US009115368B2

(12) United States Patent
Abad et al.

(10) Patent No.: US 9,115,368 B2
(45) Date of Patent: Aug. 25, 2015

(54) GENES AND USES FOR PLANT IMPROVEMENT

(75) Inventors: Mark Scott Abad, Webster Groves, MO (US); Jaclyn Cleveland, Morrisville, NC (US); Bettina Darveaux, Hillsborough, NC (US); Angie Ferguson, Morrisville, NC (US); Barry S. Goldman, St. Louis, MO (US); Balasulojini Karunanandaa, Creve Coeur, MO (US); Maria McDonald, Garner, NC (US); Daniel Riggsbee, Raleigh, NC (US); Mahmood Sayed, Cary, NC (US); Erin Slaten, Woodland Hills, CA (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 11/982,700

(22) Filed: Nov. 1, 2007

(65) Prior Publication Data

US 2008/0090998 A1 Apr. 17, 2008

Related U.S. Application Data

(62) Division of application No. 11/188,298, filed on Jul. 22, 2005, now abandoned.

(60) Provisional application No. 60/592,978, filed on Jul. 31, 2004.

(51) Int. Cl.

| | |
|---|---|
| ***A01H 5/00*** | (2006.01) |
| ***C12N 15/82*** | (2006.01) |
| ***C12N 15/63*** | (2006.01) |
| ***C07K 14/415*** | (2006.01) |
| ***C12N 9/02*** | (2006.01) |

(52) U.S. Cl.

CPC .......... *C12N 15/8271* (2013.01); *C07K 14/415* (2013.01); *C12N 9/0008* (2013.01); *C12N 15/8261* (2013.01); *C12N 15/8273* (2013.01)

(58) Field of Classification Search

None

See application file for complete search history.

(56) References Cited

U.S. PATENT DOCUMENTS

| | | | | |
|---|---|---|---|---|
| 6,025,545 | A * | 2/2000 | Lundquist et al. | 800/300.1 |
| 2003/0233675 | A1 | 12/2003 | Cao et al. | |
| 2004/0034888 | A1 | 2/2004 | Liu et al. | |
| 2006/0075522 | A1 | 4/2006 | Cleveland et al. | |
| 2006/0107345 | A1 * | 5/2006 | Alexandrov et al. | 800/278 |
| 2006/0150283 | A1 | 7/2006 | Alexandrov | |

FOREIGN PATENT DOCUMENTS

| | | | |
|---|---|---|---|
| EP | 1033405 | A2 * | 9/2000 |
| WO | WO-00/44221 | A1 | 8/2000 |
| WO | WO-02/16655 | A2 | 2/2002 |

OTHER PUBLICATIONS

Keskin et al. (Protein Science, 13:1043-1055, 2004).*
Thornton et al. (Nature structural Biology, structural genomics supplement, Nov. 2000).*
Guo et al. (PNAS, 101: 9205-9210, 2004).*
Wells, (Biochemistry 29:8509-8517, 1990).*
Ngo et al., (The Protein Folding Problem and Tertiary Structure Prediction, K. Merz., and S. Le Grand (eds.) pp. 492-495, 1994).*
Doerks et al., (TIG, 14:248-250, 1998).*
Smith et al. (Nature Biotechnology, 15:1222-1223, 1997).*
Bork et al. (TIG, 12:425-427, 1996).*
Matzke et al. Plant Physiol. (1995) 107: 679-685.
Day et al. Genes & Development 14:2869-2880 (2000).
"U.S. Appl. No. 11/188,298, Final Office Action mailed Jun. 1, 2007", 14 pgs.
"U.S. Appl. No. 11/188,298, Non Final Office Action mailed Sep. 8, 2006", 21 pgs.
"U.S. Appl. No. 11/188,298, Response filed Mar. 8, 2007 to Non Final Office Action mailed Sep. 8, 2006", 14 pgs.
"U.S. Appl. No. 11/188,298, Response filed Jun. 21, 2006 to Restriction Requirement mailed Mar. 21, 2006", 7 pgs.
"U.S. Appl. No. 11/188,298, Restriction Requirement mailed Mar. 21, 2006", 8 pgs.
"U.S. Appl. No. 11/982,700, Declaration Under 37 CFR 1.132 from Anil Neelam dated Aug. 4, 2009", 3 pgs.
"European Application Serial No. 05106786.6, Office Action mailed Sep. 23, 2010", 4 pgs.
"European Application Serial No. 10179338.8,Partial European Search Report mailed Jun. 28, 2011", 6.
Bouche, N., et al., "GABA in plants: just a metabolite?", Trends Plant Sci., 9(3), (Mar. 2004), 110-5.
Bouche, N., et al., "Mitochondrial succinic-semialdehyde dehydrogenase of the gamma-aminobutyrate shunt is required to restrict levels of reactive oxygen intermediates in plants", Proc Natl Acad Sci U S A., 100(11), (May 27, 2003), 6843-8.
Day, Christopher D., et al., "Transgene integration into the same chromosome location can produce alleles that express at a predictable level, or alleles that are differentially silenced", Genes & Development 14, (2000), 2869-2880.
Galleschi, L., et al., "Succinic Semialdehyde Dehydrogenase in Higher Plants: Purification and Properties of the Enzyme from Triticum durum Embryos", Biochemie and Physiologie der Pflanzen, 178, (1983), 645-651.
Goodner, et al., "", NCBI, GenBank, Sequence Accession No. F98145 (contig accession No. AE008689, (Jan. 2002); U.S. Appl. No. 11/188,298 on Sep. 8, 2006.
Guo, H. H, et al., "Protein tolerance to random amino acid change", Proc Natl Acad Sci U S A., 101(25), (Jun. 22, 2004), 9205-10.
Keskin, O., et al., "A new, structurally nonredundant, diverse data set of protein-protein interfaces and its implications.", Protein Sci., 13(4), (Apr. 2004), 1043-55.
Matzke, Marjori A., et al., "How and Why Do Plants Inactivate Homologous (Trans)genes?", Plant Physiol. 107, (1995), 679-685.

(Continued)

*Primary Examiner* — Vinod Kumar

(74) *Attorney, Agent, or Firm* — Schwegman Lundberg & Woessner, P.A.

(57) ABSTRACT

Transgenic seed for crops with improved traits are provided by trait-improving recombinant DNA where plants grown from such transgenic seed exhibit one or more improved traits as compared to a control plant. Of particular interest are transgenic plants that have increased yield. The invention also provides recombinant DNA molecules for expression of a protein.

6 Claims, No Drawings

(56) References Cited

OTHER PUBLICATIONS

Sunkar, R., et al., "Overexpression of a stress-inducible aldehyde dehydrogenase gene from *Arabidopsis thaliana* in transgenic plants improves stress tolerance", Plant J., 35(4), (Aug. 2003), 452-64.
Thornton, Janet M, et al., "From structure to function: approaches and limitations", Nat Struct Biol. 7(Suppl), (Nov. 2000), 991-4.
Valvekens, D., et al., "*Agrobacterium tumefaciens*-mediated transformation of *Arabidopsis thaliana* root explants by using kanamycin selection", Proc Natl Acad Sci U S A., 85(15), (Aug. 1988), 5536-40.
"European Application Serial No. 05106786.6, Reply filed Apr. 2, 2007 to Office Action mailed Sep. 22, 2006".
"European Application Serial No. 05106786.6, Office Action mailed May 23, 2008", 4 pgs.
"European Application Serial No. 05106786.6, Office Action mailed Jul. 20, 2009", 3 pgs.
"European Application Serial No. 05106786.6, Office Action mailed Sep. 22, 2006", 3 pgs.
"European Application Serial No. 05106786.6, Reply filed Nov. 30, 2009 to Office Action mailed Jul. 20, 2009", 6 pgs.
"European Application Serial No. 05106786.6, Reply filed Dec. 2, 2008 to Office Action mailed May 23, 2008", 7 pgs.
"European Application Serial No. 10179338.8, European Search Report mailed Oct. 14, 2011", 8 pgs.

* cited by examiner

GENES AND USES FOR PLANT IMPROVEMENT

CROSS REFERENCE TO RELATED APPLICATIONS

This application is a divisional of and claims the benefit of priority of U.S. application Ser. No. 11/188,298, filed Jul. 22, 2005, which application claims the benefit of priority under 35USC §119(e) of U.S. provisional application Ser. No. 60/592,978, filed Jul. 31, 2004, herein incorporated by reference in its entirety.

INCORPORATION OF SEQUENCE LISTING

Two copies of the sequence listing (Copy 1 and Copy 2) and a computer readable form (CRF) of the sequence listing, all on CD-ROMs, each containing the file named "pa__01184__53452B.rpt", which is 67,108,864 bytes (measured in MS-WINDOWS, MEDIUM TYPE: CD-ROM (ASC11 TEXT) COMPUTER: IBM PC/XT/AT, IBM PS/2 OR COMPATIBLES. OPERATING SYSTEM: DOS/WINDOWS 2000/NT) and was created on Jul. 18, 2005, are herein incorporated by reference.

FIELD OF THE INVENTION

Disclosed herein are inventions in the field of plant genetics and developmental biology. More specifically, this invention provides transgenic seeds for crops, wherein the genome of said seed comprises recombinant DNA, the expression of which results in the production of transgenic plants that have improved trait(s).

BACKGROUND OF THE INVENTION

Transgenic plants with improved traits such as improved yield, environmental stress tolerance, pest resistance, herbicide tolerance, modified seed compositions, and the like are desired by both farmers and consumers. Although considerable efforts in plant breeding have provided significant gains in desired traits, the ability to introduce specific DNA into plant genomes provides further opportunities for generation of plants with improved and/or unique traits. The ability to develop transgenic plants with improved traits depends in part on the identification of genes that are useful in recombinant DNA constructs for production of transformed plants with improved properties.

SUMMARY OF THE INVENTION

This invention provides transgenic seeds, transgenic plants and DNA constructs with trait-improving recombinant DNA from a gene for a protein having an amino acid sequence with at least 90% identity to a consensus amino acid sequence in the group consisting of SEQ ID NO: 270 and its homologs through SEQ ID NO: 538, where the respective homolog proteins have amino acid sequences SEQ ID NO: 539 through SEQ ID NO: 22568, as indicated in Table 17. In some cases of trait improvement, the recombinant DNA encodes a protein; in other cases, the recombinant DNA suppresses endogenous protein expression. In a broad aspect this invention provides transgenic seeds for growing crop plants with improved traits, such crop plants with improved traits and the plant parts including transgenic seed produced by such crop plants. The improved traits provided by the recombinant DNA in the transgenic crop plant of this invention are identified by comparison to a control plant, i.e., a plant without the trait-improving recombinant DNA. In one aspect of the invention, transgenic crop plant grown from the transgenic seed has improved yield, as compared to the yield of a control plant, e.g., a plant without the recombinant DNA that produces the increased yield. Some plants of this invention exhibit increased yield by producing a yield increase under non-stress conditions. Other plants of this invention exhibit increased yield by producing a yield increase under one or more environmental stress conditions including, but not limited to, water deficit stress, cold stress, heat stress, high salinity stress, shade stress, and low nitrogen availability stress. Still other plants of this invention have other improved phenotypes, such as improved plant development, plant morphology, plant physiology or seed composition as compared to a corresponding trait of a control plant. The various aspects of this invention are especially useful for transgenic seed and transgenic plants having improved traits in corn (maize), soybean, cotton, canola (rape), wheat, sunflower, sorghum, alfalfa, barley, millet, rice, tobacco, fruit and vegetable crops, and turfgrass.

The invention also comprises recombinant DNA constructs. In one aspect, such recombinant DNA constructs useful for the transgenic seed and transgenic plants of this invention comprise a promoter functional in a plant cell operably linked to a DNA segment for expressing a protein associated with a trait in a model plant or a homologue. In another aspect the recombinant DNA constructs useful for the transgenic seed and transgenic plants of this invention comprise a promoter functional in a plant cell operably linked to a DNA segment for suppressing the level of an endogenous plant protein which is a homologue to a model-plant protein, the suppression of which is associated with an improved trait. Suppression can be effected by any of a variety of methods known in the art, e.g., post transcriptional suppression by anti-sense, sense, dsRNA and the like or by transcriptional suppression.

This invention also provides a method of producing a transgenic crop plant having at least one improved trait, wherein the method comprises providing to a grower of transgenic seeds comprising recombinant DNA for expression or suppression of a trait-improving gene provided herein, and growing transgenic plant from said transgenic seed. Such methods are used to generate transgenic crop plants having at least one improved trait under one or more environmental stress conditions including, but not limited to, water deficit stress, cold stress, heat stress, high salinity stress, shade stress, and low nitrogen availability stress. In another aspect, such methods are used to generate transgenic crop plants having improved plant development, plant morphology, plant physiology or seed component phenotype as compared to a corresponding phenotype of a control plant. Of particular interest are uses of such methods to generate transgenic crop plants having increased yield under non-stress condition, or under one or more stress conditions.

DETAILED DESCRIPTION OF THE INVENTION

This invention provides transgenic plant seed having in its genome trait-improving recombinant DNA and transgenic plants grown from such seed which exhibit an improved trait as compared a control plant. In one aspect, the invention provides transgenic plants where the improved trait is one or more of improved drought stress tolerance, improved heat stress tolerance, improved cold stress tolerance, improved high salinity stress tolerance, improved low nitrogen availability stress tolerance, improved shade stress tolerance, improved plant growth and development at the stages of seed imbibition through early vegetative phase, and improved plant growth and development at the stages of leaf development, flower production and seed maturity. Particular transgenic plants grown from transgenic seeds of this invention exhibit increased seed yield. Recombinant DNA constructs used in this invention comprise recombinant DNA disclosed herein which produces mRNA to modulate gene expression imparting improved traits to plants.

"Gene" means all or part of the DNA that encodes a protein or mRNA, e.g., chromosomal DNA, plasmid DNA, cDNA, or synthetic DNA, and includes DNA regions flanking the coding sequences, e.g., introns, 5'UTR, 3'UTR, promoters and other DNA involved in the regulation of expression.

"Transgenic seed" means plant seed having a genome altered by the incorporation of recombinant DNA, e.g., by transformation. "Transgenic plant" means a plant produced from an original transformation event, or progeny from later generations or crosses of a plant to a transformed plant, so long as the progeny contains the recombinant DNA in its genome. "Recombinant DNA" means a DNA molecule having a genetically engineered modification introduced through a combination of endogenous and/or exogenous DNA elements in a transcription unit, manipulation via mutagenesis, restriction enzymes, and the like or simply by inserting multiple copies of a native transcription unit. Recombinant DNA may comprise DNA segments obtained from different sources, or DNA segments obtained from the same source, but which have been manipulated to join DNA segments which do not naturally exist in the joined form. Recombinant DNA can exist outside of a cell, e.g., as a PCR fragment or in a plasmid, or can be integrated into a genome such as a plant genome.

"Trait" means a physiological, morphological, biochemical, or physical characteristic of a plant or particular plant material or cell. In some instances the characteristic is visible to the human eye, e.g., seed or plant size, or can be measured by biochemical techniques, e.g., detecting the protein, starch, or oil content of seed or leaves, or by observation of a metabolic or physiological process, e.g., by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance.

"Control plant" is a plant without trait-improving recombinant DNA. A control plant is used to measure and compare trait improvement in a transgenic plant with such trait-improving recombinant DNA. One suitable control plant is a non-transgenic plant of the parental line that was used to generate a transgenic plant. Another suitable control plant is a transgenic plant that comprises recombinant DNA without the specific trait producing DNA, e.g., simply a marker gene. Another suitable control plant is a negative segregant progeny of hemizygous transgenic plant. In certain demonstrations of trait improvement, e.g., in field conditions, the use of a limited number of control plants can cause a wide variation in the control dataset. To minimize the effect of the variation within the control dataset, a "reference" is used, i.e., a trimmed mean of all data from both transgenic and control plants grown under the same conditions and at the same developmental stage. The trimmed mean is calculated by eliminating a specific percentage, i.e., 20%, of the smallest and largest observation from the data set and then calculating the average of the remaining observation.

"Trait improvement" means a detectable and desirable difference in a characteristic in a transgenic plant relative to a control plant or a reference. In some cases, the trait improvement is measured quantitatively. For example, the trait improvement can entail at least a 2% desirable difference in an observed trait, at least a 5% desirable difference, at least about a 10% desirable difference, at least about a 20% desirable difference, at least about a 30% desirable difference, at least about a 50% desirable difference, at least about a 70% desirable difference, or at least about a 100% difference, or an even greater desirable difference. In other cases, the trait improvement is only measured qualitatively. It is known that there are natural variations in a trait. Therefore, the trait improvement observed entails a change of the normal distribution of the trait in the transgenic plant compared with the trait distribution observed in a control plant or a reference, which is evaluated by statistical methods provided herein. Trait improvement includes, but not limited to, yield increase, including increased yield under non-stress conditions and increased yield under environmental stress conditions. Stress conditions may include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. Many agronomic traits can affect "yield", including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Other traits that can affect yield include, efficiency of germination (including germination in stressed conditions), growth rate (including growth rate in stressed conditions), ear number, seed number per ear, seed size, composition of seed (starch, oil, protein) and characteristics of seed fill. Also of interest is the generation of transgenic plants that demonstrate desirable phenotypic properties that may or may not confer an increase in overall plant yield. Such properties include improved plant morphology, plant physiology or improved components of the mature seed harvested from the transgenic plant.

"Yield-limiting environment" means a condition under which a plant would have the limitation on yield including environmental stress conditions.

"Stress condition" means a condition unfavorable for a plant, which adversely affects plant metabolism, growth and/or development. A plant under the stress condition typically shows reduced germination rate, retarded growth and development, reduced photosynthesis rate, and eventually leading to reduction in yield. Specifically, "water deficit stress" means sub-optimal conditions for water and humidity needed for normal growth of natural plants. Relative water content (RWC) is one physiological measure of plant water deficit. RWC measures the effect of osmotic adjustment in plant water status, when a plant is under stressed conditions. RWC can result from heat, drought, high salinity and induced osmotic stress.

"Cold stress" means exposure of a plant to temperatures below, e.g., at least two or more degrees Celsius below, those temperatures that are normal for a particular species or particular strain of plant.

"Sufficient nitrogen growth condition" means a growth condition where the soil or growth medium contains or receives enough amounts of nitrogen nutrient to sustain a healthy plant growth and/or for a plant to reach its typical yield for a particular plant species or a particular strain.

"Nitrogen nutrient" means any one or any mix of the nitrate salts commonly used as plant nitrogen fertilizer, including, but not limited to, potassium nitrate, calcium nitrate, sodium nitrate, ammonium nitrate. "Ammonium" means any one or any mix of the ammonium salts commonly used as plant nitrogen fertilizer, e.g., ammonium nitrate, ammonium chloride, ammonium sulfate, etc. Those skilled in the art know what constitutes such soil, media and fertilizer inputs for most plant species. "Low nitrogen availability stress" means a plant growth condition that does not contain sufficient nitrogen nutrient to maintain a healthy plant growth and/or for a plant to reach its typical yield under a sufficient nitrogen growth condition; a useful low nitrogen availability stress is a growth condition with 50% or less of the conventional nitrogen inputs.

"Shade stress" means a limited light availability that triggers the shade avoidance response in plant. Plants are subject to shade stress when localized at lower part of the canopy, or in close proximity of neighboring vegetation. Shade stress is exacerbated when the planting density exceeds the average prevailing density for a particular plant species. The average prevailing densities per acre of a few other examples of crop plants in the USA in the year 2000 were: wheat 1,000,000-1,500,000; rice 650,000-900,000; soybean 150,000-200,000, canola 260,000-350,000, sunflower 17,000-23,000 and cotton 28,000-55,000 plants per acre.

"Increased yield" of a transgenic plant of this invention is evidenced and measured in a number of ways, including test weight, seed number per plant, seed weight, seed number per unit area (i.e., seeds, or weight of seeds, per acre), bushels per acre, tons per acre, tons per acre, kilo per hectare. For example, corn yield is measured as production of shelled corn kernels per unit of production area, e.g., in bushels per acre or metric tons per hectare, often reported on a moisture adjusted basis, e.g., at 15.5% moisture. Increased yield is often achieved from improved utilization of key biochemical compounds, such as nitrogen, phosphorous and carbohydrate, or from improved responses to environmental stresses, such as cold, heat, drought, salt, and attack by pests or pathogens. Trait-improving recombinant DNA is used to provide transgenic plants having improved growth and development, and ultimately increased yield, as the result of modified expression of plant growth regulators or modification of cell cycle or photosynthesis pathways.

"Expression" means transcription of DNA to produce RNA. The resulting RNA includes mRNA encoding a protein, antisense RNA that is complementary to an mRNA encoding a protein, or an RNA transcript comprising a combination of sense and antisense gene regions, such as for use in RNAi gene suppression. Expression also means production of encoded protein from mRNA.

"Promoter" means a region of DNA upstream from the start of transcription and involved in recognition and binding of RNA polymerase and other proteins to initiate transcription. A "plant promoter" is a promoter capable of initiating transcription in plant cells whether or not its origin is a plant cell. Exemplary plant promoters include, but are not limited to, those that are obtained from plants, plant viruses, and bacteria which comprise genes expressed in plant cells such as *Agrobacterium* or *Rhizobium*. "Tissue preferred" promoters preferentially regulate expression in certain tissues, such as leaves, roots, or seeds. "Tissue specific" promoters predominately regulate expression only in certain tissues. "Cell type" specific promoter primarily regulate expression in certain cell types in one or more organs, for example, vascular cells in roots or leaves. "Inducible" and "repressible" promoters regulate expression under environmental influences, under the effect of anaerobic conditions, certain chemicals, or the presence of light. Tissue specific, tissue preferred, cell type specific, and inducible promoters constitute a class of "non-constitutive" promoters. "Constitutive" promoters are promoters which are active under most conditions. "Anti-sense orientation" refers to a DNA sequence that is operably linked to a promoter in an orientation where the anti-sense strand is transcribed. "Operably linked" refers to an association of two or more DNA elements in a single construct so that the function of one is affected by the other. For example, a promoter is operably linked with transcribable DNA when it is capable of affecting the expression of that DNA; that is, the coding DNA is under the transcriptional control of the promoter.

"Consensus sequence" means an artificial, amino acid sequence of conserved parts of the proteins encoded by homologous genes, e.g., as determined by a CLUSTALW alignment of amino acid sequence of homolog proteins.

"Homologs" means genes that produce functionally similar proteins, e.g., in the same organism or in different organisms. A gene can be related to a homolog gene by descent from a common ancestral DNA. Homologs include genes where the relationship is by speciation, e.g., often called orthologs, or by genetic duplication, e.g., often called paralogs. More specifically, "orthologs" include homologs in different species that evolved from a common ancestral gene by specification. Normally orthologs retain the same function in the course of evolution. "Paralogs" include homologs in the same species that have diverged from each other as a consequence of genetic duplication.

"Percent identity" means the extent to which two optimally aligned DNA or protein segments are invariant throughout a window of alignment of components, e.g., nucleotide sequence or amino acid sequence. An "identity fraction" for aligned segments of sequences is the number of identical components which are shared divided by the total number of sequence components in the segment used as a reference over a window of alignment which is the smaller of the sequences. "Percent identity" ("% identity") is the identity fraction times 100. "% identity" to a consensus amino acid sequence" is 100 times the identity fraction in a window of alignment of an amino acid sequence of a test protein optimally aligned to consensus amino acid sequence of this invention.

"*Arabidopsis*" means plants of *Arabidopsis thaliana.*

Recombinant DNA Constructs

This invention provides recombinant DNA constructs comprising DNA elements for imparting one or more improved traits to transgenic plant. Such constructs typically comprise a promoter operatively linked to DNA to provide for expression of a protein or RNA for gene suppression in a target plant. Recombinant DNA constructs can also include additional regulatory elements, such as 5' or 3' untranslated regions (UTRs) such as polyadenylation sites, introns, and transit or signal peptides. Such recombinant DNA constructs are assembled using methods known to those of ordinary skill in the art.

In certain embodiments, recombinant DNA constructs comprise sense-oriented, trait-imparting DNA operably linked to a promoter that is functional in a plant to provide for expression of the trait-imparting DNA in the sense orientation such that a desired protein is produced. In other embodiments at least a part of the trait-imparting DNA is in an anti-sense orientation for gene suppression activity.

Recombinant DNA constructs, especially for expressing proteins are typically prepared with a 3' UTR that a polyadenylation site and signal. Recombinant DNA constructs can also include a transit peptide for targeting of a gene target to a plant organelle, particularly to a chloroplast, leucoplast or other plastid organelle. For descriptions of the use of chloroplast transit peptides, see U.S. Pat. No. 5,188,642 and U.S. Pat. No. 5,728,925, incorporated herein by reference.

Table 1 provides a list of genes that can provide trait-imparting DNA for recombinant DNA constructs. DNA from each gene was used in a model plant (*Arabidopsis*) to discover associations with improved traits. The DNA was also used to identify homologs from which a consensus amino acid sequence is defined for characterizing the aspects of the invention where recombinant DNA is incorporated in the transgenic seeds, transgenic plants, DNA constructs and methods of this invention. With reference to Table 1:

"NUC SEQ ID NO" refers to a SEQ ID NO. for particular DNA sequence in the Sequence Listing.

"PEP SEQ ID NO" refers to a SEQ ID NO. in the Sequence Listing for the amino acid sequence of a protein cognate to a particular DNA "construct_id" refers to arbitrary number used to identify a particular recombinant DNA construct comprising the particular DNA.

"gene" refers to an arbitrary name used to identify the particular DNA.

"orientation" refers to the orientation of the particular DNA in a recombinant DNA construct relative to the promoter.

"species" refers to the organism from which the particular DNA was derived.

TABLE 1

| Nuc SEQ ID | Pep SEQ ID | construct_id | Gene | orientation | Species |
|---|---|---|---|---|---|
| 1 | 270 | 14324 | CGPG1560 | SENSE | *Arabidopsis thaliana* |
| 2 | 271 | 17484 | CGPG2630 | SENSE | *Arabidopsis thaliana* |
| 3 | 272 | 19109 | CGPG1381 | ANTI-SENSE | *Arabidopsis thaliana* |
| 4 | 273 | 70423 | CGPG3165 | SENSE | *Arabidopsis thaliana* |
| 5 | 274 | 70424 | CGPG3180 | SENSE | *Arabidopsis thaliana* |
| 6 | 275 | 70480 | CGPG3833 | SENSE | *Arabidopsis thaliana* |
| 7 | 276 | 70509 | CGPG2420 | SENSE | *Arabidopsis thaliana* |
| 8 | 277 | 70647 | CGPG4334 | SENSE | *Arabidopsis thaliana* |
| 9 | 278 | 70675 | CGPG4519 | SENSE | *Arabidopsis thaliana* |
| 10 | 279 | 70829 | CGPG518 | SENSE | *Arabidopsis thaliana* |
| 11 | 280 | 70849 | CGPG596 | SENSE | *Arabidopsis thaliana* |
| 12 | 281 | 71627 | CGPG1270 | SENSE | *Arabidopsis thaliana* |
| 13 | 282 | 71934 | CGPG2294 | SENSE | *Arabidopsis thaliana* |
| 14 | 283 | 72615 | CGPG4829 | SENSE | *Arabidopsis thaliana* |
| 15 | 284 | 72927 | CGPG1477 | SENSE | *Arabidopsis thaliana* |
| 16 | 285 | 73014 | CGPG5692 | SENSE | *Xenorhabdus nematophilus* 85816 |
| 17 | 286 | 73559 | CGPG6535 | SENSE | *Bacillus subtilis* 168 |
| 18 | 287 | 74251 | CGPG5489 | SENSE | *Arabidopsis thaliana* |
| 19 | 288 | 19631 | CGPG3627 | SENSE | *Arabidopsis thaliana* |
| 20 | 289 | 70121 | CGPG2380 | SENSE | *Saccharomyces cerevisiae* |
| 21 | 290 | 70654 | CGPG4352 | SENSE | *Arabidopsis thaliana* |
| 22 | 291 | 70696 | CGPG4590 | SENSE | *Arabidopsis thaliana* |
| 23 | 292 | 70713 | CGPG1462 | ANTI-SENSE | *Arabidopsis thaliana* |
| 24 | 293 | 70740 | CGPG3700 | SENSE | *Arabidopsis thaliana* |
| 25 | 294 | 71321 | CGPG4418 | SENSE | *Arabidopsis thaliana* |
| 26 | 295 | 71835 | CGPG4634 | SENSE | *Arabidopsis thaliana* |
| 27 | 296 | 72934 | CGPG5798 | SENSE | *Saccharomyces cerevisiae* |
| 28 | 297 | 72945 | CGPG5787 | SENSE | *Saccharomyces cerevisiae* |
| 29 | 298 | 72980 | CGPG5773 | SENSE | *Saccharomyces cerevisiae* |
| 30 | 299 | 73504 | CGPG6480 | SENSE | *Synechocystis* sp. PCC 6803 |
| 31 | 300 | 73507 | CGPG6504 | SENSE | *Bacillus subtilis* 168 |
| 32 | 301 | 73573 | CGPG6462 | SENSE | *Agrobacterium tumefacians* C58 |
| 33 | 302 | 73586 | CGPG6471 | SENSE | *Bacillus subtilis* 168 |
| 34 | 303 | 73770 | CGPG5435 | SENSE | *Arabidopsis thaliana* |
| 35 | 304 | 74105 | CGPG6574 | SENSE | *Xenorhabdus nematophilus* 86068 |
| 36 | 305 | 74111 | CGPG6622 | SENSE | *Escherichia coli* K-12 |
| 37 | 306 | 74136 | CGPG6632 | SENSE | *Synechocystis* |
| 38 | 307 | 74139 | CGPG6561 | SENSE | *Escherichia coli* K-12 |
| 39 | 308 | 74267 | CGPG5364 | SENSE | *Arabidopsis thaliana* |
| 40 | 309 | 74291 | CGPG5363 | SENSE | *Arabidopsis thaliana* |
| 41 | 310 | 74318 | CGPG5826 | SENSE | *Arabidopsis thaliana* |
| 42 | 311 | 74319 | CGPG5831 | SENSE | *Arabidopsis thaliana* |
| 43 | 312 | 74324 | CGPG5885 | SENSE | *Arabidopsis thaliana* |
| 44 | 313 | 74512 | CGPG32 | SENSE | *Arabidopsis thaliana* |
| 45 | 314 | 74583 | CGPG6649 | SENSE | *Ralstonia metallidurans* CH34 |
| 46 | 315 | 70427 | CGPG3067 | SENSE | *Arabidopsis thaliana* |
| 47 | 316 | 71811 | CGPG4426 | SENSE | *Arabidopsis thaliana* |
| 48 | 317 | 73463 | CGPG6384 | SENSE | *Ralstonia metallidurans* CH34 |
| 49 | 318 | 72081 | CGPG5279 | SENSE | *Glycine max* |
| 50 | 319 | 10139 | CGPG101 | ANTI-SENSE | *Arabidopsis thaliana* |
| 51 | 320 | 11410 | CGPG103 | SENSE | *Arabidopsis thaliana* |
| 52 | 321 | 11604 | CGPG48 | ANTI-SENSE | *Arabidopsis thaliana* |
| 53 | 322 | 12368 | CGPG1006 | SENSE | *Arabidopsis thaliana* |
| 54 | 323 | 13502 | CGPG1354 | SENSE | *Arabidopsis thaliana* |
| 55 | 324 | 13745 | CGPG1576 | ANTI-SENSE | *Arabidopsis thaliana* |
| 56 | 325 | 13821 | CGPG1569 | SENSE | *Arabidopsis thaliana* |
| 57 | 326 | 14240 | CGPG1697 | SENSE | *Arabidopsis thaliana* |
| 58 | 327 | 14718 | CGPG1082 | SENSE | *Arabidopsis thaliana* |

TABLE 1-continued

| Nuc SEQ ID | Pep SEQ ID | construct_id | Gene | orientation | Species |
|---|---|---|---|---|---|
| 59 | 328 | 17022 | CGPG1774 | SENSE | *Arabidopsis thaliana* |
| 60 | 329 | 17924 | CGPG2882 | SENSE | *Arabidopsis thaliana* |
| 61 | 330 | 18259 | CGPG3368 | SENSE | *Arabidopsis thaliana* |
| 62 | 331 | 19171 | CGPG2952 | SENSE | *Saccharomyces cerevisiae* |
| 63 | 332 | 19201 | CGPG2332 | SENSE | *Arabidopsis thaliana* |
| 64 | 333 | 19317 | CGPG3662 | SENSE | *Xanthomonas* |
| 65 | 334 | 70417 | CGPG3427 | SENSE | *Arabidopsis thaliana* |
| 66 | 335 | 70467 | CGPG3785 | SENSE | *Arabidopsis thaliana* |
| 67 | 336 | 70806 | CGPG712 | SENSE | *Arabidopsis thaliana* |
| 68 | 337 | 70818 | CGPG479 | SENSE | *Arabidopsis thaliana* |
| 69 | 338 | 70820 | CGPG655 | SENSE | *Arabidopsis thaliana* |
| 70 | 339 | 70919 | CGPG4029 | SENSE | *Glycine max* |
| 71 | 340 | 71623 | CGPG4696 | SENSE | *Arabidopsis thaliana* |
| 72 | 341 | 71662 | CGPG4679 | SENSE | *Glycine max* |
| 73 | 342 | 71693 | CGPG4652 | SENSE | *Glycine max* |
| 74 | 343 | 72384 | CGPG4639 | SENSE | *Saccharomyces cerevisiae* |
| 75 | 344 | 72439 | CGPG5075 | SENSE | *Arabidopsis thaliana* |
| 76 | 345 | 72619 | CGPG4835 | SENSE | *Arabidopsis thaliana* |
| 77 | 346 | 72624 | CGPG4842 | SENSE | *Arabidopsis thaliana* |
| 78 | 347 | 72715 | CGPG5521 | SENSE | *Saccharomyces cerevisiae* |
| 79 | 348 | 72754 | CGPG5548 | SENSE | *Saccharomyces cerevisiae* |
| 80 | 349 | 72819 | CGPG4989 | SENSE | *Arabidopsis thaliana* |
| 81 | 350 | 75516 | CGPG7689 | SENSE | *Glycine max* |
| 82 | 351 | 75701 | CGPG7856 | SENSE | *Glycine max* |
| 83 | 352 | 73515 | CGPG6473 | SENSE | *Bacillus subtilis* 168 |
| 84 | 353 | 74684 | CGPG6360 | SENSE | *Arabidopsis thaliana* |
| 85 | 354 | 19542 | CGPG3069 | SENSE | *Arabidopsis thaliana* |
| 86 | 355 | 19618 | CGPG3574 | SENSE | *Arabidopsis thaliana* |
| 87 | 356 | 19649 | CGPG3140 | SENSE | *Arabidopsis thaliana* |
| 88 | 357 | 19745 | CGPG3973 | SENSE | *Glycine max* |
| 89 | 358 | 19768 | CGPG4096 | SENSE | *Glycine max* |
| 90 | 359 | 19772 | CGPG3939 | SENSE | *Glycine max* |
| 91 | 360 | 19779 | CGPG4113 | SENSE | *Glycine max* |
| 92 | 361 | 19833 | CGPG4074 | SENSE | *Glycine max* |
| 93 | 362 | 19862 | CGPG3961 | SENSE | *Glycine max* |
| 94 | 363 | 19879 | CGPG4009 | SENSE | *Glycine max* |
| 95 | 364 | 70445 | CGPG3728 | SENSE | *Arabidopsis thaliana* |
| 96 | 365 | 70738 | CGPG3195 | SENSE | *Arabidopsis thaliana* |
| 97 | 366 | 71437 | CGPG4043 | SENSE | *Glycine max* |
| 98 | 367 | 71572 | CGPG4520 | SENSE | *Arabidopsis thaliana* |
| 99 | 368 | 71617 | CGPG1227 | SENSE | *Arabidopsis thaliana* |
| 100 | 369 | 72532 | CGPG4780 | SENSE | *Arabidopsis thaliana* |
| 101 | 370 | 72757 | CGPG5572 | SENSE | *Arabidopsis thaliana* |
| 102 | 371 | 73412 | CGPG6448 | SENSE | *Pseudomonas syringae* var tomato DC3000 |
| 103 | 372 | 74102 | CGPG6550 | SENSE | *Bacillus halodurans* C-125 |
| 104 | 373 | 72633 | CGPG4853 | SENSE | *Arabidopsis thaliana* |
| 105 | 374 | 72456 | CGPG4745 | SENSE | *Arabidopsis thaliana* |
| 106 | 375 | 72963 | CGPG1746 | SENSE | *Arabidopsis thaliana* |
| 107 | 376 | 70426 | CGPG3199 | SENSE | *Arabidopsis thaliana* |
| 108 | 377 | 70772 | CGPG4627 | SENSE | *Arabidopsis thaliana* |
| 109 | 378 | 71137 | CGPG125 | SENSE | *Arabidopsis thaliana* |
| 110 | 379 | 71529 | CGPG2808 | SENSE | *Arabidopsis thaliana* |
| 111 | 380 | 71601 | CGPG1858 | SENSE | *Arabidopsis thaliana* |
| 112 | 381 | 72362 | CGPG983 | SENSE | *Arabidopsis thaliana* |
| 113 | 382 | 72466 | CGPG4767 | SENSE | *Arabidopsis thaliana* |
| 114 | 383 | 72524 | CGPG4770 | SENSE | *Arabidopsis thaliana* |
| 115 | 384 | 73085 | CGPG5689 | SENSE | *Synechocystis* sp. PCC 6803 |
| 116 | 385 | 74241 | CGPG5457 | SENSE | *Arabidopsis thaliana* |
| 117 | 386 | 74247 | CGPG5475 | SENSE | *Arabidopsis thaliana* |
| 118 | 387 | 74284 | CGPG5413 | SENSE | *Arabidopsis thaliana* |
| 119 | 388 | 74652 | CGPG6168 | SENSE | *Arabidopsis thaliana* |
| 120 | 389 | 70437 | CGPG3706 | SENSE | *Arabidopsis thaliana* |
| 121 | 390 | 71633 | CGPG857 | SENSE | *Arabidopsis thaliana* |
| 122 | 391 | 72948 | CGPG5617 | SENSE | *Arabidopsis thaliana* |
| 123 | 392 | 72519 | CGPG4749 | SENSE | *Arabidopsis thaliana* |
| 124 | 393 | 10475 | CGPG399 | SENSE | *Arabidopsis thaliana* |
| 125 | 394 | 11120 | CGPG459 | ANTI-SENSE | *Arabidopsis thaliana* |
| 126 | 395 | 19736 | CGPG4129 | SENSE | *Glycine max* |
| 127 | 396 | 71606 | CGPG4715 | SENSE | *Arabidopsis thaliana* |
| 128 | 397 | 71840 | CGPG4353 | SENSE | *Arabidopsis thaliana* |
| 129 | 398 | 74240 | CGPG5454 | SENSE | *Arabidopsis thaliana* |
| 130 | 399 | 74331 | CGPG5834 | SENSE | *Arabidopsis thaliana* |
| 131 | 400 | 74610 | CGPG6048 | SENSE | *Arabidopsis thaliana* |
| 132 | 401 | 75527 | CGPG7682 | SENSE | *Glycine max* |
| 133 | 402 | 70681 | CGPG4584 | SENSE | *Arabidopsis thaliana* |
| 134 | 403 | 71663 | CGPG4638 | SENSE | *Xanthomonas* |
| 135 | 404 | 72769 | CGPG5573 | SENSE | *Arabidopsis thaliana* |
| 136 | 405 | 71508 | CGPG1541 | SENSE | *Arabidopsis thaliana* |

TABLE 1-continued

| Nuc SEQ ID | Pep SEQ ID | construct_id | Gene | orientation | Species |
|---|---|---|---|---|---|
| 137 | 406 | 74248 | CGPG5476 | SENSE | *Arabidopsis thaliana* |
| 138 | 407 | 72771 | CGPG2166 | SENSE | *Arabidopsis thaliana* |
| 139 | 408 | 72085 | CGPG5228 | SENSE | *Arabidopsis thaliana* |
| 140 | 409 | 72744 | CGPG5563 | SENSE | *Saccharomyces cerevisiae* |
| 141 | 410 | 73039 | CGPG810 | SENSE | *Arabidopsis thaliana* |
| 142 | 411 | 73054 | CGPG5754 | SENSE | *Saccharomyces cerevisiae* |
| 143 | 412 | 73501 | CGPG6456 | SENSE | *Agrobacterium tumefacians* C58 |
| 144 | 413 | 19707 | CGPG4179 | SENSE | *Glycine max* |
| 145 | 414 | 19951 | CGPG3941 | SENSE | *Glycine max* |
| 146 | 415 | 19967 | CGPG4032 | SENSE | *Glycine max* |
| 147 | 416 | 70543 | CGPG3815 | SENSE | *Arabidopsis thaliana* |
| 148 | 417 | 70707 | CGPG1273 | ANTI-SENSE | *Arabidopsis thaliana* |
| 149 | 418 | 70719 | CGPG1712 | ANTI-SENSE | *Arabidopsis thaliana* |
| 150 | 419 | 71134 | CGPG817 | SENSE | *Arabidopsis thaliana* |
| 151 | 420 | 71146 | CGPG2928 | SENSE | *Arabidopsis thaliana* |
| 152 | 421 | 71660 | CGPG4690 | SENSE | *Arabidopsis thaliana* |
| 153 | 422 | 72086 | CGPG5236 | SENSE | *Arabidopsis thaliana* |
| 154 | 423 | 72632 | CGPG4852 | SENSE | *Arabidopsis thaliana* |
| 155 | 424 | 72716 | CGPG5529 | SENSE | *Saccharomyces cerevisiae* |
| 156 | 425 | 72723 | CGPG1848 | SENSE | *Arabidopsis thaliana* |
| 157 | 426 | 72987 | CGPG1787 | SENSE | *Arabidopsis thaliana* |
| 158 | 427 | 74109 | CGPG6606 | SENSE | *Xenorhabdus nematophilus* 86068 |
| 159 | 428 | 74140 | CGPG6569 | SENSE | *Bacillus halodurans* C-125 |
| 160 | 429 | 74191 | CGPG6597 | SENSE | *Rhodobacter sphaeroides* 2.4.1 |
| 161 | 430 | 74265 | CGPG5356 | SENSE | *Arabidopsis thaliana* |
| 162 | 431 | 74369 | CGPG6076 | SENSE | *Arabidopsis thaliana* |
| 163 | 432 | 70217 | CGPG6 | SENSE | *Arabidopsis thaliana* |
| 164 | 433 | 72711 | CGPG1846 | SENSE | *Arabidopsis thaliana* |
| 165 | 434 | 70932 | CGPG4089 | SENSE | *Glycine max* |
| 166 | 435 | 73518 | CGPG6497 | SENSE | *Pseudomonas fluorescens* PfO-1 |
| 167 | 436 | 19771 | CGPG4011 | SENSE | *Glycine max* |
| 168 | 437 | 73549 | CGPG6460 | SENSE | *Xenorhabdus nematophilus* 85816 |
| 169 | 438 | 72994 | CGPG5803 | SENSE | *Saccharomyces cerevisiae* |
| 170 | 439 | 71928 | CGPG1617 | SENSE | *Arabidopsis thaliana* |
| 171 | 440 | 72903 | CGPG5584 | SENSE | *Arabidopsis thaliana* |
| 172 | 441 | 73017 | CGPG5733 | SENSE | *Saccharomyces cerevisiae* |
| 173 | 442 | 74587 | CGPG6774 | SENSE | *Agrobacterium tumefacians* C58 |
| 174 | 443 | 72453 | CGPG4735 | SENSE | *Arabidopsis thaliana* |
| 175 | 444 | 72967 | CGPG5742 | SENSE | *Saccharomyces cerevisiae* |
| 176 | 445 | 72961 | CGPG5591 | SENSE | *Arabidopsis thaliana* |
| 177 | 446 | 73070 | CGPG5627 | SENSE | *Arabidopsis thaliana* |
| 178 | 447 | 73475 | CGPG6385 | SENSE | *Rhodopseudomonas palustris* CGA009 |
| 179 | 448 | 72916 | CGPG1814 | SENSE | *Arabidopsis thaliana* |
| 180 | 449 | 72969 | CGPG5789 | SENSE | *Saccharomyces cerevisiae* |
| 181 | 450 | 74449 | CGPG6659 | SENSE | *Agrobacterium tumefaciens* |
| 182 | 451 | 16615 | CGPG2539 | SENSE | *Agrobacterium* |
| 183 | 452 | 19187 | CGPG3310 | SENSE | *Arabidopsis thaliana* |
| 184 | 453 | 19648 | CGPG3134 | SENSE | *Arabidopsis thaliana* |
| 185 | 454 | 70354 | CGPG3995 | SENSE | *Glycine max* |
| 186 | 455 | 70421 | CGPG2942 | SENSE | *Arabidopsis thaliana* |
| 187 | 456 | 70459 | CGPG3758 | SENSE | *Arabidopsis thaliana* |
| 188 | 457 | 70465 | CGPG3775 | SENSE | *Arabidopsis thaliana* |
| 189 | 458 | 70683 | CGPG4587 | SENSE | *Arabidopsis thaliana* |
| 190 | 459 | 70725 | CGPG2097 | ANTI-SENSE | *Arabidopsis thaliana* |
| 191 | 460 | 70852 | CGPG1465 | SENSE | *Arabidopsis thaliana* |
| 192 | 461 | 71112 | CGPG934 | SENSE | *Arabidopsis thaliana* |
| 193 | 462 | 71127 | CGPG945 | SENSE | *Arabidopsis thaliana* |
| 194 | 463 | 71132 | CGPG1561 | SENSE | *Arabidopsis thaliana* |
| 195 | 464 | 71217 | CGPG95 | SENSE | *Arabidopsis thaliana* |
| 196 | 465 | 71645 | CGPG4688 | SENSE | *Arabidopsis thaliana* |
| 197 | 466 | 71726 | CGPG3894 | SENSE | *Arabidopsis thaliana* |
| 198 | 467 | 72432 | CGPG4562 | SENSE | *Arabidopsis thaliana* |
| 199 | 468 | 72450 | CGPG4732 | SENSE | *Arabidopsis thaliana* |
| 200 | 469 | 72455 | CGPG4742 | SENSE | *Arabidopsis thaliana* |
| 201 | 470 | 72727 | CGPG5522 | SENSE | *Saccharomyces cerevisiae* |
| 202 | 471 | 72817 | CGPG4987 | SENSE | *Arabidopsis thaliana* |
| 203 | 472 | 72992 | CGPG5777 | SENSE | *Saccharomyces cerevisiae* |
| 204 | 473 | 73007 | CGPG5760 | SENSE | *Saccharomyces cerevisiae* |
| 205 | 474 | 73073 | CGPG5688 | SENSE | *Synechocystis* sp. PCC 6803 |
| 206 | 475 | 73506 | CGPG6496 | SENSE | *Pseudomonas fluorescens* PfO-1 |
| 207 | 476 | 74107 | CGPG6590 | SENSE | *Sinorhizobium meliloti* 1021 |
| 208 | 477 | 74117 | CGPG6575 | SENSE | *Xenorhabdus nematophilus* 86068 |
| 209 | 478 | 74131 | CGPG6592 | SENSE | *Synechocystis* sp. PCC 6803 |
| 210 | 479 | 74344 | CGPG5929 | SENSE | *Arabidopsis thaliana* |
| 211 | 480 | 14320 | CGPG1229 | SENSE | *Arabidopsis thaliana* |
| 212 | 481 | 16756 | CGPG2117 | SENSE | *Arabidopsis thaliana* |
| 213 | 482 | 17448 | CGPG2673 | SENSE | *Arabidopsis thaliana* |
| 214 | 483 | 17633 | CGPG2839 | SENSE | *Arabidopsis thaliana* |

TABLE 1-continued

| Nuc SEQ ID | Pep SEQ ID | construct_id | Gene | orientation | Species |
|---|---|---|---|---|---|
| 215 | 484 | 18876 | CGPG3096 | SENSE | *Arabidopsis thaliana* |
| 216 | 485 | 19120 | CGPG1976 | ANTI-SENSE | *Arabidopsis thaliana* |
| 217 | 486 | 19221 | CGPG2958 | SENSE | *Arabidopsis thaliana* |
| 218 | 487 | 70206 | CGPG4116 | SENSE | *Glycine max* |
| 219 | 488 | 70223 | CGPG53 | SENSE | *Arabidopsis thaliana* |
| 220 | 489 | 70347 | CGPG3147 | SENSE | *Arabidopsis thaliana* |
| 221 | 490 | 70406 | CGPG1687 | SENSE | *Arabidopsis thaliana* |
| 222 | 491 | 70469 | CGPG3791 | SENSE | *Arabidopsis thaliana* |
| 223 | 492 | 70564 | CGPG1864 | SENSE | *Arabidopsis thaliana* |
| 224 | 493 | 70601 | CGPG2917 | SENSE | *Arabidopsis thaliana* |
| 225 | 494 | 70612 | CGPG3721 | SENSE | *Arabidopsis thaliana* |
| 226 | 495 | 70720 | CGPG1358 | ANTI-SENSE | *Arabidopsis thaliana* |
| 227 | 496 | 70735 | CGPG2661 | SENSE | *Arabidopsis thaliana* |
| 228 | 497 | 70846 | CGPG377 | SENSE | *Arabidopsis thaliana* |
| 229 | 498 | 70923 | CGPG4020 | SENSE | *Glycine max* |
| 230 | 499 | 71149 | CGPG3457 | SENSE | *Arabidopsis thaliana* |
| 231 | 500 | 71608 | CGPG4687 | SENSE | *Arabidopsis thaliana* |
| 232 | 501 | 71739 | CGPG4345 | SENSE | *Arabidopsis thaliana* |
| 233 | 502 | 72014 | CGPG5230 | SENSE | *Arabidopsis thaliana* |
| 234 | 503 | 72051 | CGPG5241 | SENSE | *Arabidopsis thaliana* |
| 235 | 504 | 74259 | CGPG5343 | SENSE | *Arabidopsis thaliana* |
| 236 | 505 | 72463 | CGPG4760 | SENSE | *Arabidopsis thaliana* |
| 237 | 506 | 72902 | CGPG5597 | SENSE | *Arabidopsis thaliana* |
| 238 | 507 | 74572 | CGPG6640 | SENSE | *Synechocystis* |
| 239 | 508 | 73055 | CGPG5768 | SENSE | *Saccharomyces cerevisiae* |
| 240 | 509 | 74103 | CGPG6558 | SENSE | *Escherichia coli* K-12 |
| 241 | 510 | 72921 | CGPG5781 | SENSE | *Saccharomyces cerevisiae* |
| 242 | 511 | 72968 | CGPG5772 | SENSE | *Saccharomyces cerevisiae* |
| 243 | 512 | 19703 | CGPG4172 | SENSE | *Glycine max* |
| 244 | 513 | 19946 | CGPG4097 | SENSE | *Glycine max* |
| 245 | 514 | 19980 | CGPG3914 | SENSE | *Glycine max* |
| 246 | 515 | 70435 | CGPG3701 | SENSE | *Arabidopsis thaliana* |
| 247 | 516 | 71114 | CGPG1657 | SENSE | *Arabidopsis thaliana* |
| 248 | 517 | 72451 | CGPG4733 | SENSE | *Arabidopsis thaliana* |
| 249 | 518 | 72947 | CGPG5607 | SENSE | *Glycine max* |
| 250 | 519 | 73012 | CGPG5786 | SENSE | *Saccharomyces cerevisiae* |
| 251 | 520 | 73022 | CGPG5622 | SENSE | *Arabidopsis thaliana* |
| 252 | 521 | 73488 | CGPG6394 | SENSE | *Bacillus subtilis* 168 |
| 253 | 522 | 73901 | CGPG5237 | SENSE | *Arabidopsis thaliana* |
| 254 | 523 | 73964 | CGPG5804 | SENSE | *Saccharomyces cerevisiae* |
| 255 | 524 | 74019 | CGPG5706 | SENSE | *Bacillus subtilis* 168 |
| 256 | 525 | 74022 | CGPG5724 | SENSE | *Arabidopsis thaliana* |
| 257 | 526 | 74114 | CGPG6551 | SENSE | *Agrobacterium tumefacians* C58 |
| 258 | 527 | 74262 | CGPG5353 | SENSE | *Arabidopsis thaliana* |
| 259 | 528 | 74292 | CGPG5367 | SENSE | *Arabidopsis thaliana* |
| 260 | 529 | 74302 | CGPG5384 | SENSE | *Arabidopsis thaliana* |
| 261 | 530 | 74325 | CGPG5898 | SENSE | *Arabidopsis thaliana* |
| 262 | 531 | 74429 | CGPG6689 | SENSE | *Bacillus subtilis* 168 |
| 263 | 532 | 74440 | CGPG6682 | SENSE | *Bacillus halodurans* C-125 |
| 264 | 533 | 74462 | CGPG6668 | SENSE | *Synechocystis* |
| 265 | 534 | 74465 | CGPG6692 | SENSE | *Bacillus subtilis* 168 |
| 266 | 535 | 74474 | CGPG6669 | SENSE | *Synechocystis* |
| 267 | 536 | 74505 | CGPG6783 | SENSE | *Escherichia coli* K-12 |
| 268 | 537 | 74507 | CGPG6799 | SENSE | *Xenorhabdus nematophilus* 85816 |
| 269 | 538 | 74562 | CGPG6764 | SENSE | *Bacillus subtilis* 168 |

"NUC SEQ ID NO" refers to a SEQ ID NO. for particular DNA sequence in the Sequence Listing .
"PEP SEQ ID NO" refers to a SEQ ID NO. in the Sequence Listing for the amino acid sequence of a protein cognate to a particular DNA
"construct_id" refers to an arbitrary number used to identify a particular recombinant DNA construct comprising the particular DNA.
"gene" refers to an arbitrary name used to identify the particular DNA.
"orientation" refers to the orientation of the particular DNA in a recombinant DNA construct relativeto the promoter.
"species" refers to the organism from which the particular DNA was derived.

Recombinant DNA

Trait-imparting DNA for use in this invention for improved traits in plants is disclosed herein as having a DNA sequence of SEQ ID NO:1 through SEQ ID NO:269 and any of the respective homologs. A subset of the trait-imparting DNA includes fragments with less than the full DNA sequence, e.g., consisting of oligonucleotides of at least about 15 to 20 or more consecutive nucleotides from one of the disclosed sequences. Such oligonucleotides are fragments of the larger molecules having a sequence selected from the group consisting of SEQ ID NO: 1 through SEQ ID NO: 269, and find use, for example as probes and primers for detection of the polynucleotides of the invention or for cloning DNA for use in this invention.

Useful DNA includes variants of the disclosed DNA. Such variants include naturally occurring, including homologous DNA from genes of the same or a different species, or non-natural variants, for example DNA synthesized using chemical synthesis methods, or generated using recombinant DNA techniques. Degeneracy of the genetic code provides the possibility to substitute at least one nucleotide of a disclosed DNA without causing the amino acid sequence of the protein produced to be changed. Hence, useful DNA can have any base sequence that has been changed from the sequences provided herein by substitution in accordance with degeneracy of the genetic code.

Homologs of the trait-imparting DNA generally demonstrate significant identity with the DNA provided herein. Homologous DNA is substantially identical to a trait-imparting DNA if, when the nucleotide sequences are optimally aligned there is at least about 60% nucleotide identity, or higher, e.g., at least 70% or 80% or 85% or even 90% identity or higher, such as 95% or 98% identity over a comparison window of at least 50 to 100 nucleotides, and up to the entire length of the trait-imparting DNA. Optimal alignment of sequences for aligning a comparison window can be conducted by algorithms including computerized implementations of the algorithms (for example, the Wisconsin Genetics Software Package Release 7.0-10.0, Genetics Computer Group, 575 Science Dr., Madison, Wis.). The reference DNA sequence can represent a full-length coding sequence or a portion.

Proteins useful for imparting improved traits are entire proteins or at least a sufficient portion of the entire protein to impart the relevant biological activity of the protein. Proteins useful for generation of transgenic plants having improved traits include the proteins with an amino acid sequence provided herein as SEQ ID NO: 270 through SEQ ID NO: 538, as well as homologs of such proteins.

One method to identify homologs of the proteins useful in this invention is by comparison of the amino acid sequence of the trait-imparting protein to amino acid sequences of proteins from the same or different organisms, e.g., manually or by using known homology-based search algorithms such as those commonly known and referred to as BLAST, FASTA, and Smith-Waterman. In one method a local sequence alignment program, e.g., BLAST, is used to search a database of sequences to find similar sequences, and the summary Expectation value (E-value) is used to measure the sequence base similarity. As a protein hit with the best E-value for a particular organism may not necessarily be an ortholog or the only ortholog, a reciprocal BLAST search is used to filter hit sequences with significant E-values for ortholog identification. The reciprocal BLAST entails search of the significant hits against a database of amino acid sequences from the base organism that are similar to the sequence of the query protein. A hit is a likely ortholog, when the reciprocal BLAST's best hit is the query protein itself or a protein encoded by a duplicated gene after speciation. Thus, homolog is used herein to described proteins that are assumed to have functional similarity by inference from sequence base similarity. The relationship of homologs with amino acid sequences of SEQ ID NO: 539 through SEQ ID NO: 22568 to the proteins with amino acid sequences of SEQ ID NO: 270 through SEQ ID NO: 538 is found is found in Table 17.

Aspects of the invention also use DNA encoding functional homolog proteins which differ in one or more amino acids from those of protein encoded by disclosed trait-imparting DNA as the result of one or more of the well-known conservative amino acid substitutions, e.g., valine is a conservative substitute for alanine and threonine is a conservative substitute for serine. Conservative substitutions for an amino acid within the native sequence are selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence are selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention uses DNA encoding proteins that differ in one or more amino acids from those of protein encoded from a described trait-imparting DNA as the result of deletion or insertion of one or more amino acids in a native sequence.

Homologs of the proteins encoded by disclosed trait-improving DNA will generally demonstrate significant sequence identity, e.g., at least 50% amino acid sequence identity or higher such as at least 70% identity or at least 80% or at least 90% identity with an amino acid sequence of SEQ ID NO:270 through SEQ ID NO:538. Identity of protein homologs is determined by optimally aligning the amino acid sequence of a putative protein homolog with a defined amino acid sequence of a protein encoded by a disclosed trait-imparting DNA and by calculating the percentage of identical and conservatively substituted amino acids over the window of comparison. The window of comparison for determining identity can be the entire amino acid sequence disclosed herein, e.g., the full sequence of any of SEQ ID NO:270 through SEQ ID NO:538.

Genes that are homologs to each other can be grouped into families and included in multiple sequence alignments to allow a consensus sequence to be derived. This analysis enables the derivation of conserved and class- (family) specific residues or motifs that are functionally important. These conserved residues and motifs can be further validated with 3D protein structure if available. A consensus sequence is used to define the full scope of the invention, e.g., to identify proteins with a homolog relationship and the corresponding trait-imparting DNA. Thus, this invention contemplates that protein homologs include proteins with an amino acid sequence that has at least 90% identity to such a consensus amino acid sequence.

Promoters

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens*, caulimovirus promoters such as the cauliflower mosaic virus or figwort mosaic virus promoters. For instance, see U.S. Pat. Nos. 5,858,742 and 5,322,938 which disclose versions of the constitutive promoter derived from cauliflower mosaic virus (CaMV35S), U.S. Pat. No. 5,378,619 which discloses a Figwort Mosaic Virus (FMV) 35S promoter, U.S. Pat. No. 6,437,217 which discloses a maize RS81 promoter, U.S. Pat. No. 5,641,876 which discloses a rice actin promoter, U.S. Pat. No. 6,426,446 which discloses a maize RS324 promoter, U.S. Pat. No.

6,429,362 which discloses a maize PR-1 promoter, U.S. Pat. No. 6,232,526 which discloses a maize A3 promoter, U.S. Pat. No. 6,177,611 which discloses constitutive maize promoters, U.S. Pat. No. 6,433,252 which discloses a maize L3 oleosin promoter, U.S. Pat. No. 6,429,357 which discloses a rice actin 2 promoter and intron, U.S. Pat. No. 5,837,848 which discloses a root specific promoter, U.S. Pat. No. 6,084, 089 which discloses cold inducible promoters, U.S. Pat. No. 6,294,714 which discloses light inducible promoters, U.S. Pat. No. 6,140,078 which discloses salt inducible promoters, U.S. Pat. No. 6,252,138 which discloses pathogen inducible promoters, U.S. Pat. No. 6,175,060 which discloses phosphorus deficiency inducible promoters, U.S. Patent Application Publication 2002/0192813A1 which discloses 5', 3' and intron elements useful in the design of effective plant expression vectors, U.S. patent application Ser. No. 09/078,972 which discloses a coixin promoter, U.S. patent application Ser. No. 09/757,089 which discloses a maize chloroplast aldolase promoter, and U.S. patent application Ser. No. 10/739,565 which discloses water-deficit inducible promoters, all of which are incorporated herein by reference. These and numerous other promoters that function in plant cells are known to those skilled in the art and available for use in recombinant DNA to provide for expression of desired genes in transgenic plant cells.

It is well known in the art that promoters are usefully altered to contain multiple "enhancer sequences" to assist in elevating gene expression. By including an enhancer sequence with such constructs, expression is generally enhanced. These enhancers often are found 5' to the start of transcription in a promoter that functions in eukaryotic cells, and can also be inserted in the forward or reverse orientation 5' or 3' to the coding sequence. In some instances, 5' enhancing elements are introns. Particularly useful enhancers are the 5' introns of the rice actin 1 gene and the rice actin 2 gene. Other enhancers include elements from the CaMV 35S promoter, octopine synthase genes, the maize alcohol dehydrogenase gene, the maize shrunken 1 gene and promoters from non-plant eukaryotes.

In some aspects of the invention it is preferred that the promoter element in the DNA construct be capable of causing sufficient expression in water deficit conditions. Such promoters can be identified and isolated from the regulatory region of plant genes that are over expressed in water deficit conditions. Specific water-deficit-inducible promoters for use in this invention are derived from the 5' regulatory region of genes identified as a heat shock protein 17.5 gene (HSP17.5), an HVA22 gene (HVA22), a Rab17 gene and a cinnamic acid 4-hydroxylase (CA4H) gene (CA 4H) of *Zea maize*. Such water-deficit-inducible promoters are disclosed in U.S. 2004-0123347 A1, incorporated herein by reference.

In other aspects of the invention, sufficient expression in plant seed tissues is desired to effect improvements in seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell, et al., (1997) *Transgenic Res.* 6(2):157-166), globulin 1 (Belanger, et al., (1991) Genetics 129:863-872), glutelin 1 (Russell (1997) supra), and peroxiredoxin antioxidant (Per1) (Stacy, et al., (1996) *Plant Mol. Biol.* 31(6):1205-1216).

In still other aspects of the invention, preferential expression in plant green tissues is desired. Promoters of interest for such uses include those from genes such as SSU (Fischhoff, et al., (1992) Plant Mol. Biol. 20:81-93), aldolase and pyruvate orthophosphate dikinase (PPDK) (Taniguchi, et al., (2000) *Plant Cell Physiol.* 41(1):42-48).

Gene Overexpression

"Gene overexpression" means expression, e.g., of a gene at a level in its native host that exceeds levels of expression in a non-trans genic host. In many embodiments of the invention, a recombinant DNA construct provides gene overexpression, e.g., as identified in Table 1.

Gene Suppression

Gene suppression includes any of the well-known methods for suppressing expression, typically indicated by reduced levels of protein. Posttranscriptional gene suppression is mediated by transcription of integrated recombinant DNA to form double-stranded RNA (dsRNA) having homology to a gene targeted for suppression. This formation of dsRNA most commonly results from transcription of an integrated inverted repeat of an element of a target gene, and is a common feature of gene suppression methods known as anti-sense suppression, co-suppression and RNA interference (RNAi). Transcriptional suppression can be mediated by a transcribed dsRNA having homology to a promoter DNA sequence to effect what is called promoter trans suppression.

More particularly, posttranscriptional gene suppression by inserting a recombinant DNA construct with one or more copies of anti-sense oriented DNA to regulate gene expression in plant cells is disclosed in U.S. Pat. No. 5,107,065 (Shewmaker, et al.,) and U.S. Pat. No. 5,759,829 (Shewmaker, et al.,). Transgenic plants transformed using such anti-sense oriented DNA constructs for gene suppression can comprise integrated DNA arranged as an inverted repeats that result from insertion of the DNA construct into plants by *Agrobacterium*-mediated transformation, as disclosed by Redenbaugh, et al., in "Safety Assessment of Genetically Engineered Flavr Savr™ Tomato, CRC Press, Inc. (1992). Inverted repeat insertions can comprises a part or all of the T-DNA construct, e.g., an inverted repeat of a complete transcription unit or an inverted repeat of transcription terminator sequence. Screening for inserted DNA comprising inverted repeat elements can improve the efficiency of identifying transformation events effective for gene silencing whether the transformation construct is a simple anti-sense DNA construct which must be inserted in multiple copies or a complex inverted repeat DNA construct (e.g., an RNAi construct) which can be inserted as a single copy.

Posttranscriptional gene suppression by inserting a recombinant DNA construct with sense-oriented DNA to regulate gene expression in plants is disclosed in U.S. Pat. No. 5,283, 184 (Jorgensen, et al.) and U.S. Pat. No. 5,231,020 (Jorgensen, et al.). Inserted T-DNA providing gene suppression in plants transformed with such sense constructs by *Agrobacterium* is organized predominately in inverted repeat structures, as disclosed by Jorgensen, et al., Mol. Gen. Genet., 207:471-477 (1987). See also Stam, et al., The Plant Journal, 12(1), 63-82 (1997) who used segregation studies to support Jorgensen's finding that gene silencing is mediated by multimeric transgene T-DNA loci in which the T-DNAs are arranged in inverted repeats. Screening for inserted DNA comprising inverted repeat elements can improve the gene silencing efficiency when transforming with simple sense-orientated DNA constructs. Gene silencing efficiency can also be improved by screening for single insertion events when transforming with an RNAi construct containing inverted repeat elements As disclosed by Redenbaugh, et al., gene suppression can be achieved by inserting into a plant genome recombinant DNA that transcribes dsRNA. Such a DNA insert can be transcribed to an RNA element having the 3' region as a double stranded RNA. RNAi constructs are also disclosed in EP 0426195 A1 (Goldbach, et al.,—1991) where recombinant DNA constructs for transcription into hairpin dsRNA for providing transgenic plants with resistance to tobacco spotted wilt virus. Double-stranded RNAs were also disclosed in WO 94/01550 (Agrawal, et al.,) where anti-sense RNA was stabilized with a self-complementary 3' segment. Agrawal, et al., referred to U.S. Pat. No. 5,107,065 for using such self-stabilized anti-sense RNAs for regulating gene expression in plant cells; see International Publication No. 94/01550. Other double-stranded hairpin-forming elements in transcribed RNA are disclosed in International Publication No. 98/05770 (Werner, et al.,) where the anti-sense RNA is stabilized by hairpin forming repeats of poly(CG) nucleotides. See also U.S. Patent Application Publication No. 2003/0175965 A1 (Lowe, et al.,) which discloses gene suppression using and RNAi construct comprising a gene coding sequence preceded by inverted repeats of 5'UTR. See also U.S. Patent Application Publication No. 2002/0048814 A1 (Oeller) where RNAi constructs are transcribed to sense or anti-sense RNA which is stabilized by a poly(T)-poly(A) tail. See also U.S. Patent Application Publication No. 2003/0018993 A1 (Gutterson, et al.,) where sense or anti-sense RNA is stabilized by an inverted repeat of the 3' untranslated region of the NOS gene. See also U.S. Patent Application Publication No. 2003/0036197 A1 (Glassman, et al.,) where RNA having homology to a target is stabilized by two complementary RNA regions.

Gene silencing can also be affected by transcribing RNA from both a sense and an anti-sense oriented DNA, e.g., as disclosed by Shewmaker, et al., in U.S. Pat. No. 5,107,065 where in Example 1 a binary vector was prepared with both sense and anti-sense aroA genes. See also U.S. Pat. No. 6,326,193 where gene targeted DNA is operably linked to opposing promoters.

Gene silencing can also be affected by transcribing from contiguous sense and anti-sense DNA. In this regard see Sijen, et al., The Plant Cell, Vol. 8, 2277-2294 (1996) discloses the use of constructs carrying inverted repeats of a cowpea mosaic virus gene in transgenic plants to mediate virus resistance. Such constructs for posttranscriptional gene suppression in plants by double-stranded RNA are also disclosed in International Publication No. WO 99/53050 (Waterhouse, et al.,), International Publication No. WO 99/49029 (Graham, et al.), U.S. 2004-0029283 A1 (Fillatti), U.S. Pat. No. 6,506,559 (Fire, et al.,). See also U.S. 2004-0006792 A1 (Shewmaker, et al.,) that discloses constructs and methods for simultaneously expressing one or more recombinant genes while simultaneously suppressing one or more native genes in a transgenic plant. See also U.S. Pat. No. 6,448,473 (Mitsky, et al.,) that discloses multi-gene suppression vectors for use in plants. All of the above-described patents, applications and international publications disclosing materials and methods for posttranscriptional gene suppression in plants are incorporated herein by reference. Transcriptional suppression such as promoter trans suppression can be affected by a expressing a DNA construct comprising a promoter operably linked to inverted repeats of promoter DNA for a target gene. Constructs useful for such gene suppression mediated by promoter trans suppression are disclosed by Mette, et al., The EMBO Journal, Vol. 18, No. 1, pp. 241-148, 1999 and by Mette, et al., The EMBO Journal, Vol. 19, No. 19, pp. 5194-5201-148, 2000, both of which are incorporated herein by reference.

Suppression can also be achieved by insertion mutations created by transposable elements may also prevent gene function. For example, in many dicot plants, transformations with the T-DNA of *Agrobacterium* are readily achieved and large numbers of transformants can be rapidly obtained. Also, some species have lines with active transposable elements that are efficiently be used for the generation of large numbers of insertion mutations, while some other species lack such options. Mutant plants produced by *Agrobacterium* or transposon mutagenesis and having altered expression of a polypeptide of interest are identified using the polynucleotides of this invention. For example, a large population of mutated plants are screened to detect mutated plants having an insertion in the gene encoding the polypeptide of interest.

Gene Stacking

This invention also contemplates that the trait-improving recombinant DNA is used in combination with other recombinant DNA to create plants with a multiple desired traits. The combinations generated include multiple copies of any one or more of the recombinant DNA constructs. These stacked combinations are created by any method, including but not limited to cross breeding of transgenic plants, or multiple genetic transformation.

Plant Transformation Methods

Numerous methods for transforming plant cells with recombinant DNA are known in the art and are useful in producing the transgenic seeds of this invention. Two commonly used methods for plant transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat) and *Agrobacterium*-mediated transformation is described in U.S. Pat. No. 5,159,135 (cotton); U.S. Pat. No. 5,824,877 (soybean); U.S. Pat. No. 5,591,616 (corn); and U.S. Pat. No. 6,384,301 (soybean), all of which are incorporated herein by reference. For *Agrobacterium tumefaciens* based plant transformation system, additional elements present on transformation constructs include T-DNA left and right border sequences to facilitate incorporation of the recombinant polynucleotide into the plant genome.

In general it is preferred to introduce heterologous DNA randomly, i.e., at a non-specific location, in the genome of a target plant line. In special cases it is useful to target heterologous DNA insertion in order to achieve site-specific integration, e.g., to replace an existing gene in the genome, to use an existing promoter in the plant genome, or to insert a recombinant polynucleotide at a predetermined site known to be active for gene expression. Several site specific recombination systems exist which are known to function implants include cre-lox as disclosed in U.S. Pat. No. 4,959,317 and FLP-FRT as disclosed in U.S. Pat. No. 5,527,695, both incorporated herein by reference.

Transformation methods of this invention are preferably practiced in tissue culture on media and in a controlled environment. "Media" means any of the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant is regenerated is useful as a recipient cell. Callus is initiated from tissue sources including, but not limited to, immature embryos, seedling apical meristems, microspores and the like. Cells capable of proliferating as callus are also recipient cells for genetic transformation. Practical transformation methods and materials for making transgenic plants of this invention, e.g., various media and recipient target cells, transformation of immature embryos and subsequent regeneration of fertile transgenic plants are disclosed in U.S. Pat. Nos. 6,194,636 and 6,232,526 and U.S. 2004-0216189 A1, which are incorporated herein by reference.

In practice DNA is introduced into only a small percentage of target cells in any one experiment. Marker genes are used to provide an efficient system for identification of those cells that are stably transformed by receiving and integrating a transgenic DNA construct into their genomes. Preferred marker genes provide selective markers that confer resistance to a selective agent, such as an antibiotic or herbicide. Potentially transformed cells are exposed to the selective agent. In the population of surviving cells are those cells where, generally, the resistance-conferring gene has been integrated and expressed at sufficient levels to permit cell survival. Cells are tested further to confirm stable integration of the exogenous DNA. Useful selective marker genes include those conferring resistance to antibiotics such as kanamycin (nptII), hygromycin B (aph IV) and gentamycin (aac3 and aacC4) or resistance to herbicides such as glufosinate (bar or pat) and glyphosate (EPSPS). Examples of such selectable are illustrated in U.S. Pat. Nos. 5,550,318; 5,633,435; 5,780,708 and 6,118,047, all of which are incorporated herein by reference. Screenable markers which provide an ability to visually identify transformants are also often employed, e.g., a gene expressing a colored or fluorescent protein such as a luciferase or green fluorescent protein (GFP) or a gene expressing a beta-glucuronidase or uidA gene (GUS) for which various chromogenic substrates are known. It is also contemplated that combinations of screenable and selectable markers will be useful for identification of transformed cells. See PCT publication WO 99/61129 which discloses use of a gene fusion between a selectable marker gene and a screenable marker gene, e.g., an NPTII gene and a GFP gene.

Cells that survive exposure to the selective agent, or cells that have been scored positive in a screening assay, are cultured in regeneration media and allowed to mature into plants. Developing plantlets are transferred to soil less plant growth mix, and hardened off, e.g., in an environmentally controlled chamber at about 85% relative humidity, 600 ppm $CO_2$, and 25-250 microeinsteins $m^{-2}s^{-1}$ of light, prior to transfer to a greenhouse or growth chamber for maturation. Plants are preferably matured either in a growth chamber or greenhouse. Plants are regenerated from about 6 wk to 10 months after a transformant is identified, depending on the initial tissue. During regeneration, cells are grown to plants on solid media at about 19 to 28 degrees C. After regenerating plants have reached the stage of shoot and root development, they are transferred to a greenhouse for further growth and testing. Plants are pollinated using conventional plant breeding methods known to those of skill in the art and seed produced.

Progeny are recovered from transformed plants and tested for expression of the exogenous recombinant polynucleotide. Useful assays include, for example, "molecular biological" assays, such as Southern and Northern blotting and PCR; "biochemical" assays, such as detecting the presence of RNA, e.g., double stranded RNA, or a protein product, e.g., by immunological means (ELISAs and Western blots) or by enzymatic function; plant part assays, such as leaf or root assays; and also, by analyzing the phenotype of the whole regenerated plant.

Discovery of Trait-Improving Recombinant DNA

To identify recombinant DNA that confer improved traits to plants, *Arabidopsis* plants were transformed with a large population of recombinant DNA constructs for expressing a large variety of distinct DNA. Transgenic plants were produced and screened to identify those plants having recombinant DNA constructs expressing trait-imparting DNA. A two-step screening process was employed which comprised two passes of trait characterization to ensure that the trait modification was dependent on expression of the recombinant DNA, but not due to the chromosomal location of the integration of the transgene. Twelve independent transgenic lines for each recombinant DNA construct were established and assayed for the transgene expression levels. Five transgenic lines with high transgene expression levels were used in the first pass screen to evaluate the transgene's function in T2 transgenic plants. Subsequently, three transgenic events, which had been shown to have one or more improved traits, were further evaluated in the second pass screen to confirm the transgene's ability to impart an improved trait. The following Table 2 summarizes the improved traits that have been confirmed as provided by a recombinant DNA construct.

In particular, Table 2 reports

"PEP Seq ID" which is the amino acid sequence of the protein cognate to the DNA in the recombinant DNA construct corresponding to a protein sequence of a SEQ ID NO. in the Sequence Listing.

"construct_id" is an arbitrary name for the recombinant DNA describe more particularly in Table 1.

"annotation" refers to a description of the top hit protein obtained from an amino acid sequence query of each PEP SEQ ID NO to GenBank database of the National Center for Biotechnology Information (ncbi). More particularly, "gi" is the GenBank ID number for the top BLAST hit.

"description" refers to the description of the top BLAST hit.

"e-value" provides the expectation value for the BLAST hit.

"identity" refers to the percentage of identically matched amino acid residues along the length of the portion of the sequences which is aligned by BLAST between the sequence of interest provided herein and the hit sequence in GenBank.

"traits" identified by two letters codes the confirmed improvement in a transgenic plant provided by the recombinant DNA. The codes for improved traits are:

"CK" which indicates cold tolerance improvement identified under a cold shock tolerance screen;

"CS" which indicates cold tolerance improvement identified by a cold germination tolerance screen;

"DS" which indicates drought tolerance improvement identified by a PEG induced osmotic stress tolerance screen;

"PEG" which idicates osmotic stress tolerance improvement identified by a PEG induced osmotic stress tolerance screen;

"HS" which indicates heat stress tolerance improvement identified by a heat stress tolerance screen;

"SS" which indicates high salinity stress tolerance improvement identified by a salt stress tolerance screen;

"LN" which indicates nitrogen use efficiency improvement identified by a limited nitrogen tolerance screen;

"LL" which indicates attenuated shade avoidance response identified by a shade tolerance screen under a low light condition;

"PP" which indicates improved growth and development at early stages identified by an early plant growth and development screen;

"SP" which indicates improved growth and development at late stages identified by a late plant growth and development screen provided herein.

TABLE 2

| Pep SEQ Id | construct id | gene | annotation e value | % identity | ncbi id | description | traits |
|---|---|---|---|---|---|---|---|
| 270 | 14324 | CGPG1560 | 1.00E−127 | 86 | gi\|15232185\| | ref\|NP_191546.1\|expressed protein [*Arabidopsis thaliana*]] | CK SS |
| 271 | 17484 | CGPG2630 | 0 | 93 | gi\|15220912\| | ref\|NP_173239.1\|zinc finger (C3HC4-type RING finger) family protein [*Arabidopsis thaliana*] | CK |
| 272 | 19109 | CGPG1381 | 9.00E−31 | 81 | gi\|18404521\| | ref\|NP_565870.1\|expressed protein [*Arabidopsis thaliana*] | CK |
| 273 | 70423 | CGPG3165 | 1.00E−134 | 96 | gi\|30688808\| | ref\|NP_850953.1\|MADS-box protein (AGL9) [*Arabidopsis thaliana*] gb\|AAM65812.1\| putative floral homeotic protein, AGL9 [*Arabidopsis thaliana*] | CK CS CK HS PP |
| 274 | 70424 | CGPG3180 | 1.00E−142 | 81 | gi\|25405039\| | pir\|\|H96827protein F20B17.12 [imported]-*Arabidopsis thaliana* gb\|AAF68121.1\| F20B17.12 [*Arabidopsis thaliana*] | CK |
| 275 | 70480 | CGPG3833 | 1.00E−122 | 99 | gi\|18411867\| | ref\|NP_565174.1\|14-3-3 protein GF14 pi (GRF13) [*Arabidopsis thaliana*] | CK |
| 276 | 70509 | CGPG2420 | 1.00E−113 | 82 | gi\|15225186\| | ref\|NP_180770.1\|ovate protein-related [*Arabidopsis thaliana*] | CK |
| 277 | 70647 | CGPG4334 | 1.00E−171 | 94 | gi\|15237269\| | ref\|NP_200093.1\|ornithine cyclodeaminase/mu-crystallin family protein [*Arabidopsis thaliana*] dbj\|BAB10429.1] | CK |
| 278 | 70675 | CGPG4519 | 0 | 100 | gi\|15224730\| | ref\|NP_180115.1\|2-oxoglutarate-dependent dioxygenase, putative [*Arabidopsis thaliana*] pir\|\|E84648 probable dioxygenase] | CK |
| 279 | 70829 | CGPG518 | 0 | 92 | gi\|15232841\| | ref\|NP_186854.1\|potassium transporter (KUP3) [*Arabidopsis thaliana*] | CK |
| 280 | 70849 | CGPG596 | 1.00E−166 | 96 | gi\|15224801\| | ref\|NP_179547.1\|cytidine deaminase (CDD)/cytidine aminohydrolase [*Arabidopsis thaliana*] | CK |
| 281 | 71627 | CGPG1270 | 0 | 99 | gi\|18398032\| | ref\|NP_566315.1\|ABC1 family protein [*Arabidopsis thaliana*] | CK |
| 282 | 71934 | CGPG2294 | 1.00E−154 | 79 | gi\|15233973\| | ref\|NP_195575.1\|26S proteasome regulatory subunit S5A (RPN10) [*Arabidopsis thaliana*] sp\|P55034\|PSD4_ARATH 26S proteasome non-ATPase regulatory subunit 4 (26S proteasome regulatory | CK |
| 283 | 72615 | CGPG4829 | 2.00E−49 | 88 | gi\|18422886\| | ref\|NP_568693.1\|expressed protein [*Arabidopsis thaliana*] | CK |
| 284 | 72927 | CGPG1477 | 1.00E−114 | 81 | gi\|15234815\| | ref\|NP_194797.1\|MA3 domain-containing protein [*Arabidopsis thaliana*] pir\|\|A85359 translation initiation factor-like protein | CK |
| 285 | 73014 | CGPG5692 | 1.00E−180 | 93 | gi\|37528369\| | ref\|NP_931714.1\|Fructose-1,6-bisphosphatase (D-fructose-1,6-bisphosphate 1-phosphohydrolase) (FBPase) [*Photorhabdus luminescens* subsp. *laumondii* TTO1] | CK PP |

TABLE 2-continued

| Pep SEQ Id | construct id | gene | annotation e value | % identity | ncbi id | description | traits | | |
|---|---|---|---|---|---|---|---|---|---|
| 286 | 73559 | CGPG6535 | 0 | 93 | gi\|16078422\| | ref\|NP_389241.1\|similar to aspartate aminotransferase [*Bacillus subtilis*] sp\|O31665\|MTNE_BACSU Transaminase mtnE pir\|\|F69863 probable transaminase (EC 2.6.1.—) ykrV | CK | | |
| 287 | 74251 | CGPG5489 | 1.00E−171 | 87 | gi\|15238437\| | ref\|NP_200760.1\|zinc transporter (ZIP2) [*Arabidopsis thaliana*] sp\|Q9LTH9\|ZIP2_ARATH Zinc transporter 2 precursor (ZRT/IRT-like protein 2) | CK | SP | |
| 288 | 19631 | CGPG3627 | 1.00E−94 | 90 | gi\|18410249\| | ref\|NP_565053.1\|SNF7 family protein [*Arabidopsis thaliana*] pir\|\|G96755 developmental protein homolog DG1118 [imported]-*Arabidopsis thaliana* | CS | | |
| 289 | 70121 | CGPG2380 | 1.00E−111 | 100 | gi\|6323765\| | ref\|NP_013836.1\|Hypothetical ORF; Ymr118cp [*Saccharomyces cerevisiae*] sp\|Q04487\|YM07_YEAST Putative succinate dehydrogenase cytochrome B subunit, mitochondrial precursor | CS | | |
| 290 | 70654 | CGPG4352 | 2.00E−63 | 88 | gi\|18400941\| | ref\|NP_566531.1\|expressed protein [*Arabidopsis thaliana*] | CS | | |
| 291 | 70696 | CGPG4590 | 8.00E−92 | 87 | gi\|25408379\| | pir\|\|E84768hypothetical protein At2g35430 | CS | PP | |
| 292 | 70713 | CGPG1462 | 0 | 95 | gi\|30678679\| | ref\|NP_191966.2\|malate oxidoreductase, putative | CS | | |
| 293 | 70740 | CGPG3700 | 0 | 94 | gi\|18402759\| | ref\|NP_566667.1\|transcription factor jumonji (jmjC) domain-containing protein | CS | LL | PP |
| 294 | 71321 | CGPG4418 | 0 | 91 | gi\|13878402\| | sp\|Q9STL0\|C71N_ARATH Cytochrome P450 71A23 pir\|\|T06712 probable cytochrome P450 T29H11.180 | CS | | |
| 295 | 71835 | CGPG4634 | 0 | 100 | gi\|15234361\| | ref\|NP_192100.1\|DC1 domain-containing protein [*Arabidopsis thaliana*] pir\|\|E85024 probable CHP-rich zinc finger protein | CS | SP | |
| 296 | 72934 | CGPG5798 | 0 | 98 | gi\|6323512\| | ref\|NP_013583.1\|High-affinity inorganic phosphate (Pi) transporter and low-affinity manganese transporter; regulated by Pho4p and Spt7p; mutation confers resistance to arsenate; exit from the ER during maturation requires Pho86p; Pho84p [*Saccharomyces cerevisiae*] | CS | | |
| 297 | 72945 | CGPG5787 | 0 | 94 | gi\|6319991\| | ref\|NP_010071.1\|GABA-specific transport protein; Uga4p [*Saccharomyces cerevisiae*] sp\|P32837\|UGA4_YEAST GABA-specific permease (GABA-specific transport protein) | CS | | |
| 298 | 72980 | CGPG5773 | 0 | 89 | gi\|6321960\| | ref\|NP_012036.1\|Subunit of the anaphase-promoting complex/cyclosome (APC/C), which is a ubiquitin-protein ligase | CS | | |

TABLE 2-continued

<table>
<tr><th>Pep</th><th></th><th></th><th colspan="4">annotation</th><th colspan="4"></th></tr>
<tr><th>SEQ Id</th><th>construct id</th><th>gene</th><th>e value</th><th>% identity</th><th>ncbi id</th><th>description</th><th colspan="4">traits</th></tr>
<tr><td></td><td></td><td></td><td></td><td></td><td></td><td>required for degradation of anaphase inhibitors, including mitotic cyclins, during the metaphase/anaphase transition; Cdc23p</td><td></td><td></td><td></td><td></td></tr>
<tr><td>299</td><td>73504</td><td>CGPG6480</td><td>1.00E−178</td><td>100</td><td>gi|16330153|</td><td>ref|NP_440881.1|fructokinase [Synechocystis sp. PCC 6803] pir||S77227 fructokinase (EC 2.7.1.4)-Synechocystis sp. (strain PCC 6803)</td><td>CS</td><td>PP</td><td></td><td></td></tr>
<tr><td>300</td><td>73507</td><td>CGPG6504</td><td>1.00E−173</td><td>100</td><td>gi|16078547|</td><td>ref|NP_389366.1|similar to glutaminase [Bacillus subtilis]</td><td>CS</td><td>LL</td><td>PP</td><td>PEG</td></tr>
<tr><td>301</td><td>73573</td><td>CGPG6462</td><td>0</td><td>100</td><td>gi|15890038|</td><td>ref|NP_355719.1|AGR_C_5067p [Agrobacterium tumefaciens str. C58] ref|NP_533456.1|3-isopropylmalate dehydrogenase</td><td>CS</td><td>PP</td><td></td><td></td></tr>
<tr><td>302</td><td>73586</td><td>CGPG6471</td><td>1.00E−177</td><td>100</td><td>gi|160776841</td><td>ref|NP_388498.1|similar to fructokinase [Bacillus subtilis]</td><td>CS</td><td>DS</td><td>PP</td><td></td></tr>
<tr><td>303</td><td>73770</td><td>CGPG5435</td><td>2.00E−34</td><td>68</td><td>gi|15235771|</td><td>ref|NP_193383.1|cysteine protease inhibitor family protein/cystatin family protein [Arabidopsis thaliana]</td><td>CS</td><td>PP</td><td></td><td></td></tr>
<tr><td>304</td><td>74105</td><td>CGPG6574</td><td>0</td><td>73</td><td>gi|23059330|</td><td>ref|ZP_00084307.1|COG1012: NAD-dependent aldehyde dehydrogenases [Pseudomonas fluorescens PfO-1]</td><td>CS</td><td></td><td></td><td></td></tr>
<tr><td>305</td><td>74111</td><td>CGPG6622</td><td>0</td><td>99</td><td>gi|16131442|</td><td>ref|NP_418028.1|alpha-amylase [Escherichia coli K12]</td><td>CS</td><td></td><td></td><td></td></tr>
<tr><td>306</td><td>74136</td><td>CGPG6632</td><td>9.00E−81</td><td>99</td><td>gi|16330993|</td><td>ref|NP_441721.1|unknown protein [Synechocystis sp. PCC 6803]</td><td>CS</td><td>CK</td><td>HS</td><td></td></tr>
<tr><td>307</td><td>74139</td><td>CGPG6561</td><td>1.00E−180</td><td>95</td><td>gi|24112825|</td><td>ref|NP_707335.1|glyceraldehyde-3-phosphate dehydrogenase A [Shigella flexneri 2a str. 301]</td><td>CS</td><td>LL</td><td></td><td></td></tr>
<tr><td>308</td><td>74267</td><td>CGPG5364</td><td>0</td><td>97</td><td>gi|18399375|</td><td>ref|NP_566402.1|U-box domain-containing protein [Arabidopsis thaliana]</td><td>CS</td><td></td><td></td><td></td></tr>
<tr><td>309</td><td>74291</td><td>CGPG5363</td><td>0</td><td>94</td><td>gi|18401867|</td><td>ref|NP_565676.1|armadillo/ beta-catenin repeat family protein/U-box domain-containing protein [Arabidopsis thaliana]</td><td>CS</td><td></td><td></td><td></td></tr>
<tr><td>310</td><td>74318</td><td>CGPG5826</td><td>0</td><td>100</td><td>gi|15219730|</td><td>ref|NP_176847.1|cell division protein kinase, putative [Arabidopsis thaliana]</td><td>CS</td><td>HS</td><td></td><td></td></tr>
<tr><td>311</td><td>74319</td><td>CGPG5831</td><td>0</td><td>96</td><td>gi|15224359|</td><td>ref|NP_181907.1|mitogen-activated protein kinase, putative/MAPK, putative (MPK6) [Arabidopsis thaliana]</td><td>CS</td><td></td><td></td><td></td></tr>
<tr><td>312</td><td>74324</td><td>CGPG5885</td><td>1.00E−174</td><td>95</td><td>gi|42569304|</td><td>ref|NP_180094.2|protein kinase family protein [Arabidopsis thaliana]</td><td>CS</td><td></td><td></td><td></td></tr>
<tr><td>313</td><td>74512</td><td>CGPG32</td><td>0</td><td>96</td><td>gi|15217945|</td><td>ref|NP_176132.1|amino acid permease I (AAP1) [Arabidopsis thaliana]</td><td>CS</td><td>HS</td><td>SP</td><td></td></tr>
<tr><td>314</td><td>74583</td><td>CGPG6649</td><td>1.00E−151</td><td>83</td><td>gi|22978283|</td><td>ref|ZP_00024043.1|COG0252: L-asparaginase/archaeal Glu-tRNAGln amidotransferase subunit D [Ralstonia metallidurans]</td><td>CS</td><td>PP</td><td></td><td></td></tr>
</table>

TABLE 2-continued

| Pep SEQ Id | construct id | gene | annotation e value | % identity | ncbi id | description | traits | | | |
|---|---|---|---|---|---|---|---|---|---|---|
| 315 | 70427 | CGPG3067 | 0 | 100 | gi\|42572771\| | ref\|NP_974481.1\|kelch repeat-containing F-box family protein [*Arabidopsis thaliana*] | CS | DS | | |
| 316 | 71811 | CGPG4426 | 0 | 97 | gi\|15223341\| | ref\|NP_171627.1\|cytochrome P450, putative [*Arabidopsis thaliana*] | CS | DS | LL | LN |
| 317 | 73463 | CGPG6384 | 0 | 100 | gi\|22977164\| | ref\|ZP_00022985.1\|COG0538: Isocitrate dehydrogenases [*Ralstonia metallidurans*] | DS | | | |
| 318 | 72081 | CGPG5279 | 7.00E−66 | 77 | gi\|42570373\| | ref\|NP_850277.2\|CCAAT-box binding transcription factor, putative [*Arabidopsis thaliana*] | DS | PEG | | |
| 319 | 10139 | CGPG101 | 0 | 89 | gi\|15229877\| | ref\|NP_187154.1\|sodium proton exchanger, putative (NHX2) [*Arabidopsis thaliana*] | DS | | | |
| 320 | 11410 | CGPG103 | 0 | 82 | gi\|15236418\| | ref\|NP_192555.1\|homeobox protein knotted-1 like 1 (KNAT1) [*Arabidopsis thaliana*] | DS | | | |
| 321 | 11604 | CGPG48 | 0 | 92 | gi\|15233457\| | ref\|NP_194642.1\|hexokinase 1 (HXK1) [*Arabidopsis thaliana*] | DS | | | |
| 322 | 12368 | CGPG1006 | 1.00E−146 | 85 | gi\|15231451\| | ref\|NP_190238.1\|epsin N-terminal homology (ENTH) domain-containing protein/ clathrin assembly protein-related [*Arabidopsis thaliana*] | DS | | | |
| 323 | 13502 | CGPG1354 | 0 | 95 | gi\|15224557\| | ref\|NP_180632.1\|serine/threonine protein kinase, putative [*Arabidopsis thaliana*] | DS | PP | | |
| 324 | 13745 | CGPG1576 | 1.00E−112 | 84 | gi\|15222987\| | ref\|NP_177749.1\|hypothetical protein [*Arabidopsis thaliana*] gb\|AAF17642.1\| T23E18.15 [*Arabidopsis thaliana*] | DS | | | |
| 325 | 13821 | CGPG1569 | 1.00E−155 | 85 | gi\|18416499\| | ref\|NP_567716.1\|expressed protein [*Arabidopsis thaliana*] | DS | | | |
| 326 | 14240 | CGPG1697 | 0 | 94 | gi\|15241302\| | ref\|NP_197527.1\|expressed protein [*Arabidopsis thaliana*] | DS | | | |
| 327 | 14718 | CGPG1082 | 0 | 86 | gi\|18407200\| | ref\|NP_566090.1\|expressed protein [*Arabidopsis thaliana*] | DS | | | |
| 328 | 17022 | CGPG1774 | 1.00E−159 | 100 | gi\|15237803\| | ref\|NP_197755.1\|nodulin MtN3 family protein [*Arabidopsis thaliana*] | DS | | | |
| 329 | 17924 | CGPG2882 | 3.00E−92 | 100 | gi\|15233350\| | ref\|NP_192875.1\|zinc finger (C3HC4-type RING finger) family protein (RHA1b) [*Arabidopsis thaliana*] | DS | | | |
| 330 | 18259 | CGPG3368 | 2.00E−94 | 88 | gi\|30685085\| | ref\|NP_849549.1\|zinc finger protein (LSD1) [*Arabidopsis thaliana*] | DS | PP | | |
| 331 | 19171 | CGPG2952 | 0 | 91 | gi\|6320063\| | ref\|NP_010143.1\|plasma membrane glucose sensor; Rgt2p [*Saccharomyces cerevisiae*] | DS | | | |
| 332 | 19201 | CGPG2332 | 0 | 96 | gi\|15233948\| | ref\|NP_194205.1\|protein kinase (AFC2) [*Arabidopsis thaliana*] sp\|P51567\|AFC2_ARATH Protein kinase | DS | | | |
| 333 | 19317 | CGPG3662 | 1.00E−151 | 91 | gi\|21232858\| | ref\|NP_638775.1\|conserved hypothetical protein [*Xanthomonas campestris* pv. *campestris* str. ATCC 33913] | DS | | | |

TABLE 2-continued

| Pep SEQ Id | construct id | gene | annotation e value | % identity | ncbi id | description | traits | | |
|---|---|---|---|---|---|---|---|---|---|
| 334 | 70417 | CGPG3427 | 0 | 81 | gi\|18396278\| | ref\|NP_566180.1\|integral membrane family protein [*Arabidopsis thaliana*] | DS | PP | SP |
| 335 | 70467 | CGPG3785 | 0 | 100 | gi\|15241416\| | ref\|NP_196953.1\|no apical meristem (NAM) family protein [*Arabidopsis thaliana*] | DS | | |
| 336 | 70806 | CGPG712 | 0 | 100 | gi\|15218225\| | ref\|NP_173010.1\|cyclin, putative [*Arabidopsis thaliana*] | DS | | |
| 337 | 70818 | CGPG479 | 1.00E−157 | 92 | gi\|30691978\| | ref\|NP_568508.2\|bZIP transcription factor family protein [*Arabidopsis thaliana*] | DS | | |
| 338 | 70820 | CGPG655 | 0 | 93 | gi\|15224342\| | ref\|NP_181899.1\|acyl-[acyl-carrier-protein] desaturase/ stearoyl-ACP desaturase (SSI2) [*Arabidopsis thaliana*] | DS | | |
| 339 | 70919 | CGPG4029 | 1.00E−169 | 73 | gi\|6996560\| | emb\|CAB75429.1\|oligouridylate binding protein [*Nicotiana plumbaginifolia*] | DS | | |
| 340 | 71623 | CGPG4696 | 1.00E−150 | 95 | gi\|15236511\| | ref\|NP_192588.1\|mitogen-activated protein kinase, putative [*Arabidopsis thaliana*] pir\|\|T01835 serine/threonine-specific protein kinase ARA.KIN homolog T15F16.3-*Arabidopsis thaliana* | DS | | |
| 341 | 71662 | CGPG4679 | 1.00E−173 | 91 | gi\|5929964\| | gb\|AAD56659.1\|malate dehydrogenase [*Glycine max*] | DS | | |
| 342 | 71693 | CGPG4652 | 6.00E−86 | 56 | gi\|21553460\| | gb\|AAM62553.1\|snap25a [*Arabidopsis thaliana*] | DS | | |
| 343 | 72384 | CGPG4639 | 0 | 98 | gi\|1169548\| | sp\|P38604\| ERG7_YEASTLanosterol synthase (Oxidosqualene--lanosterol cyclase) (2,3-epoxysqualene--lanosterol cyclase) (OSC) gb\|AAA64377.1\|2,3-oxidosqualene-lanosterol cyclase | DS | | |
| 344 | 72439 | CGPG5075 | 8.00E−57 | 90 | gi\|22331337\| | ref\|NP_683594.1\|NPR1/NIM1-interacting protein 2 (NIMIN-2) | DS | | |
| 345 | 72619 | CGPG4835 | 6.00E−83 | 88 | gi\|15237317\| | ref\|NP_200108.1\|expressed protein [*Arabidopsis thaliana*] | DS | | |
| 346 | 72624 | CGPG4842 | 0 | 100 | gi\|15242148\| | ref\|NP_200558.1\|expressed protein [*Arabidopsis thaliana*] | DS | | |
| 347 | 72715 | CGPG5521 | 0 | 91 | gi\|6323933\| | ref\|NP_014004.1\|Carboxy-terminal domain (CTD) phosphatase, essential for dephosphorylation of the repeated C-terminal domain of the RNA polymerase II large subunit (Rpo21p); Fcp1p [*Saccharomyces cerevisiae*] | DS | SS | |
| 348 | 72754 | CGPG5548 | 1.00E−169 | 100 | gi\|728961\| | sp\|Q00618\| BET4_YEASTGeranylgeranyl transferase type II alpha subunit (Type II protein geranyl- | DS | | |
| 349 | 72819 | CGPG4989 | 0 | 100 | gi\|18417026\| | ref\|NP_567780.1\|pfkB-type carbohydrate kinase family protein [*Arabidopsis thaliana*] | DS | | |

TABLE 2-continued

| Pep SEQ Id | construct id | gene | annotation e value | % identity | ncbi id | description | traits | | | |
|---|---|---|---|---|---|---|---|---|---|---|
| 350 | 75516 | CGPG7689 | 1.00E−138 | 70 | gi\|42568081\| | ref\|NP_197938.2\|zinc finger (C3HC4-type RING finger) family protein [*Arabidopsis thaliana*] | DS | | | |
| 351 | 75701 | CGPG7856 | 8.00E−41 | 37 | gi\|15225413\| | ref\|NP_182037.1\|zinc finger (C2H2 type) family protein [*Arabidopsis thaliana*] | DS | LN | | |
| 352 | 73515 | CGPG6473 | 1.00E−162 | 100 | gi\|16079626\| | ref\|NP_390450.1\|similar to 6-phosphogluconate dehydrogenase (pentose phosphate) [*Bacillus subtilis*] | HS | CS | PEG | |
| 353 | 74684 | CGPG6360 | 1.00E−64 | 100 | gi\|18390735\| | ref\|NP_563782.1\|expressed protein [*Arabidopsis thaliana*] | CS | HS | | |
| 354 | 19542 | CGPG3069 | 0 | 90 | gi\|18403574\| | ref\|NP_564592.1\|F-box family protein [*Arabidopsis thaliana*] | HS | | | |
| 355 | 19618 | CGPG3574 | 1.00E−121 | 100 | gi\|15218423\| | ref\|NP_177373.1\|trypsin and protease inhibitor family protein/Kunitz family protein [*Arabidopsis thaliana*] pir\|\|F96746 probable drought induced protein | HS | | | |
| 356 | 19649 | CGPG3140 | 1.00E−141 | 87 | gi\|18412787\| | ref\|NP_567287.1\|vesicle-associated membrane family protein/VAMP family protein | HS | | | |
| 357 | 19745 | CGPG3973 | 2.00E−60 | 46 | gi\|15239303\| | ref\|NP_201424.1\|expressed protein [*Arabidopsis thaliana*] | HS | | | |
| 358 | 19768 | CGPG4096 | 1.00E−179 | 81 | gi\|25052804\| | gb\|AAN65180.1\|mitogen-activated protein kinase 4 [*Petroselinum crispum*] | HS | SS | | |
| 359 | 19772 | CGPG3939 | 3.00E−82 | 79 | gi\|7488744\| | pir\|\|T09700MADS-box protein —alfalfa (fragment) gb\|AAB51377.1\| MADS-box protein [*Medicago sativa*] | HS | | | |
| 360 | 19779 | CGPG4113 | 1.00E−153 | 89 | gi\|30681126\| | ref\|NP_196201.2\|phosphate translocator-related [*Arabidopsis thaliana*] | CS | HS | | |
| 361 | 19833 | CGPG4074 | 1.00E−107 | 79 | gi\|6683777\| | gb\|AAF23363.1\|CAGL2 [*Cucumis sativus*] | CS | HS | PP | |
| 362 | 19862 | CGPG3961 | 2.00E−89 | 56 | gi\|15229637\| | ref\|NP_188469.1\|no apical meristem (NAM) family protein [*Arabidopsis thaliana*] dbj\|BAB01106.1\| unnamed protein product [*Arabidopsis thaliana*] | HS | | | |
| 363 | 19879 | CGPG4009 | 0 | 75 | gi\|18401703\| | ref\|NP_564504.1\|protein phosphatase 2C-related/PP2C-related [*Arabidopsis thaliana*] | HS | CS | | SS |
| 364 | 70445 | CGPG3728 | 2.00E−51 | 88 | gi\|30696602\| | ref\|NP_200357.2\|protease inhibitor/seed storage/lipid transfer protein (LTP) family protein [*Arabidopsis thaliana*] | HS | | | |
| 365 | 70738 | CGPG3195 | 1.00E−96 | 100 | gi\|15234797\| | ref\|NP_194791.1\|expressed protein [*Arabidopsis thaliana*] | HS | PP | | |
| 366 | 71437 | CGPG4043 | 1.00E−164 | 81 | gi\|15241535\| | ref\|NP_196433.1\|serine/threonine protein kinase, putative [*Arabidopsis thaliana*] | HS | | | |
| 367 | 71572 | CGPG4520 | 3.00E−83 | 92 | gi\|18403850\| | ref\|NP_565804.1\|expressed protein [*Arabidopsis thaliana*] | HS | | | |
| 368 | 71617 | CGPG1227 | 0 | 100 | gi\|15236219\| | ref\|NP_195218.1\|1-phosphatidylinositol phosphodiesterase-related [*Arabidopsis thaliana*] | HS | CK | | |

TABLE 2-continued

| Pep | | | annotation | | | | | | |
|---|---|---|---|---|---|---|---|---|---|
| SEQ Id | construct id | gene | e value | % identity | ncbi id | description | traits | | |
| 369 | 72532 | CGPG4780 | 1.00E−118 | 90 | gi\|15236659\| | ref\|NP_194120.1\|expressed protein [*Arabidopsis thaliana*] | HS | | |
| 370 | 72757 | CGPG5572 | 0 | 89 | gi\|15242402\| | ref\|NP_197088.1\|zinc finger protein CONSTANS (CO) [*Arabidopsis thaliana*] | HS | LL | PEG |
| 371 | 73412 | CGPG6448 | 0 | 99 | gi\|28867589\| | ref\|NP_790208.1\|glutamine synthetase, type I [*Pseudomonas syringae* pv. tomato str. DC3000] | HS | | |
| 372 | 74102 | CGPG6550 | 1.00E−167 | 94 | gi\|15614187\| | ref\|NP_242490.1\|L-asparaginase [*Bacillus halodurans* C-125] | HS | | |
| 373 | 72633 | CGPG4853 | 1.00E−145 | 86 | gi\|15238013\| | ref\|NP_199519.1\|casein kinase II beta chain, putative [*Arabidopsis thaliana*] | CS | LL | PEG |
| 374 | 72456 | CGPG4745 | 1.00E−75 | 92 | gi\|15239846\| | ref\|NP_196763.1\|17.6 kDa class II heat shock protein (HSP17.6-CII) [*Arabidopsis thaliana*] | DS | LL | |
| 375 | 72963 | CGPG1746 | 1.00E−151 | 87 | gi\|15222239\| | ref\|NP_172174.1\|ovate family protein [*Arabidopsis thaliana*] | LL | LN | |
| 376 | 70426 | CGPG3199 | 8.00E−54 | 88 | gi\|18397268\| | ref\|NP_564336.1\|double-stranded DNA-binding family protein [*Arabidopsis thaliana*] | LL | | |
| 377 | 70772 | CGPG4627 | 1.00E−92 | 80 | gi\|15220084\| | ref\|NP_173175.1\|MADS-box protein (AGL100) [*Arabidopsis thaliana*] P | LL | | |
| 378 | 71137 | CGPG125 | 1.00E−111 | 90 | gi\|15218957\| | ref\|NP_176202.1\|two-component responsive regulator/response regulator 3 (ARR3) [*Arabidopsis thaliana*] | LL | | |
| 379 | 71529 | CGPG2808 | 1.00E−131 | 72 | gi\|42562375\| | ref\|NP_174152.3\|Dof-type zinc finger domain-containing protein [*Arabidopsis thaliana*] | LL | | |
| 380 | 71601 | CGPG1858 | 1.00E−168 | 92 | gi\|15231425\| | ref\|NP_187378.1\|transcriptional activator, putative [*Arabidopsis thaliana*] | LL | | |
| 381 | 72362 | CGPG983 | 1.00E−163 | 95 | gi\|15242779\| | ref\|NP_200562.1\|xyloglucan: xyloglucosyl transferase, putative/xyloglucan endotransglycosylase, putative/endo-xyloglucan transferase, putative [*Arabidopsis thaliana*] | LL | | |
| 382 | 72466 | CGPG4767 | 3.00E−60 | 83 | gi\|15234046\| | ref\|NP_195030.1\|glutaredoxin family protein [*Arabidopsis thaliana*] | CK | LL | PEG |
| 383 | 72524 | CGPG4770 | 1.00E−134 | 91 | gi\|18412649\| | ref\|NP_567140.1\|expressed protein [*Arabidopsis thaliana*] | CK | LL | |
| 384 | 73085 | CGPG5689 | 1.00E−134 | 100 | gi\|16331347\| | ref\|NP_442075.1\|triosephosphate isomerase [*Synechocystis* sp. PCC 6803] | LL | | |
| 385 | 74241 | CGPG5457 | 0 | 89 | gi\|444790\| | prf\|\|1908224Anucleotide translocator | LL | | |
| 386 | 74247 | CGPG5475 | 1.00E−159 | 100 | gi\|18411863\| | ref\|NP_565172.1\|protein phosphatase 2C, putative/PP2C, putative [*Arabidopsis thaliana*] | LL | | |
| 387 | 74284 | CGPG5413 | 0 | 97 | gi\|15230577\| | ref\|NP_190087.1\|serine carboxypeptidase III, putative [*Arabidopsis thaliana*] | LL | | |
| 388 | 74652 | CGPG6168 | 1.00E−90 | 80 | gi\|15235970\| | ref\|NP_194879.1\|expressed protein [*Arabidopsis thaliana*] | LL | DS | |

TABLE 2-continued

| Pep | | | annotation | | | | | | | |
|---|---|---|---|---|---|---|---|---|---|---|
| SEQ Id | construct id | gene | e value | % identity | ncbi id | description | traits | | | |
| 389 | 70437 | CGPG3706 | 1.00E−172 | 100 | gi\|30678824\| | ref\|NP_186983.2\|short-chain dehydrogenase/reductase (SDR) family protein [*Arabidopsis thaliana*] | CK | LN | | |
| 390 | 71633 | CGPG857 | 1.00E−100 | 86 | gi\|6690274\| | gb\|AAF24061.1\|v-SNARE AtVTI1a [*Arabidopsis thaliana*] | DS | LN | | |
| 391 | 72948 | CGPG5617 | 0 | 94 | gi\|15225456\| | ref\|NP_182059.1\|leucine-rich repeat transmembrane protein kinase, putative [*Arabidopsis thaliana*] | LN | PEG | | |
| 392 | 72519 | CGPG4749 | | | | | LN | SS | | |
| 393 | 10475 | CGPG399 | 1.00E−164 | 96 | gi\|15240972\| | ref\|NP_195761.1\|stress-responsive protein, putative [*Arabidopsis thaliana*] | LN | | | |
| 394 | 11120 | CGPG459 | 0 | 100 | gi\|15227169\| | ref\|NP_179812.1\|inositol-3-phosphate synthase isozyme 2/myo-inositol-1-phosphate synthase 2/MI-1-P synthase 2/IPS 2 [*Arabidopsis thaliana*] | LN | | | |
| 395 | 19736 | CGPG4129 | 2.00E−94 | 67 | gi\|13346194\| | gb\|AAK19619.1\|GHMYB9 [*Gossypium hirsutum*] | LN | | | |
| 396 | 71606 | CGPG4715 | 0 | 91 | gi\|15218674\| | ref\|NP_171800.1\|phototropic-responsive NPH3 family protein [*Arabidopsis thaliana*] | LN | | | |
| 397 | 71840 | CGPG4353 | 0 | 96 | gi\|18401087\| | ref\|NP_566542.1\|mitotic phosphoprotein N' end (MPPN) family protein [*Arabidopsis thaliana*] | DS | LL | LN | |
| 398 | 74240 | CGPG5454 | 1.00E−155 | 90 | gi\|15233884\| | ref\|NP_194188.1\|mitochondrial substrate carrier family protein [*Arabidopsis thaliana*] pir\|\|T05577 uncoupling protein homolog F22K18.230-*Arabidopsis thaliana* | CK | LN | | |
| 399 | 74331 | CGPG5834 | 0 | 94 | gi\|15220416\| | ref\|NP_172003.1\|protein kinase family protein [*Arabidopsis thaliana*] | LN | | | |
| 400 | 74610 | CGPG6048 | 1.00E−117 | 100 | gi\|15217568\| | ref\|NP_172434.1\|Ras-related GTP-binding protein, putative [*Arabidopsis thaliana*] sp\|O04486\|RB1C_ARATH Ras-related protein Rab11C | LL | LN | | |
| 401 | 75527 | CGPG7682 | 1.00E−55 | 65 | gi\|15240946\| | ref\|NP_195750.1\|phosphatidylethanolamine-binding family protein [*Arabidopsis thaliana*] | LN | | | |
| 402 | 70681 | CGPG4584 | 9.00E−64 | 93 | gi\|18411465\| | ref\|NP_567196.1\|auxin-responsive family protein [*Arabidopsis thaliana*] | CK | PEG | | |
| 403 | 71663 | CGPG4638 | 0 | 93 | gi\|21230153\| | ref\|NP_636070.1\|conserved hypothetical protein [*Xanthomonas campestris* pv. *campestris* str. ATCC 33913] | CK | PEG | | |
| 404 | 72769 | CGPG5573 | 0 | 100 | gi\|15225499\| | ref\|NP_182075.1\|cytochrome P450, putative [*Arabidopsis thaliana*] | CK | PEG | | |
| 405 | 71508 | CGPG1541 | 2.00E−24 | 100 | gi\|15241504\| | sp\|Q9SD80\|OM05_ARATH Mitochondrial import receptor subunit TOM5 homolog (Translocase of outer membrane 5 kDa subunit homolog) | PEG | CS | SP | PEG |
| 406 | 74248 | CGPG5476 | 0 | 100 | gi\|15226152\| | ref\|NP_180926.1\|protein phosphatase 2C, putative/PP2C, putative [*Arabidopsis thaliana*] p | PEG | CS | | |

TABLE 2-continued

| Pep SEQ Id | construct id | gene | annotation e value | % identity | ncbi id | description | traits | | | |
|---|---|---|---|---|---|---|---|---|---|---|
| 407 | 72771 | CGPG2166 | 5.00E−44 | 100 | gi\|18395032\| | ref\|NP_564151.1\|expressed protein [*Arabidopsis thaliana*] | PEG | CK | HS | SS |
| 408 | 72085 | CGPG5228 | 0 | 94 | gi\|15241541\| | ref\|NP_199275.1\|cytochrome P450 family protein [*Arabidopsis thaliana*] dbj\|BAA98115.1\| flavonoid 3',5'-hydroxylase-like; cytochrome P450 [*Arabidopsis thaliana*] | PEG | HS | | |
| 409 | 72744 | CGPG5563 | 1.00E−136 | 96 | gi\|6321574\| | ref\|NP_011651.1\|20S proteasome beta-type subunit; the only nonessential 20S subunit; Pre9p [*Saccharomyces cerevisiae*] | HS | PEG | CK | |
| 410 | 73039 | CGPG810 | 0 | 96 | gi\|15242124\| | ref\|NP_197599.1\|molybdopterin biosynthesis CNX1 protein/molybdenum cofactor biosynthesis enzyme CNX1 (CNX1) [*Arabidopsis thaliana*] | HS | PEG | | |
| 411 | 73054 | CGPG5754 | 2.00E−98 | 100 | gi\|6324827\| | ref\|NP_014896.1\|Nat5p [*Saccharomyces cerevisiae*] pir\|\|S67150 hypothetical protein YOR253w-yeast (*Saccharomyces cerevisiae*) | PEG | HS | SS | PEG |
| 412 | 73501 | CGPG6456 | 0 | 97 | gi\|15888752\| | ref\|NP_354433.1\|AGR_C_2631p [*Agrobacterium tumefaciens* str. C58] sp\|Q8UFH1\|ENO_AGRT5 Enolase (2-phosphoglycerate dehydratase) (2-phospho-D-glycerate hydro-lyase) | HS | PEG | | |
| 413 | 19707 | CGPG4179 | 1.00E−86 | 49 | gi\|15236282\| | ref\|NP_195242.1\|O-methyltransferase family 2 protein [*Arabidopsis thaliana*] | PEG | CS | | |
| 414 | 19951 | CGPG3941 | 5.00E−91 | 54 | gi\|15221582\| | ref\|NP_177064.1\|basic helix-loop-helix (bHLH) family protein [*Arabidopsis thaliana*] | PEG | CK | | |
| 415 | 19967 | CGPG4032 | 1.00E−127 | 67 | gi\|4760710\| | dbj\|BAA77395.1\|SLL2-S9-protein [*Brassica rapa*] | PEG | | | |
| 416 | 70543 | CGPG3815 | 0 | 95 | gi\|15220994\| | ref\|NP_175222.1\|E2F transcription factor-2 (E2F2)/transcription factor E2Fc (E2Fc) [*Arabidopsis thaliana*] | PEG | CK | | |
| 417 | 70707 | CGPG1273 | 1.00E−108 | 100 | gi\|15219558\| | ref\|NP_177523.1\|Ssu72-like family protein [*Arabidopsis thaliana*] pir\|\|F96765 unknown protein F | PEG | | | |
| 418 | 70719 | CGPG1712 | 0 | 86 | gi\|18394560\| | ref\|NP_564043.1\|expressed protein [*Arabidopsis thaliana*] | PEG | | | |
| 419 | 71134 | CGPG817 | 8.00E−55 | 100 | gi\|15240471\| | ref\|NP_200327.1\|small ubiquitin-like modifier 2 (SUMO) [*Arabidopsis thaliana*] | PEG | HS | PP | |
| 420 | 71146 | CGPG2928 | 1.00E−86 | 92 | gi\|29165403\| | gb\|AAO65311.1\|MADS affecting flowering 3 variant II [*Arabidopsis thaliana*] | PEG | | | |
| 421 | 71660 | CGPG4690 | 3.00E−80 | 100 | gi\|18415773\| | ref\|NP_567637.1\|methionine sulfoxide reductase domain-containing protein/ SeIR domain-containing protein [*Arabidopsis thaliana*] | PEG | | | |

TABLE 2-continued

| Pep SEQ Id | construct id | gene | annotation e value | % identity | ncbi id | description | traits | | | |
|---|---|---|---|---|---|---|---|---|---|---|
| 422 | 72086 | CGPG5236 | 0 | 100 | gi\|15232215\| | ref\|NP_191556.1\| methylenetetrahydrofolate reductase 1 (MTHFR1) [*Arabidopsis thaliana*]- | PEG | PP | PEG | |
| 423 | 72632 | CGPG4852 | 4.00E−99 | 90 | gi\|18425032\| | ref\|NP_569028.1\|expressed protein [*Arabidopsis thaliana*] | PEG | | | |
| 424 | 72716 | CGPG5529 | 2.00E−85 | 89 | gi\|6320196\| | ref\|NP_010276.1\|subunit of the Anaphase Promoting Complex; all known APC subunits co-immunoprecipitate with epitope-tagged Apc11p; Apc11p [*Saccharomyces cerevisiae*] | PEG | | | |
| 425 | 72723 | CGPG1848 | 0 | 97 | gi\|15237500\| | ref\|NP_199487.1\|human Rev interacting-like family protein/hRIP family protein [*Arabidopsis thaliana*] dbj\|BAB08919.1\| zinc finger protein Glo3-like [*Arabidopsis thaliana*] | PEG | | | |
| 426 | 72987 | CGPG1787 | 5.00E−81 | 77 | gi\|15231568\| | ref\|NP_189282.1\|octicosapeptide/Phox/Bem1p (PB1) domain-containing protein [*Arabidopsis thaliana*] | PEG | SP | | |
| 427 | 74109 | CGPG6606 | 0 | 77 | gi\|37524479\| | ref\|NP_927823.1\|maltodextrin phosphorylase [*Photorhabdus luminescens* subsp. *laumondii* TTO1] | PEG | | | |
| 428 | 74140 | CGPG6569 | 0 | 99 | gi\|15613102\| | ref\|NP_241405.1\|NADP-dependent aldehyde dehydrogenase [*Bacillus halodurans* C-125] | PEG | PP | PEG | |
| 429 | 74191 | CGPG6597 | 0 | 96 | gi\|22960294\| | ref\|ZP_00007935.1\|COG1850: Ribulose 1,5-bisphosphate carboxylase, large subunit [*Rhodobacter sphaeroides*] | PEG | | | |
| 430 | 74265 | CGPG5356 | 1.00E−117 | 100 | gi\|15237288\| | ref\|NP_197727.1\|GRAM domain-containing protein/ABA-responsive protein-related [*Arabidopsis thaliana*] | PEG | PP | PEG | |
| 431 | 74369 | CGPG6076 | 2.00E−86 | 96 | gi\|18409647\| | ref\|NP_564994.1\|ubiquitin-conjugating enzyme family protein [*Arabidopsis thaliana*] | PEG | CK | PP | PEG |
| 432 | 70217 | CGPG6 | 0 | 97 | gi\|15231536\| | ref\|NP_189259.1\|cytochrome P450 family protein [*Arabidopsis thaliana*] | CK | PP | SP | |
| 433 | 72711 | CGPG1846 | 4.00E−75 | 79 | gi\|15221048\| | ref\|NP_175816.1\|transcription initiation factor IID (TFIID) 31 kDa subunit (TAFII-31) family protein [*Arabidopsis thaliana*] | CK | PP | SP | |
| 434 | 70932 | CGPG4089 | 1.00E−129 | 56 | gi\|15223134\| | ref\|NP_177792.1\|expressed protein [*Arabidopsis thaliana*] | CS | HS | PP | |
| 435 | 73518 | CGPG6497 | 1.00E−177 | 63 | gi\|22981996\| | ref\|ZP_00027327.1\|COG1012: NAD-dependent aldehyde dehydrogenases [*Burkholderia fungorum*] | CS | CK | PP | |
| 436 | 19771 | CGPG4011 | 3.00E−90 | 80 | gi\|18418200\| | ref\|NP_568342.1\|rubredoxin family protein [*Arabidopsis thaliana*] dbj\|BAB10504.1\| gene_id: MKP11.2~unknown protein [*Arabidopsis thaliana*] g | PP | HS | SS | |
| 437 | 73549 | CGPG6460 | 0 | 90 | gi\|37524978\| | ref\|NP_928322.1\|5-carboxymethyl-2-hydroxymuconate semialdehyde | HS | DS | PP | |

TABLE 2-continued

| Pep SEQ Id | construct id | gene | annotation e value | % identity | ncbi id | description | traits | | | | | |
|---|---|---|---|---|---|---|---|---|---|---|---|---|
| | | | | | | dehydrogenase [*Photorhabdus luminescens* subsp. *laumondii* TTO1] | | | | | | |
| 438 | 72994 | CGPG5803 | 0 | 83 | gi\|6322702\| | ref\|NP_012776.1\|Vacuolar transporter, exports large neutral amino acids from the vacuole; member of a family of seven *S. cerevisiae* genes (AVT1-7) related to vesicular GABA-glycine transporters; Avt3p [*Saccharomyces cerevisiae*] | CK | PEG | CS | PP | PEG | |
| 439 | 71928 | CGPG1617 | 0 | 100 | gi\|18394888\| | ref\|NP_564120.1\|catalase 3 (SEN2) [*Arabidopsis thaliana*] | CS | PEG | CK | PP | PEG | |
| 440 | 72903 | CGPG5584 | 0 | 91 | gi\|6322293\| | ref\|NP_012367.1\|Histone methyltransferase with a role in transcriptional elongation, methylates a lysine residue of histone H3; associates with the C-terminal domain of Rpo21p; histone methylation activity is regulated by phosphorylation status of Rpo21p; Set2p [*Saccharomyces cerevisiae*] sp\|P46995\|SET2_YEAST SET domain protein 2 | PEG | PP | SS | | | |
| 441 | 73017 | CGPG5733 | 0 | 94 | gi\|6325368\| | ref\|NP_015436.1\|kinase required for late nuclear division; Dbf20p [*Saccharomyces cerevisiae*] | PEG | PP | PEG | | | |
| 442 | 74587 | CGPG6774 | 0 | 94 | gi\|17938451\| | ref\|NP_535240.1\|succinate semialdehyde dehydrogenase [*Agrobacterium tumefaciens* str. C58] | PEG | DS | HS | PP | SS | |
| 443 | 72453 | CGPG4735 | 6.00E−67 | 91 | gi\|15218924\| | ref\|NP_174236.1\|auxin-responsive family protein [*Arabidopsis thaliana*] pir\|\|A86417 probable auxin-induced protein, 45653-45228 | CK | PP | SP | SS | | |
| 444 | 72967 | CGPG5742 | 0 | 99 | gi\|6321525\| | ref\|NP_011602.1\|Cytosolic catalase T, has a role in protection from oxidative damage by hydrogen peroxide, Ctt1p [*Saccharomyces cerevisiae*] | CS | CK | HS | LL | PP | SS |
| 445 | 72961 | CGPG5591 | 0 | 95 | gi\|15228498\| | ref\|NP_186975.1\|UTP--glucose-1-phosphate uridylyltransferase, putative/ UDP-glucose pyrophosphorylase, putative/UGPase, putative [*Arabidopsis thaliana*] | PEG | SS | HS | PP | | |
| 446 | 73070 | CGPG5627 | 0 | 90 | gi\|15225044\| | ref\|NP_181451.1\|protein kinase family protein [*Arabidopsis thaliana*] | PEG | PP | SS | | | |
| 447 | 73475 | CGPG6385 | 0 | 100 | gi\|39934021\| | ref\|NP_946297.1\|glyceraldehyde-3-phosphate dehydrogenase(GAPDH) [*Rhodopseudomonas palustris* CGA009] | PEG | PP | SS | | | |
| 448 | 72916 | CGPG1814 | 0 | 97 | gi\|15228871\| | ref\|NP_188303.1\|protein phosphatase 2C, putative/ PP2C, putative [*Arabidopsis thaliana*] | PP | SS | | | | |
| 449 | 72969 | CGPG5789 | 0 | 94 | gi\|6321886\| | ref\|NP_011962.1\|Low-affinity glucose transporter of the major facilitator | PP | SP | SS | | | |

TABLE 2-continued

| Pep | | | annotation | | | | | | |
|---|---|---|---|---|---|---|---|---|---|
| SEQ Id | construct id | gene | e value | % identity | ncbi id | description | traits | | |
| | | | | | | superfamily, expression is induced by Hxk2p in the presence of glucose and repressed by Rgt1p when glucose is limiting; Hxt1p [*Saccharomyces cerevisiae*] | | | |
| 450 | 74449 | CGPG6659 | 0 | 96 | gi\|15890426\| | ref\|NP_356098.1\|AGR_L_619p [*Agrobacterium tumefaciens* str. C58] pir\|\|A98170 hypothetical protein AGR_L_619 [imported]-*Agrobacterium* | PP | SS | |
| 451 | 16615 | CGPG2539 | 0 | 98 | gi\|15890896\| | ref\|NP_356568.1\|AGR_L_1560p [*Agrobacterium tumefaciens* str. C58] ref\|NP_534561.1\| glucose-1-phosphate adenylyltransferase [*Agrobacterium tumefaciens* str. C58] | PP | | |
| 452 | 19187 | CGPG3310 | 0 | 91 | gi\|18423163\| | ref\|NP_568731.1\|squamos a promoter-binding protein, putative [*Arabidopsis thaliana*] | PP | | |
| 453 | 19648 | CGPG3134 | 1.00E−179 | 96 | gi\|18413950\| | ref\|NP_568102.1\|short-chain dehydrogenase/reductase (SDR) family protein [*Arabidopsis thaliana*] | PP | | |
| 454 | 70354 | CGPG3995 | 0 | 64 | gi\|15241312\| | ref\|NP_196916.1\|nodulin family protein [*Arabidopsis thaliana*] | DS | PP | SP |
| 455 | 70421 | CGPG2942 | 0 | 88 | gi\|30677977\| | ref\|NP_178317.2\|zinc finger (C2H2 type) family protein [*Arabidopsis thaliana*] | PP | | |
| 456 | 70459 | CGPG3758 | 0 | 95 | gi\|15233315\| | ref\|NP_188242.1\|F-box family protein [*Arabidopsis thaliana*] dbj\|BAB01261.1\| unnamed protein product [*Arabidopsis thaliana*] | PP | | |
| 457 | 70465 | CGPG3775 | 1.00E−155 | 90 | gi\|15236937\| | ref\|NP_195254.1\|zinc finger (C2H2 type) family protein [*Arabidopsis thaliana*] | PP | SP | |
| 458 | 70683 | CGPG4587 | 3.00E−65 | 64 | gi\|18423239\| | ref\|NP_568751.1\|polyadenylate-binding protein, putative/PABP, putative [*Arabidopsis thaliana*] | PP | | |
| 459 | 70725 | CGPG2097 | 0 | 91 | gi\|18420505\| | ref\|NP_568066.1\|expressed protein [*Arabidopsis thaliana*] | CS | PP | |
| 460 | 70852 | CGPG1465 | 0 | 93 | gi\|15237075\| | ref\|NP_195290.1\|isocitrate dehydrogenase, putative/ NAD+ isocitrate dehydrogenase, putative [*Arabidopsis thaliana*] | PP | SP | |
| 461 | 71112 | CGPG934 | 1.00E−130 | 94 | gi\|15218701\| | ref\|NP_171806.1\|expressed protein [*Arabidopsis thaliana*] pir\|\|E86161 F10O3.11 protein-*Arabidopsis thaliana* gb\|AAD25802.1\| Belongs to the PF\|01027 Uncharacterized protein family UPF0005 with 7 transmembrane domains. [*Arabidopsis thaliana*] | CS | PP | |
| 462 | 71127 | CGPG945 | 0 | 97 | gi\|15225307\| | ref\|NP_179604.1\|26S protease regulatory complex subunit 4, putative [*Arabidopsis thaliana*] pir\|\|E84585 26S proteasome subunit 4 [imported]-*Arabidopsis thaliana* | PP | | |

TABLE 2-continued

| Pep | | | annotation | | | | | |
|---|---|---|---|---|---|---|---|---|
| SEQ Id | construct id | gene | e value | % identity | ncbi id | description | traits | |
| 463 | 71132 | CGPG1561 | 0 | 98 | gi\|15232209\| | ref\|NP_191550.1\|expressed protein [*Arabidopsis thaliana*] | PP | |
| 464 | 71217 | CGPG95 | 0 | 100 | gi\|15221476\| | ref\|NP_172127.1\|shaggy-related protein kinase iota/ASK-iota (ASK9) (GSK1) [*Arabidopsis thaliana*] (EC 2.7.1.—) | PP | |
| 465 | 71645 | CGPG4688 | 3.00E−69 | 100 | gi\|18401105\| | ref\|NP_566544.1\|phosphotransfer family protein [*Arabidopsis thaliana*] | PP | |
| 466 | 71726 | CGPG3894 | 0 | 93 | gi\|15217677\| | ref\|NP_171725.1\|no apical meristem (NAM) family protein [*Arabidopsis thaliana*] | HS | PP |
| 467 | 72432 | CGPG4562 | 1.00E−144 | 92 | gi\|20152540\| | emb\|CAD29662.1\|putative auxin response factor 23 [*Arabidopsis thaliana*] | PP | SP |
| 468 | 72450 | CGPG4732 | 1.00E−170 | 100 | gi\|15238890\| | ref\|NP_197366.1\|zinc finger (C3HC4-type RING finger) family protein [*Arabidopsis thaliana*] | LL | PP |
| 469 | 72455 | CGPG4742 | 1.00E−144 | 93 | gi\|15242893\| | ref\|NP_200597.1\|anthranilate synthase beta subunit, putative [*Arabidopsis thaliana*] | PP | PEG |
| 470 | 72727 | CGPG5522 | 1.00E−118 | 100 | gi\|6324107\| | ref\|NP_014177.1\|functionally related to TFIIB, affects start site selection in vivo; Ssu72p [*Saccharomyces cerevisiae*] | PP | |
| 471 | 72817 | CGPG4987 | 0 | 96 | gi\|30679158\| | ref\|NP_567238.2\|AAA-type ATPase family protein [*Arabidopsis* | PP | |
| 472 | 72992 | CGPG5777 | 0 | 90 | gi\|6324981\| | ref\|NP_015049.1\|S-adenosylMethionine Permease; Sam3p [*Saccharomyces cerevisiae*] | PP | PEG |
| 473 | 73007 | CGPG5760 | 0 | 93 | gi\|6320865\| | ref\|NP_010944.1\|One of three possible beta-subunits of the Snf1 kinase complex, allows nuclear localization of the Snf1 kinase complex in the presence of a nonfermentable carbon source; contains glycogen-binding domain; Gal83p [*Saccharomyces cerevisiae*] | PP | |
| 474 | 73073 | CGPG5688 | 0 | 95 | gi\|16331010\| | ref\|NP_441738.1\|fructose 1,6-bisphosphatase [*Synechocystis* sp. PCC 6803] | PP | |
| 475 | 73506 | CGPG6496 | 0 | 96 | gi\|23062569\| | ref\|ZP_00087347.1\|COG10 12: NAD-dependent aldehyde dehydrogenases [*Pseudomonas fluorescens* PfO-1] | PP | |
| 476 | 74107 | CGPG6590 | 0 | 95 | gi\|15965198\| | ref\|NP_385551.1\|PYRUVATE DEHYDROGENASE ALPHA2 SUBUNIT PROTEIN [*Sinorhizobium meliloti* 1021] | PP | SS |
| 477 | 74117 | CGPG6575 | 0 | 81 | gi\|37528116\| | ref\|NP_931461.1\| Phenylacetaldehyde dehydrogenase (PAD) [*Photorhabdus luminescens* subsp. *laumondii* TTO1] | CS | PP |
| 478 | 74131 | CGPG6592 | 0 | 96 | gi\|16329404\| | ref\|NP_440132.1\|transaldolase [*Synechocystis* sp. PCC 6803] B- | PP | SS |

TABLE 2-continued

| Pep SEQ Id | construct id | gene | annotation e value | % identity | ncbi id | description | traits | |
|---|---|---|---|---|---|---|---|---|
| 479 | 74344 | CGPG5929 | 1.00E−111 | 100 | gi\|15236410\| | ref\|NP_193147.1\|COP9 signalosome subunit, putative/CSN subunit, putative (CSN8) [*Arabidopsis thaliana*] | HS | PP |
| 480 | 14320 | CGPG1229 | 0 | 100 | gi\|18418018\| | ref\|NP_567894.1\|expressed protein [*Arabidopsis thaliana*] | SP | |
| 481 | 16756 | CGPG2117 | 1.00E−142 | 85 | gi\|18391249\| | ref\|NP_563885.1\|expressed protein [*Arabidopsis thaliana*] | SP | |
| 482 | 17448 | CGPG2673 | 1.00E−102 | 72 | gi\|15239624\| | ref\|NP_197993.1\|PHD finger family protein [*Arabidopsis thaliana*] gb\|AAM64729.1\| nucleic acid binding protein-like [*Arabidopsis thaliana*] | SP | |
| 483 | 17633 | CGPG2839 | 1.00E−145 | 85 | gi\|18395124\| | ref\|NP_564171.1\|basic helix-loop-helix (bHLH) family protein [*Arabidopsis thaliana*] | SP | |
| 484 | 18876 | CGPG3096 | 1.00E−172 | 89 | gi\|18394949\| | ref\|NP_564133.1\|transporter-related [*Arabidopsis thaliana*] pir\|\|G86343 hypothetical protein T22I11.10 | SP | |
| 485 | 19120 | CGPG1976 | 0 | 100 | gi\|15232345\| | ref\|NP_188710.1\|fertilization-independent endosperm protein (FIE) [*Arabidopsis thaliana*] | SP | |
| 486 | 19221 | CGPG2958 | 1.00E−159 | 78 | gi\|30690446\| | ref\|NP_182182.2\|Dof zinc finger protein DAG2/Dof affecting germination 2 (DAG2) [*Arabidopsis thaliana*] | SP | |
| 487 | 70206 | CGPG4116 | 1.00E−139 | 64 | gi\|18412918\| | ref\|NP_565249.1\|phospholipid/glycerol acyltransferase family protein [*Arabidopsis* | SP | |
| 488 | 70223 | CGPG53 | 0 | 93 | gi\|15240313\| | ref\|NP_198006.1\|hexose transporter, putative [*Arabidopsis thaliana*] | SP | |
| 489 | 70347 | CGPG3147 | 1.00E−121 | 66 | gi\|18416267\| | ref\|NP_567693.1\|Dof-type zinc finger domain-containing protein [*Arabidopsis thaliana*] | SP | |
| 490 | 70406 | CGPG1687 | 0 | 93 | gi\|18397470\| | ref\|NP_564354.1\|early-responsive to dehydration stress protein (ERD4) [*Arabidopsis thaliana*] | SP | |
| 491 | 70469 | CGPG3791 | 1.00E−171 | 89 | gi\|15237581\| | ref\|NP_198936.1\|MADS-box family protein [*Arabidopsis thaliana*] | SP | HS |
| 492 | 70564 | CGPG1864 | 0 | 89 | gi\|15219067\| | ref\|NP_173589.1\|SWIRM domain-containing protein/DNA-binding family protein gb\|AAD41423.1\| Contains similarity to gb\|AF033823 moira protein from *Drosophila melanogaster* and contains a PF\|00249 Myb-like DNA-binding domain. | SP | |
| 493 | 70601 | CGPG2917 | 0 | 91 | gi\|15235140\| | ref\|NP_193702.1\|zinc finger (C3HC4-type RING finger) family protein [*Arabidopsis thaliana*] pir\|\|T04748 hypothetical protein T16H5.30-*Arabidopsis thaliana* | SP | PP |
| 494 | 70612 | CGPG3721 | 0 | 96 | gi\|18416732\| | ref\|NP_568256.1\|conserved oligomeric Golgi complex component-related/COG complex component-related [*Arabidopsis thaliana*] | SP | |

TABLE 2-continued

| Pep SEQ Id | construct id | gene | annotation e value | % identity | ncbi id | description | traits | | | | |
|---|---|---|---|---|---|---|---|---|---|---|---|
| 495 | 70720 | CGPG1358 | 0 | 93 | gi\|15238483\| | ref\|NP_198387.1\|lectin protein kinase family protein [*Arabidopsis thaliana*] | SP | | | | |
| 496 | 70735 | CGPG2661 | 1.00E−109 | 100 | gi\|15231241\| | ref\|NP_187953.1\|transcription initiation factor IID-1 (TFIID-1)/TATA-box factor 1/TATA sequence-binding protein 1 (TBP1) [*Arabidopsis thaliana*] | SP | | | | |
| 497 | 70846 | CGPG377 | 1.00E−151 | 100 | gi\|15221223\| | ref\|NP_177577.1\|zinc finger (C3HC4-type RING finger) family protein [*Arabidopsis thaliana*] pir\|\|D96772 probable RING zinc finger protein | SP | | | | |
| 498 | 70923 | CGPG4020 | 0 | 87 | gi\|8132347\| | gb\|AAF73257.1\|MAP kinase PsMAPK2 [*Pisum sativum*] | SP | | | | |
| 499 | 71149 | CGPG3457 | 0 | 83 | gi\|20141566\| | sp\|P48001\| HKL4_ARATHHomeobox protein knotted-1 like 4 (KNAT4) pir\|\|T51795 HOMEOBOX PROTEIN KNOTTED-1 LIKE 4 (KNAT4)- | SP | | | | |
| 500 | 71608 | CGPG4687 | 0 | 100 | gi\|15220438\| | ref\|NP_72008.1\|ent-kaurenoic acid hydroxylase (KAO1)/cytochrome P450 88A3, putative (CYP88A3) [*Arabidopsis thaliana*] | SP | | | | |
| 501 | 71739 | CGPG4345 | 7.00E−89 | 80 | gi\|18406944\| | ref\|NP_566061.1\|expressed protein [*Arabidopsis thaliana*] | SP | | | | |
| 502 | 72014 | CGPG5230 | 0 | 100 | gi\|25410898\| | pir\|\|D84423probable WD-40-repeat protein [imported]- *Arabidopsis thaliana* gb\|AAD14533.1\| putative stress protein [*Arabidopsis thaliana*] | SP | | | | |
| 503 | 72051 | CGPG5241 | 0 | 93 | gi\|18401606\| | ref\|NP_566585.1\|cyclic nucleotide-binding transporter 1/CNBT1 (CNGC20) [*Arabidopsis thaliana*] sp\|Q9LD37\|CG20_ARATH Probable cyclic nucleotide-gated ion channel 20, chloroplast precursor (Cyclic nucleotide-binding transporter 1) | SP | | | | |
| 504 | 74259 | CGPG5343 | 0 | 96 | gi\|15222882\| | ref\|NP_175431.1\|branched-chain amino acid aminotransferase 6/ branched-chain amino acid transaminase 6 (BCAT6) [*Arabidopsis thaliana*] s | CS | HS | SS | | |
| 505 | 72463 | CGPG4760 | 8.00E−48 | 100 | gi\|15236351\| | ref\|NP_193115.1\|auxin-responsive protein, putative [*Arabidopsis thaliana*] | CS | SS | HS | LN | PP |
| 506 | 72902 | CGPG5597 | 0 | 88 | gi\|15240576\| | ref\|NP_199800.1\|chloride channel protein (CLC-c) [*Arabidopsis thaliana*] sp\|Q96282\|CLCC_ARATH Chloride channel protein CLC-c (AtCLC-c) | SS | CS | DS | | |
| 507 | 74572 | CGPG6640 | 1.00E−109 | 93 | gi\|16331001\| | ref\|NP_441729.1\|unknown protein [*Synechocystis* sp. PCC 6803] | CS | PP | SS | | |
| 508 | 73055 | CGPG5768 | 0 | 97 | gi\|6321588\| | ref\|NP_011665.1\|Hypothetical ORF; Ygr149wp [*Saccharomyces cerevisiae*] | SS | CS | HS | | |
| 509 | 74103 | CGPG6558 | 0 | 99 | gi\|15833050\| | ref\|NP_311823.1\|fructose-bisphosphate aldolase | HS | PP | SS | | |

TABLE 2-continued

| Pep SEQ Id | construct id | gene | annotation e value | % identity | ncbi id | description | traits | | |
|---|---|---|---|---|---|---|---|---|---|
| | | | | | | class II [*Escherichia coli* O157:H7] r | | | |
| 510 | 72921 | CGPG5781 | 0 | 93 | gi\|6322892\| | ref\|NP_012965.1\|general amino acid permease; Gap1p [*Saccharomyces cerevisiae*] | CK | PEG | SS |
| 511 | 72968 | CGPG5772 | 0 | 99 | gi\|6321546\| | ref\|NP_011623.1\|role in DNA replication during S phase; Clb6p [*Saccharomyces cerevisiae*] | PEG | LL | SS |
| 512 | 19703 | CGPG4172 | 0 | 83 | gi\|7488676\| | pir\|\|T07150G-box binding factor 2A-soybean (fragment) gb\|AAB00097.1\| G-box binding factor | HS | SS | |
| 513 | 19946 | CGPG4097 | 1.00E−46 | 34 | gi\|15219099\| | ref\|NP_175691.1\|2-oxoglutarate-dependent dioxygenase, putative [*Arabidopsis thaliana*] | SS | | |
| 514 | 19980 | CGPG3914 | 2.00E−63 | 49 | gi\|28629811\| | gb\|AAO45179.1\|transcription factor Myb1 [*Malus xiaojinensis*] | CS | SS | |
| 515 | 70435 | CGPG3701 | 1.00E−150 | 91 | gi\|15236597\| | ref\|NP_193499.1\|casein kinase II beta chain, putative [*Arabidopsis thaliana*] | SS | PP | SP |
| 516 | 71114 | CGPG1657 | 0 | 88 | gi\|30680729\| | ref\|NP_849990.1\|K+ efflux antiporter, putative (KEA4) [*Arabidopsis thaliana*] | SS | | |
| 517 | 72451 | CGPG4733 | 0 | 94 | gi\|15239622\| | ref\|NP_197992.1\|mitochondrial substrate carrier family protein [*Arabidopsis thaliana*] | SS | | |
| 518 | 72947 | CGPG5607 | 3.00E−62 | 53 | gi\|1483230\| | emb\|CAA67968.1\|MADS4 protein [*Betula pendula*] | SS | | |
| 519 | 73012 | CGPG5786 | 0 | 97 | gi\|6324187\| | ref\|NP_014257.1\|belongs to a ubiquitous family of cytoplasmic membrane proteins that transport only ammonium (NH(4)(+) + NH(3)).; Mep2p [*Saccharomyces cerevisiae*] | SS | | |
| 520 | 73022 | CGPG5622 | 0 | 86 | gi\|15225518\| | ref\|NP_182083.1\|protein kinase family protein [*Arabidopsis thaliana*] | SS | | |
| 521 | 73488 | CGPG6394 | 1.00E−154 | 94 | gi\|16080620\| | ref\|NP_391447.1\|UTP-glucose-1-phosphate uridylyltransferase [*Bacillus subtilis*] | SS | CS | PP |
| 522 | 73901 | CGPG5237 | 0 | 92 | gi\|18400284\| | ref\|NP_565553.1\|extra-large guanine nucleotide binding protein/G-protein (XLG) | SS | | |
| 523 | 73964 | CGPG5804 | 0 | 88 | gi\|6319773\| | ref\|NP_009855.1\|Na+/Pi cotransporter, active in early growth phase; similar to phosphate transporters of *Neurospora crassa*; transcription regulated by inorganic phosphate concentrations and Pho4p; Pho89p [ | SS | | |
| 524 | 74019 | CGPG5706 | 2.00E−92 | 100 | gi\|16079815\| | ref\|NP_390639.1\|adenine phosphoribosyltransferase [*Bacillus subtilis*] | SS | | |
| 525 | 74022 | CGPG5724 | 0 | 97 | gi\|18378991\| | ref\|NP_563659.1\|glycosyl hydrolase family 3 protein [*Arabidopsis thaliana*] | SS | SP | |
| 526 | 74114 | CGPG6551 | 0 | 99 | gi\|15888903\| | ref\|NP_354584.1\|AGR_C_2 921p [*Agrobacterium tumefaciens* str. C58] pir\|\|H97551 probable aminotransferase aatc | SS | | |

TABLE 2-continued

| Pep SEQ Id | construct id | gene | annotation e value | % identity | ncbi id | description | traits | |
|---|---|---|---|---|---|---|---|---|
| 527 | 74262 | CGPG5353 | 0 | 100 | gi\|18416245\| | ref\|NP_568226.1\|histidinol-phosphate aminotransferase, putative [*Arabidopsis thaliana*] | SS | PP |
| 528 | 74292 | CGPG5367 | 0 | 96 | gi\|15239204\| | ref\|NP_201393.1\|U-box domain-containing protein [*Arabidopsis thaliana*] | SS | |
| 529 | 74302 | CGPG5384 | 1.00E−59 | 82 | gi\|25313155\| | pir\|\|A96787protein F10A5.6 [imported]-*Arabidopsis thaliana* | PP | SS |
| 530 | 74325 | CGPG5898 | 1.00E−174 | 86 | gi\|15230382\| | ref\|NP_188576.1\|cinnamyl-alcohol dehydrogenase (CAD) [*Arabidopsis thaliana*] | SS | |
| 531 | 74429 | CGPG6689 | 0 | 96 | gi\|16077873\| | ref\|NP_388687.1\|acetoin dehydrogenase E1 component (TPP-dependent alpha subunit) [*Bacillus subtilis*] | SS | |
| 532 | 74440 | CGPG6682 | 6.00E−90 | 82 | gi\|15613838\| | ref\|NP_242141.1\|uridine kinase [*Bacillus halodurans* C-125] | SS | |
| 533 | 74462 | CGPG6668 | 5.00E−67 | 99 | gi\|16332127\| | ref\|NP_442855.1\|unknown protein [*Synechocystis* sp. PCC 6803] | HS | SS |
| 534 | 74465 | CGPG6692 | 1.00E−119 | 99 | gi\|16078642\| | ref\|NP_389461.1\|similar to ribulose-5-phosphate 3-epimerase [*Bacillus subtilis*] | PP | SS |
| 535 | 74474 | CGPG6669 | 2.00E−85 | 82 | gi\|16331209\| | ref\|NP_441937.1\|unknown protein [*Synechocystis* sp. PCC 6803] | LL | SS |
| 536 | 74505 | CGPG6783 | 0 | 100 | gi\|16129426\| | ref\|NP_415984.1\|cryptic nitrate reductase 2 beta subunit [*Escherichia coli* K12] | SS | |
| 537 | 74507 | CGPG6799 | 0 | 82 | gi\|27479656\| | gb\|AAO17183.1\|Orf17 [*Photorhabdus luminescens*] | SP | SS |
| 538 | 74562 | CGPG6764 | 0 | 95 | gi\|16077501\| | ref\|NP_388315.1\|similar to pyruvate oxidase [*Bacillus subtilis*] | SS | |

"PEP SEQ ID" which is the amino acid sequence of the protein cognate to the DNA in the recombinant DNA construct corresponding to a protein sequence of a SEQ ID NO. in the Sequence Listing.
"constructed" is an arbitrary name for the recombinant DNA describe more particularly in Table I.
"annotation" refers to a description of the top hit protein obtained from an amino acid sequence query of each PEP SEQ ID NO to GenBank database of the National Center for Biotechnology Information (ncbi). More particularly, "gi" is the GenBank ID number for the top BLAST hit.
"description" refers to the description of the top BLAST hit.
"e-value" provides the expectation value for the BLAST hit.
"identity" refers to the percentage of identically matched amino acid residues along the length of the portion of the sequences which is aligned by BLAST between the sequence of interest provided herein and the hit sequence in GenBank.
"traits" identified by two letters codes the confirmed improvement in a transgenic plant provided by the recombinant DNA . The codes for improved traits are:
"CK" which indicates cold tolerance improvement identified under a cold shock tolerance screen;
"CS" which indicates cold tolerance improvement identified by a cold germination tolerance screen;
"DS" which indicates drought tolerance improvement identified by a soil drought stress tolerance screen;
"PEG" which indicates osmotic stress tolerance improvement identified by a PEG induced osmotic stress tolerance screen;
"HS" which indicates heat stress tolerance improvement identified by a heat stress tolerance screen;
"SS" which indicates high salinity stress tolerance improvement identified by a salt stress tolerance screen;
"LN" which indicates nitrogen use efficiency improvement identified by a limited nitrogen tolerance screen;
"LL" which indicates attenuated shade avoidance response identified by a shade tolerance screen under a low light condition;
"PP" which indicates improved growth and development at early stages identified by an early plant growth and development screen;
"SP" which indicates improved growth and development at late stages identified by a late plant growth and development screen provided herein.

Screens for Identifying Trait Improving Genes

DS—Improvement of Drought Tolerance Identified by a Soil Drought Stress Tolerance Screen:

Drought is a water deficit condition that imposes osmotic stress on plants. Plants are particularly vulnerable to drought during the flowering stage. The drought condition in the screening process disclosed in Example 1B started from the flowering time and was sustained to the end of harvesting. The drought tolerance-imparting DNA defined for this invention are used in recombinant DNA constructs that improve plant survival rate under drought conditions. Exemplary recombinant DNA which has been identified for conferring such drought tolerance is identified as such in Table 2. Such identified recombinant DNA is useful in generating transgenic plants that are tolerant to the drought condition imposed during flowering time and in other stages of the plant life cycle. As demonstrated from the model plant screen, in some embodiments of transgenic plants with trait-improving recombinant DNA grown under such sustained drought condition also have increased total seed weight per plant in addition to the increased survival rate within a transgenic population, providing a higher yield potential as compared to control plants.

PEG-Improvement of Drought Tolerance Identified by PEG Induced Osmotic Stress Tolerance Screen:

Various drought levels can be artificially induced by using various concentrations of polyethylene glycol (PEG) to produce different osmotic potentials (Pilon-Smits et al., (1995) Plant Physiol. 107:125-130). Several physiological characteristics have been reported as being reliable indications for selection of plants possessing drought tolerance. These characteristics include the rate of seed germination and seedling growth. The traits can be assayed relatively easily by measuring the growth rate of seedling in PEG solution. Thus, a PEG-induced osmotic stress tolerance screen is a useful surrogate for drought tolerance screen. Certain embodiments of transgenic plants with trait-improving recombinant DNA identified in the PEG-induced osmotic stress tolerance screen survive drought conditions providing a higher yield potential as compared to control plants.

SS-Improvement of Drought Tolerance Identified by High Salinity Stress Tolerance Screen:

Three different factors are responsible for salt damages: (1) osmotic effects, (2) disturbances in the mineralization process, (3) toxic effects caused by the salt ions, e.g., inactivation of enzymes. While the first factor of salt stress results in the wilting of the plants that is similar to drought effect, the ionic aspect of salt stress is clearly distinct from drought. Exemplary recombinant DNA which has been identified to help plants maintain biomass, root growth and/or plant development in high salinity conditions are identified as such in Table 2. Since osmotic effect is one of the major components of salt stress, which is common to the drought stress, embodiments of trait-improving recombinant DNA identified in a high salinity stress tolerance screen also provide transgenic crops with improved drought tolerance. Embodiments of transgenic plants with trait-improving recombinant DNA identified in a high salinity stress tolerance screen survive drought conditions and/or high salinity conditions providing a higher yield potential as compared to control plants.

HS-Improvement of Drought Tolerance Identified by Heat Stress Tolerance Screen:

Heat and drought stress often occur simultaneously, limiting plant growth. Heat stress can cause the reduction in photosynthesis rate, inhibition of leaf growth and osmotic potential in plants. Thus, genes identified as heat stress tolerance conferring genes may also impart improved drought tolerance to plants. As demonstrated from the model plant screen, embodiments of transgenic plants with trait-improving recombinant DNA identified in a heat stress tolerance screen can survive better heat stress conditions and/or drought conditions providing a higher yield potential as compared to control plants.

CK and CS-Improvement of Tolerance to Cold Stress:

Low temperature may immediately result in mechanical constraints, changes in activities of macromolecules, and reduced osmotic potential. Two screening conditions, i.e., cold shock tolerance screen (CK) and cold germination tolerance screen (CS), were set up to look for transgenic plants that display visual growth advantage at lower temperature. In cold germination tolerance screen, the transgenic *Arabidopsis* plants were exposed to a constant temperature of 8 degrees C. from planting until day 28 post planting. The trait-improving recombinant DNA identified by such screen are particular useful for the production of transgenic plant that can germinate more robustly in a cold temperature as compared to the wild type plants. In cold shock tolerance screen, the transgenic plants were first grown under the normal growth temperature of 22 degrees C. until day 8 post planting, and subsequently were placed under 8 degrees C. until day 28 post planting. Embodiments of transgenic plants with trait-improving recombinant DNA identified in a cold shock stress tolerance screen and/or a cold germination stress tolerance screen survive cold conditions providing a higher yield potential as compared to control plants.

Improvement of Tolerance to Multiple Stresses:

Different kinds of stresses often lead to identical or similar reaction in the plants. Genes that are activated or inactivated as a reaction to stress can either act directly in a way the genetic product reduces a specific stress, or they can act indirectly by activating other specific stress genes. By manipulating the activity of such regulatory genes, i.e., multiple stress tolerance genes, plants are enabled to react to different kinds of stresses. For examples, DNA for expressing proteins of SEQ ID NO:352 and SEQ ID NO:353 is useful to improve both heat stress tolerance and cold stress tolerance in plants. Plants transformed with DNA for expressing protein of SEQ ID NO:508 resist heat stress, salt stress and cold stress. Thus, the disclosed stress tolerance conferring genes are useful in combinations to generate transgenic plants that resist multiple stress conditions.

PP-Improvement of Early Plant Growth and Development:

It is known in the art that to minimize the impact of disease on crop profitability, it is important to start the season with healthy vigorous plants. This means avoiding seed and seedling diseases, leading to increased nutrient uptake and increased yield potential. Traditionally early planting and applying fertilizer are the methods used for promoting early seedling vigor. In early development stage, plant embryos establish only the basic root-shoot axis, a cotyledon storage organ(s), and stem cell populations, called the root and shoot apical meristems, that continuously generate new organs throughout post-embryonic development. "Early growth and development" encompasses the stages of seed imbibition through the early vegetative phase. Certain DNA is identified as useful to produce transgenic plants that have advantages in one or more processes including, but not limited to, germination, seedling vigor, root growth and root morphology under non-stressed conditions. The transgenic plants starting from a more robust seedling are less susceptible to the fungal and bacterial pathogens that attach germinating seeds and seedling. Furthermore, seedlings with advantage in root growth are more resistant to drought stress due to extensive and deeper root architecture. Therefore, genes conferring the growth advantage in early stages to plants are used to generate transgenic plants that are more resistant to various stress conditions due to improved early plant development. Exemplary recombinant DNA that confers both stress tolerance and growth advantages to plants, is identified as such in Table 2, e.g., DNA encoding a protein of SEQ ID NO:444 can improve the plant early growth and development, and impart heat and cold tolerance to plants. Embodiments of transgenic plants with trait-improving recombinant DNA identified in the early plant development screen grow better under non-stress conditions and/or stress conditions providing a higher yield potential as compared to control plants.

SP-Improvement of Late Plant Growth and Development:

"Late growth and development" encompasses the stages of leaf development, flower production, and seed maturity. Transgenic plants with late growth and development advantages express DNA that is identified as such in Table 2. Such plants exhibit at least one phenotypic characteristics including, but not limited to, increased rosette radius, increased rosette dry weight, seed dry weight, silique dry weight, and silique length. For example, the rosette radius and rosette dry weight are used as the indexes of photosynthesis capacity, and thereby plant source strength and yield potential of a plant. Seed dry weight, silique dry weight and silique length are used as the indexes for plant sink strength, which are considered as the direct determinants of yield. Embodiments of transgenic plants with trait-improving recombinant DNA identified in the late development screen grow better and/or have improved development during leaf development and seed maturation providing a higher yield potential as compared to control plants.

LL-Improvement of Tolerance to Shade Stress Identified in a Low Light Screen:

The effects of light on plant development are especially prominent at the seedling stage. Under normal light conditions with unobstructed direct light, a plant seeding develops according to a characteristic photomorphogenic pattern, in which plants have open and expanded cotyledons and short hypocotyls. Then the plant's energy is devoted to cotyledon and leaf development while longitudinal extension growth is minimized. Under low light condition where light quality and intensity are reduced by shading, obstruction or high population density, a seedling displays a shade-avoidance pattern, in which the seedling displays a reduced cotyledon expansion, and hypocotyls extension is greatly increased. As the result, a plant under low light condition increases significantly its stem length at the expanse of leaf, seed or fruit and storage organ development, thereby adversely affecting of yield. Recombinant DNA that enables plants to have an attenuated shade avoidance response so that the source of plant can be contributed to reproductive growth efficiently provides embodiments of those plants with higher yield as compared to the wild type plants. Embodiments of transgenic plants with trait-improving recombinant DNA identified in a shade stress tolerance screen have attenuated shade response under shade conditions providing a higher yield potential as compared to control plants. The transgenic plants generated by this invention are suitable for a higher density planting, thereby resulting increased yield per unit area.

LN-Improvement of Tolerance to Low Nitrogen Availability Stress

Nitrogen is a key factor in plant growth and crop yield. The metabolism, growth and development of plants are profoundly affected by their nitrogen supply. Restricted nitrogen supply alters shoot to root ratio, root development, activity of enzymes of primary metabolism and the rate of senescence (death) of older leaves. All field crops have a fundamental dependence on inorganic nitrogenous fertilizer. Since fertilizer is rapidly depleted from most soil types, it must be supplied to growing crops two or three times during the growing season. Enhanced nitrogen use efficiency by plants should enable crops cultivated under low nitrogen availability stress condition resulted from low fertilizer input or poor soil quality.

Recombinant DNA that imparts enhanced nitrogen use efficiency in transgenic plants is identified in Table 2. Such plants exhibit one or more desirable traits including, but not limited to, increased seedling weight, increased number of green leaves, increased number of rosette leaves, altered root length and advanced flower bud formation. Such plants can also have altered amino acid or protein compositions, increased yield and/or better seed quality. Embodiments of such transgenic plants are productively cultivated under nitrogen nutrient deficient conditions, i.e., nitrogen-poor soils and low nitrogen fertilizer inputs that cause the growth of wild type plants to cease or to be so diminished as to make the wild type plants practically useless under such conditions. The transgenic plants also are advantageously used to achieve earlier maturing, faster growing, and/or higher yielding crops and/or produce more nutritious foods and animal feedstocks when cultivated using nitrogen non-limiting growth conditions.

Stacked Traits:

This invention also provides transgenic plants with stacked engineered traits, e.g., a crop having an improved phenotype resulting from expression of a trait-improving recombinant DNA, in combination with herbicide and/or pest resistance traits. For example, genes of the current invention can be stacked with other traits of agronomic interest, such as a trait providing herbicide resistance, for example a glyphosate resistance trait, or insect resistance, such as using a gene from *Bacillus thuringiensis* to provide resistance against lepidopteran, coliopteran, homopteran, hemiopteran, and other insects. Herbicides for which resistance is useful in a plant include glyphosate herbicides, phosphinothricin herbicides, oxynil herbicides, imidazolinone herbicides, dinitroaniline herbicides, pyridine herbicides, sulfonylurea herbicides, bialaphos herbicides, sulfonamide herbicides and gluphosinate herbicides. To illustrate that the production of transgenic plants with herbicide resistance is a capability of those of ordinary skill in the art, reference is made to U.S. 2003-0106096 A1 and 2002-0112260 A1 and U.S. Pat. Nos. 5,034,322; 5,776,760, 6,107,549 and 6,376,754, all of which are incorporated herein by reference. To illustrate that the production of transgenic plants with pest resistance is a capability of those of ordinary skill in the art reference is made to U.S. Pat. Nos. 5,250,515 and 5,880,275 which disclose plants expressing an endotoxin of *Bacillus thuringiensis* bacteria, to U.S. Pat. No. 6,506,599 which discloses control of invertebrates which feed on transgenic plants which express dsRNA for suppressing a target gene in the invertebrate, to U.S. Pat. No. 5,986,175 which discloses the control of viral pests by transgenic plants which express viral replicase, and to U.S. Patent Application Publication 2003/0150017 A1 which discloses control of pests by a transgenic plant which express a dsRNA targeted to suppressing a gene in the pest, all of which are incorporated herein by reference.

Once one recombinant DNA has been identified as conferring an improved trait of interest in transgenic *Arabidopsis* plants, several methods are available for using the sequence of that recombinant trait-imparting DNA and knowledge about the protein it encodes to identify homologs of that sequence from the same plant and different plant species or other organisms, e.g., bacteria and yeast. Thus, in one aspect, this invention provides methods for identifying a homologous gene with a DNA sequence homologous to any of SEQ ID NO:1 through SEQ ID NO:269, or a homologous protein with an amino acid sequence homologous to any of SEQ ID NO:270 through SEQ ID NO:538. In another aspect, this invention provides a consensus amino acid sequence for respective homologs for each of SEQ ID NO:270 through SEQ ID NO:538. In yet another aspect, this invention also includes linking or associating one or more desired traits, or gene function with a homolog sequence disclosed herein.

The trait-improving recombinant DNA and methods of using such trait-improving recombinant DNA for generating transgenic plants with improved traits provided by this invention are not limited to any particular plant species. Indeed, the plants of this invention encompass many species of monocots and dicots and include agriculturally useful plants which are cultivated for purposes of food production or industrial applications, e.g., corn and soybean plants and cotton plants. Recombinant DNA constructs optimized for soybean transformation and recombinant DNA constructs optimized for corn transformation are disclosed in the following examples. Other plants of this invention include canola, wheat, sunflower, sorghum, alfalfa, barley, millet, rice, tobacco, fruit and vegetable crops, and turfgrass.

Thus, embodiments of this invention include the use of both DNA identified in Table 3 and homologs in recombinant DNA for transgenic crop plants with improved traits. Transgenic crop plants with improved traits are identified from populations of plants grown from transgenic events by screening to segregate the plants of this invention from plants without the improved traits. Preferred screens for transgenic crop plants identify plants with improved responses to stress conditions, e.g., assays using imposed stress conditions to detect improved responses to drought stress, nitrogen deficiency, cold growing conditions, or alternatively, under naturally present stress conditions, for example under field conditions. Biomass measures are made on greenhouse or field grown plants and include such measurements as plant height, stem diameter, root and shoot dry weights, and, for corn plants, ear length and diameter.

Trait data on morphological changes is collected by visual observation during the process of plant regeneration as well as in regenerated plants transferred to soil. Such trait data includes characteristics such as normal plants, bushy plants, taller plants, thicker stalks, narrow leaves, striped leaves, knotted phenotype, chlorosis, albino, anthocyanin production, or altered tassels, ears or roots. Other enhanced traits are identified by measurements taken under field conditions, such as days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barrenness/prolificacy, green snap, and pest resistance. In addition, trait characteristics of harvested grain are confirmed, including number of kernels per row on the ear, number of rows of kernels on the ear, kernel abortion, kernel weight, kernel size, kernel density and physical grain quality.

To confirm hybrid yield in transgenic corn plants expressing trait-imparting DNA of this invention, it is useful to test hybrid plants over multiple years at multiple locations in a geographical location where corn is conventionally grown, e.g., in Iowa, Illinois and Kansas, under "normal" field conditions as well as under stress conditions, e.g., under drought or population density stress.

Transgenic crop plants are used to provide other aspects of this invention such as transgenic seeds of crop plants. Seeds of transgenic plants are used to propagate more progeny plants which contain the trait-improving recombinant DNA constructs of this invention. These progeny plants are within the scope of this invention when they contain a trait-improving recombinant DNA construct of this invention, whether or not these plants are selfed or crossed with different varieties of plants.

Screening Methods for Crop Transgenic Plants with Enhanced Agronomic Trait

Due to variability in transformation many transgenic events which survive to fertile transgenic plants that produce seeds and progeny plants do not exhibit an enhanced agronomic trait. Thus, screening is necessary to identify the transgenic events that produce the transgenic plants and seeds of this invention. Transgenic crop plants having enhanced traits are identified from populations of plants transformed as described herein by evaluating the trait in a variety of assays to detect an enhanced agronomic trait. Useful assays include analyses to detect changes in the chemical composition, biomass, physiological properties and morphology of the plant. Changes in chemical compositions such as nutritional composition of grain are detected by analysis of the seed composition and content of protein, free amino acids, oil, free fatty acids, starch or tocopherols. Changes in biomass characteristics are detected in greenhouse or field grown plants and include plant height, stem diameter, root and shoot dry weights; and, for corn plants, ear length and diameter. Changes in physiological properties are identified by evaluating responses to stress conditions, e.g., assays using imposed stress conditions such as water deficit, nitrogen deficiency, cold growing conditions, pathogen or insect attack or light deficiency, or increased plant density. Changes in morphology are measured by visual observation of tendency of a transformed plant with an enhanced agronomic trait to also appear to be a normal plant as compared to changes toward bushy, taller, thicker, narrower leaves, striped leaves, knotted trait, chlorosis, albino, anthocyanin production, or altered tassels, ears or roots. Other screening properties include days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barrenness/prolificacy, green snap, and pest resistance. In addition, phenotypic characteristics of harvested grain are evaluated, including number of kernels per row on the ear, number of rows of kernels on the ear, kernel abortion, kernel weight, kernel size, kernel density and physical grain quality.

Seeds for transgenic crop plants with enhanced agronomic traits of this invention are corn, soybean and cotton seeds, as well as seeds for canola, wheat, sunflower, sorghum, alfalfa, barley, millet, rice, tobacco, fruit and vegetable crops, and turfgrass.

A. Screening for Nitrogen Use Efficiency

Many transgenic crop plants of this invention exhibit enhanced nitrogen use efficiency as compared to control plants. Higher nitrogen soil applications increase seed protein and starch accumulation, and lead to larger seed weight and larger kernel number per ear. Recent improvements in elite high yielding corn hybrid genotypes include the ability to utilize nitrogen efficiently. DNA causing the enhanced nitrogen use efficiency in crop plants are especially useful, e.g., for improving yield. Enhanced nitrogen use efficiency is assessed by measuring changes in plant growth such as leaf area production, shoot biomass, chlorophyll content in plants grown in nitrogen limiting conditions and/or nitrogen sufficient conditions. It is useful to conduct a first screen in nitrogen limiting conditions and confirm replicate transgenic events in both nitrogen limiting and nitrogen sufficient conditions. Table 3 shows an amount of nutrients in the nutrient solution for nitrogen limiting conditions (low N); and Table 4 shows an amount of nutrients in nutrient solution for nitrogen sufficient conditions (high N). These nutrient solutions when adjusted to pH 5.6, e.g. with HCl or KOH, are useful for nitrogen use efficiency screening. For example in a greenhouse screen pots of transgenic plants and control plants are treated with 100 ml of nutrient solution three times a week on alternate days starting at 8 and 10 days after planting for high N and low N screening, respectively.

TABLE 3

| Nutrient stock | 2 mM $NH_4NO_3$ Low nitrogen |
|---|---|
| 1M $NH_4N0_3$ | 2 mL/L |
| 1M $KH_2PO_4$ | 0.5 |
| 1M $MgSO_4$•$7H_2O$ | 2 |

TABLE 3-continued

| Nutrient stock | 2 mM $NH_4NO_3$ Low nitrogen |
|---|---|
| 1M $CaCl_2$ | 2.5 |
| 1M $K_2SO_4$ | 1 |

TABLE 4

| Nutrient stock | 20 mM $NH_4NO_3$ High nitrogen |
|---|---|
| 1M $NH_4NO_3$ | 20 mL/L |
| 1M $KH_2PO_4$ | 0.5 |
| 1M $MgSO_4 \cdot 7H_2O$ | 2 |
| 1M $CaCl_2$ | 2.5 |
| 1M $K_2SO_4$ | 1 |

After 28 days of plant growth for low N screening and 23 days for high N screening, measurements are taken for total shoot fresh mass, leaf chlorophyll, leaf area, leaf fresh mass and leaf dry mass.

B. Screening for Increased Yield

Many transgenic plants of this invention exhibit improved yield as compared to a control plant. Improved yield can result from a variety or other traits such as enhanced seed sink potential, e.g., the number and size of endosperm cells or kernels, and/or enhanced sink strength, e.g., the rate of starch biosynthesis. Sink potential is established very early during kernel development, as endosperm cell number and cell size are determined within the first few days after pollination.

Much of the increase in corn yield of the past several decades has resulted from an increase in planting density. During that period, corn yield has been increasing at a rate of 2.1 bushels/acre/year, but the planting density has increased at a rate of 250 plants/acre/year. A characteristic of modern hybrid corn is the ability of these varieties to be planted at high density. Many studies have shown that a higher than current planting density should result in more biomass production, but current germplasm does not perform well at these higher densities. One approach to increasing yield is to increase harvest index (HI), the proportion of biomass that is allocated to the kernel compared to total biomass, in high density plantings.

Effective yield screening of transgenic corn uses hybrid progeny of the transgenic event over multiple locations with plants grown under optimal production management practices, and maximum pest control. A useful target for improved yield is a 5% to 10% increase in yield as compared to yield produced by plants grown from seed for a control plant. Useful screening in multiple and diverse geographic locations, e.g., up to 16 or more locations, over one or more planting seasons, e.g., at least two planting seasons, is useful to statistically distinguish yield improvement from natural environmental effects. Useful hybrid screening includes planting multiple transgenic plants, positive and negative control plants, and pollinator plants in standard plots, e.g., 2 row plots, 20 feet long by 5 feet wide with 30 inches distance between rows and a 3 foot alley between ranges. Plants from separate transgenic events can be grouped by recombinant DNA constructs with groups randomly placed in the field. A pollinator plot of a high quality corn line is planted for every two plots to allow open pollination when using male sterile transgenic events. A useful planting density is about 30,000 plants/acre.

Surrogate indicators for screening for yield improvement include source capacity (biomass), source output (sucrose and photosynthesis), sink components (kernel size, ear size, starch in the seed), development (light response, height, density tolerance), maturity, early flowering trait and physiological responses to high density planting, e.g., at 45,000 plants per acre.

When screening for yield improvement a useful statistical measurement approach comprises three components, i.e., modeling spatial autocorrelation of the test field separately for each location, adjusting traits of recombinant DNA events for spatial dependence for each location, and conducting an across location analysis.

A first step in modeling spatial autocorrelation is estimating the covariance parameters of the semivariogram. A spherical covariance model is assumed to model the spatial autocorrelation. Because of the size and nature of the trial, it is likely that the spatial autocorrelation may change. Therefore, anisotropy is also assumed along with spherical covariance structure. The following set of equations describes the statistical form of the anisotropic spherical covariance model.

$$C(h;\theta) = \nu I(h=0) + \sigma^2\left(1 - \frac{3}{2}h + \frac{1}{2}h^3\right)I(h<1),$$

where I(•) is the indicator function, $h=\sqrt{\dot{x}^2+\dot{y}^2}$, and $$\dot{x}=[\cos(\rho\pi/180)(x_1-x_2)-\sin(\rho\pi/180)(y_1-y_2)]/\omega_x$$

$$\dot{y}=[\sin(\rho\pi/180)(x_1-x_2)+\cos(\rho\pi/180)(y_1-y_2)]/\omega_y$$

where $s_1=(x_1, y_1)$ are the spatial coordinates of one location and $s_2=(x_2, y_2)$ are the spatial coordinates of the second location. There are 5 covariance parameters, $\theta=(\nu, \sigma^2, \rho, \omega_n, \omega_j)$ where $\nu$ is the nugget effect, $\sigma^2$ is the partial sill, $\rho$ is a rotation in degrees clockwise from north, $\omega_n$ is a scaling parameter for the minor axis and $\omega_j$ is a scaling parameter for the major axis of an anisotropical ellipse of equal covariance. The five covariance parameters that define the spatial trend will then be estimated by using data from heavily replicated pollinator plots via restricted maximum likelihood approach. In a multi-location field trial, spatial trend are modeled separately for each location.

After obtaining the variance parameters of the model, a variance-covariance structure is generated for the data set to be analyzed. This variance-covariance structure contains spatial information required to adjust yield data for spatial dependence. In this case, a nested model that best represents the treatment and experimental design of the study is used along with the variance-covariance structure to adjust the yield data. During this process the nursery or the seed batch effects can also be modeled and estimated to adjust the yields for any yield parity caused by seed batch differences.

After spatially adjusted data from different locations are generated, all adjusted data is combined and analyzed assuming locations as replications. In this analysis, intra and inter-location variances are combined to estimate the standard error of yield from transgenic plants and control plants. Relative mean comparisons are used to indicate statistically significant yield improvements.

C. Screening for Water Use Efficiency

Many transgenic crop plants of this invention exhibit improved yield resulting from improved water use efficiency and/or drought tolerance.

A greenhouse screen for transgenic corn plants for water use efficiency measures changes in plant growth rate, e.g., at least a 10% improvement, in height and biomass during a vegetative drought treatment, as compared to control plants.

The hydration status of the shoot tissues following the drought is also measured. Shoot Initial Height (SIH) is plant height after 3 weeks of growth under optimum conditions. Shoot Wilt Height (SWH) is plant height at the end of a 6 day drought. Time course experiments have shown that at about 3 days of drought, wild type plants basically stop growing and begin to wilt. Thus a transgenic plant with improved water use efficiency will continue to grow (probably to a lesser extent than with water) and thereby end up as a significantly taller plant at the end of a drought experiment. Shoot Wilt Mass (SWM) is the amount of wet and dry matter in the shoot (plant separated from root ball at the soil line) at the end of the drought; SDM is measure after 2 to 3 weeks in a drying chamber. Shoot Turgid mass (STM) is the SWM plus the mass of the water that is transported into plant tissues in 3 days of soaking in 40 degree C. water in the dark. Experiments show that most of the water is pulled up in 24 hours but it takes 2 more days before additional increase becomes insignificant. STM-SWM is indicative of water use efficiency in plants where recovery from stress is more important than stress tolerance per se. Relative water content (RWC) is a measurement of how much (%) of the plant is water at harvest. RWC=(SWM−SDM)/(STM−SDM)*100. Fully watered corn plants are about 98% RWC. Typically, in a wilt screen the plants are about 60% RWC. Plants with higher RWC at the end of a drought are considered to be healthier plants and more fit for post-drought recovery and growth.

Relative Growth Rate (RGR) is calculated for each shoot using the formula RGR=(SWH−SIH)/((SWH+SIH)/2)*100

D. Screening for Growth Under Cold Stress

Many transgenic crop plants of this invention exhibit improved growth under cold stress, e.g., in a cold germination assay, in a cold shock assay, in an early seedling growth assay and in root-shoot biomass assay.

In a cold germination assay transgenic seeds from transgenic plants, e.g., R2 inbred seeds or F1 hybrid seeds, seeds of two types of control plants, e.g., negative segregants from the transgenic event or wild type, non-transgenic seeds of the transformed genotype, are treated with fungicide. A useful fungicide such as Captan fungicide (available from Arvesta Corp as MAESTRO® 80DF Fungicide) is applied at the rate of 0.43 mL Captan per 45 g of corn seeds which are dried to provide fungicide-coated seeds.

In a useful cold screen for transgenic corn seeds ten seeds per transgenic event are placed on filter paper (e.g., Whatman No. 1) in the lid of a Petri dish with 5 ml of water. A closed Petri dish is placed in a growth chamber set at 11 degrees C. for inbred corn seed or 9.5 degrees C. for hybrid corn seed. 2 ml of water is added on day 3 and day 10. Seeds are considered germinated if the emerged radicle size is 1 cm. Cold seeds are scored every 2 days from day 10 up to day 30. Tissue samples are collected at random on the last day of the experiment for confirmation of RNA expression. A germination index (GI) is calculated as $$GI=(\Sigma([T+1-n_i]*[P_i-P_{i-1}]))/T$$

where “T” is the number of days for the experiment, “n” is the number of days after start, “i” is number of times germination is counted including the current day, “P” is the percentage of seed germinated during any given rating. Statistical differences are calculated between positive and wild type control.

In a cold shock assay, seeds are planted in potting media and placed in a growth chamber set at 23 degrees C., relative humidity of 65% with 12 hour day and night photoperiod (300 uE/m2-min). Planted seeds are watered for 20 minute every other day by sub-irrigation and flats are rotated every third day. On day 10 after planting the transgenic positive and wild type control plants are positioned in flats in an alternating pattern. Chlorophyll fluorescence of plants is measured on the tenth day during the dark period of growth by using a Walz PAM-2000 portable fluorometer following manufacturer's instructions. After chlorophyll measurements, leaf samples from each event are collected for confirming the expression of recombinant DNA. The plants are then exposed to temperatures of 5 degrees C. for 4 days. On the fourth day chlorophyll fluorescence is measured and plants are restored to a 23 degrees C. environment for recovery over 3 days. During the recovery period the length of the V3 leaf is measured on the first and third days. After two days of recovery V2 leaf damage is determined visually by estimating percent of green V2 leaf. Statistical differences in V3 leaf growth, V2 leaf necrosis and fluorescence during pre-shock and cold shock can be used for estimation of cold shock damage on corn plants.

In an early seedling growth assay three sets of seeds are assayed. The first set is a group of transgenic seeds from transgenic plants; the second set is negative segregants of the transgenic seed; and the third seed set is seed from two cold tolerant and two cold sensitive wild-type controls. All seeds are treated with a fungicide as indicated above. Seeds are grown in germination paper (12 inch×18 inch pieces of Anchor Paper #SD7606), wetted in a solution of 0.5% $KNO_3$ and 0.1% Thyram. For each paper fifteen seeds are placed on the line evenly spaced such that the radicles will grow toward the same edge. The wet paper is rolled up evenly and tight enough to hold the seeds in place. The roll is secured into place with two large paper clips, one at the top and one at the bottom. The rolls are incubated in a growth chamber at 23 degrees C. for three days in a randomized complete block design within an appropriate container. The chamber is set for 65% humidity with no light cycle. For the cold stress treatment the rolls are then incubated in a growth chamber at 12 degrees C. for fourteen days. The chamber is set for 65% humidity with no light cycle. For the warm treatment the rolls are incubated at 23 degrees C. for an additional two days. After the treatment the germination papers are unrolled and the seeds that did not germinate are discarded. The lengths of the radicle and coleoptile for each seed are measured. A coleoptile sample is collected from six individual kernels of each entry for confirming the expression of recombinant DNA. Statistical differences in the length of radicle and shoot during pre-shock and cold shock are used for an estimation of the effect of the cold treatment on corn plants. The analysis is conducted independently for the warm and cold treatments.

In a root-shoot biomass assay two sets of seeds are used. The first set is transgenic seeds with recombinant DNA, e.g., R2 inbred seeds or F1 hybrid seeds; the second seed set is non-transgenic, wild type negative control made from the same genotypes as the transgenic seeds. All seeds are treated with a fungicide as indicated above. The seeds are planted in potting media in pots arranged in a randomized complete block design with 6 replications. Pots are watered as and when needed by filling water up to the brim of the pot. Plants are grown in a greenhouse to a V6 stage or approximately for 28 days. Greenhouse lights are turned on after emergence of seedlings with 14 hours of light 10 hours of dark. Plants are fertilized twice each week with water-soluble fertilizer containing 200-ppm nitrogen. For measurement of root and shoot dry weight, two pots are separated carefully to remove adhering sand by washing with water. Washed roots are cut at the first node. The roots are placed in a paper bag after squeezing excess water, folded once and stapled. The shoots are then folded up to a convenient size (approximately 15 cm), placed in a paper bag. Bags are placed over a wire shelve to facilitate drying in a ventilated room maintained at 120 degrees F. to a moisture content of about 13% then weighed to determine dried root and shoot biomass.

E. Screen for Enhanced Oil, Starch, or Protein Levels in Plant Seeds

Oil concentrations are determined in kernels by Near Infrared Transmittance (NIT) from inbred and from hybrid lines. Data are also obtained for protein and starch content from this measurement.

Inbred Kernel Oil Screen

The primary transformants are selfed to produce R1 seed which is planted to segregating seed. An untransformed control line is planted every sixth row. All plants are self-pollinated. A molecular assay is conducted to determine zygosity of the transgene in each plant. Ears are harvested at maturity, and well-filled ears are chosen for proximate analysis. Proximate analysis is conducted on up to 5 homozygous ears. If 5 good homozygous ears are not available, then hemizygous ears will be used to obtain 5 good transgene-positive ears. Statistical analysis is conducted to determine whether proximate values for transgenic events are different from controls. Events with an increase in oil with a p-value of less than or equal to 0.1 are termed "putative leads." Kernel composition is confirmed in an inbred confirmation nursery which is conducted with selected events, and is run with a design similar to that of the Gen2 nursery. A "confirmed lead event" demonstrates an increase in oil with a p-value of less than or equal to 0.1 in two nurseries.

Hybrid Kernel Oil Screen

Grain samples from the multilocation hybrid yield trials are collected at the time of harvest and are analyzed by NIT. Controls are negative segregants, untransformed controls, or pollinators. Data from 3 to 12 locations are pooled for the statistical analysis. Putative leads have increased oil with a p-value of less than or equal to 0.1.

The various aspects of the invention are illustrated by means of the following examples which are in no way intended to limit the full breath and scope of claims.

Example 1

Identification of Recombinant DNA that Confers Improved Trait(s) to Plants

A. Expression Constructs for *Arabidopsis* Plant Transformation

Each gene of interest was amplified from a genomic or cDNA library using primers specific to sequences upstream and downstream of the coding region. Transformation vectors were prepared to constitutively transcribe DNA in either sense orientation (for enhanced protein expression) or anti-sense orientation (for endogenous gene suppression) under the control of an enhanced Cauliflower Mosaic Virus 35S promoter (U.S. Pat. No. 5,359,142) directly or indirectly (Moore, et al., PNAS 95:376-381, 1998; Guyer, et al., Genetics 149: 633-639, 1998; International patent application NO. PCT/EP98/07577). The transformation vectors also contain a bar gene as a selectable marker for resistance to glufosinate herbicide. The transformation of *Arabidopsis* plants was carried out using the vacuum infiltration method known in the art (Bethtold, et al., Methods Mol. Biol. 82:259-66, 1998). Seeds harvested from the plants, named as T1 seeds, were subsequently grown in a glufosinate-containing selective medium to select for plants which were actually transformed and which produced T2 transgenic seed.

B. Soil Drought Tolerance Screen

This example describes a soil drought tolerance screen to identify *Arabidopsis* plants transformed with recombinant DNA that wilt less rapidly and/or produce higher seed yield when grown in soil under drought conditions T2 seeds were sown in flats filled with Metro/Mix® 200 (The Scotts® Company, USA). Humidity domes were added to each flat and flats were assigned locations and placed in climate-controlled growth chambers. Plants were grown under a temperature regime of 22° C. at day and 20° C. at night, with a photoperiod of 16 hours and average light intensity of 170 μmol/m$^2$/s. After the first true leaves appeared, humidity domes were removed. The plants were sprayed with glufosinate herbicide and put back in the growth chamber for 3 additional days. Flats were watered for 1 hour the week following the herbicide treatment. Watering was continued every seven days until the flower bud primordia became apparent, at which time plants were watered for the last time.

To identify drought tolerant plants, plants were evaluated for wilting response and seed yield. Beginning ten days after the last watering, plants were examined daily until 4 plants/line had wilted. In the next six days, plants were monitored for wilting response. Five drought scores were assigned according to the visual inspection of the phenotypes: 1 for healthy, 2 for dark green, 3 for wilting, 4 severe wilting, and 5 for dead. A score of 3 or higher was considered as wilted.

At the end of this assay, seed yield measured as seed weight per plant under the drought condition was characterized for the transgenic plants and their controls and analyzed as a quantitative response according to example 1M.

Two approaches were used for statistical analysis on the wilting response. First, the risk score was analyzed for wilting phenotype and treated as a qualitative response according to the example 1L. Alternatively, the survival analysis was carried out in which the proportions of wilted and non-wilted transgenic and control plants were compared over each of the six days under scoring and an overall log rank test was performed to compare the two survival curves using S-PLUS statistical software (S-PLUS 6, Guide to statistics, Insightful, Seattle, Wash., USA). Table 5 provides a list of recombinant DNA constructs that improve drought tolerance in transgenic plants.

TABLE 5

| | | | | Wilt Response Risk score | | | Seed Weight/plant | | | Survival Anaysis of wilt response | | |
|---|---|---|---|---|---|---|---|---|---|---|---|---|
| Pep SEQ ID | Construct_id | Gene | Orientation | RS mean | p-value | c | delta | p-value | c | diff time to wilting | p-value | c |
| 319 | 10139 | CGPG101 | ANTI-SENSE | 0.115 | 0.024 | S | −0.123 | 0.804 | / | −0.01 | 0.469 | / |
| 320 | 11410 | CGPG103 | SENSE | 0.226 | 0.003 | S | −0.366 | 0.926 | / | 0 | 1 | / |
| 321 | 11604 | CGPG48 | ANTI-SENSE | 0.25 | 0.034 | S | 0.257 | 0.01 | S | −0.24 | 0.38 | / |

TABLE 5-continued

| Pep | | | | Wilt Response Risk score | | | Seed Weight/plant | | | Survival Anaysis of wilt response | | |
|---|---|---|---|---|---|---|---|---|---|---|---|---|
| SEQ ID | Construct_id | Gene | Orientation | RS mean | p-value | c | delta | p-value | c | diff time to wilting | p-value | c |
| 322 | 12368 | CGPG1006 | SENSE | 0.148 | 0.044 | S | 0.359 | 0.02 | S | −0.06 | 0.764 | / |
| 323 | 13502 | CGPG1354 | SENSE | 0.431 | 0 | S | 0.624 | 0 | S | 1.34 | 0.366 | / |
| 324 | 13745 | CGPG1576 | ANTI-SENSE | −0.021 | 0.711 | / | 0.664 | 0 | S | −0.29 | 0.453 | / |
| 325 | 13821 | CGPG1569 | SENSE | 0.135 | 0.025 | S | 0.128 | 0.402 | / | 0.24 | 0.972 | / |
| 326 | 14240 | CGPG1697 | SENSE | 0.377 | 0.002 | S | −1.305 | 0.991 | / | 0 | 1 | / |
| 327 | 14718 | CGPG1082 | SENSE | 0.168 | 0.001 | S | 0.135 | 0.351 | / | 0.25 | 0.208 | / |
| 328 | 17022 | CGPG1774 | SENSE | 0.06 | 0.124 | T | 0.563 | 0.043 | S | 0 | 0.961 | / |
| 329 | 17924 | CGPG2882 | SENSE | −0.093 | 0.914 | / | 0.288 | 0.021 | S | 0.09 | 0.935 | / |
| 330 | 18259 | CGPG3368 | SENSE | 0.07 | 0.28 | / | 0.391 | 0.058 | T | −0.27 | 0.591 | / |
| 331 | 19171 | CGPG2952 | SENSE | 0.227 | 0.005 | S | 0.846 | 0.001 | S | 0.12 | 0.543 | / |
| 332 | 19201 | CGPG2332 | SENSE | 0.124 | 0.027 | S | −0.435 | 0.785 | / | 0.35 | 0.256 | / |
| 333 | 19317 | CGPG3662 | SENSE | 0.338 | 0 | S | −0.071 | 0.61 | / | 0.63 | 0.106 | T |
| 334 | 70417 | CGPG3427 | SENSE | 0.253 | 0.016 | S | −1.424 | 0.984 | / | 0 | 1 | / |
| 315 | 70427 | CGPG3067 | SENSE | −0.033 | 0.818 | / | 1.004 | 0.002 | S | 0.01 | 0.977 | / |
| 335 | 70467 | CGPG3785 | SENSE | 0.127 | 0.023 | S | −0.448 | 0.946 | / | 0.71 | 0.046 | S |
| 336 | 70806 | CGPG712 | SENSE | 0.246 | 0.046 | S | 0.174 | 0.276 | / | 0.14 | 0.07 | T |
| 337 | 70818 | CGPG479 | SENSE | 0.07 | 0.115 | T | 0.558 | 0.009 | S | 0.61 | 0.283 | / |
| 338 | 70820 | CGPG655 | SENSE | 0.172 | 0.048 | S | 0.036 | 0.441 | / | 0.26 | 0.554 | / |
| 339 | 70919 | CGPG4029 | SENSE | 0.167 | 0.009 | S | −0.565 | 0.904 | / | 0.31 | 0.508 | / |
| 340 | 71623 | CGPG4696 | SENSE | 0.158 | 0.047 | S | 0.421 | 0.04 | S | 0 | 1 | / |
| 390 | 71633 | CGPG857 | SENSE | 0.121 | 0.017 | S | −0.823 | 0.967 | / | 0.45 | 0.139 | T |
| 341 | 71662 | CGPG4679 | SENSE | 0.063 | 0.013 | S | −0.037 | 0.631 | / | 0.16 | 0.957 | / |
| 342 | 71693 | CGPG4652 | SENSE | 0.074 | 0.042 | S | 0.246 | 0.06 | T | 0.34 | 0.616 | / |
| 316 | 71811 | CGPG4426 | SENSE | 0.359 | 0.015 | S | −0.729 | 0.903 | / | 0.15 | 0.822 | / |
| 318 | 72081 | CGPG5279 | SENSE | 0.269 | 0.005 | S | −0.372 | 0.987 | / | 0.17 | 0.404 | / |
| 343 | 72384 | CGPG4639 | SENSE | 0.133 | 0.018 | S | 0.62 | 0.002 | S | 0.17 | 0.359 | / |
| 344 | 72439 | CGPG5075 | SENSE | 0.175 | 0.013 | S | −0.035 | 0.604 | / | 0.23 | 0.244 | / |
| 374 | 72456 | CGPG4745 | SENSE | 0.53 | 0.01 | S | −0.737 | 0.979 | / | −0.08 | 0.823 | / |
| 345 | 72619 | CGPG4835 | SENSE | 0.178 | 0.039 | S | 0.219 | 0.072 | T | 0.96 | 0.691 | / |
| 346 | 72624 | CGPG4842 | SENSE | 0.163 | 0.021 | S | 0.356 | 0.051 | T | 0.3 | 0.375 | / |
| 347 | 72715 | CGPG5521 | SENSE | 0.082 | 0.1 | T | 0.767 | 0.002 | S | 0.12 | 0.628 | / |
| 348 | 72754 | CGPG5548 | SENSE | 0.131 | 0.031 | S | −0.365 | 0.974 | / | 0 | 0.923 | / |
| 349 | 72819 | CGPG4989 | SENSE | 0.094 | 0.026 | S | 0.362 | 0.069 | T | 0.03 | 0.83 | / |
| 350 | 75516 | CGPG7689 | SENSE | 0.067 | 0.066 | T | 0.965 | 0.001 | S | 0.24 | 0.464 | / |
| 351 | 75701 | CGPG7856 | SENSE | 0.147 | 0.006 | S | 0.986 | 0.015 | S | 0.15 | 0.448 | / |
| 317 | 73463 | CGPG6384 | SENSE | 0.174 | 0.048 | S | −1.359 | 0.959 | / | 0.09 | 0.984 | / |
| 454 | 70354 | CGPG3995 | SENSE | −0.005 | 0.563 | / | 0.444 | 0.002 | S | 10.29 | 0.9 | / |
| 397 | 71840 | CGPG4353 | SENSE | 0.142 | 0.007 | S | −0.212 | 0.859 | / | 9.29 | 0.99 | / |
| 506 | 72902 | CGPG5597 | SENSE | 0.009 | 0.162 | T | 0.034 | 0.2 | T | 5 | 1 | / |
| 437 | 73549 | CGPG6460 | SENSE | 0.119 | 0.037 | S | −0.774 | 0.949 | / | 6.26 | 0.25 | / |
| 302 | 73586 | CGPG6471 | SENSE | 0.003 | 0.451 | / | 0.588 | 0.002 | S | 6.34 | 0.723 | / |
| 442 | 74587 | CGPG6774 | SENSE | 0.262 | 0.001 | S | −0.117 | 0.574 | / | 7.49 | 0.041 | S |
| 388 | 74652 | CGPG6168 | SENSE | 0.475 | 0 | S | −0.766 | 0.92 | / | 7.48 | 0 | S |

S: represents that the transgenic plants showed statistically significant trait improvement as compared to the reference ($p < 0.05$, p value, of the delta of a quantitative response or of the risk score of a qualitative response, is the probability that the observed difference between the transgenic plants and the reference occur by chance)

T: represents that the transgenic plants showed a trend of trait improvement as compared to the reference with $p < 0.2$ /: represents the transgenic plants didn't show any alteration or had unfavorable change in traits examined as compared to the reference in the current dataset.

C. Stress Tolerance Screen

Under high temperatures, *Arabidopsis* seedlings become chlorotic and root growth is inhibited. This example sets forth the heat stress tolerance screen to identify *Arabidopsis* plants transformed with the gene of interest that are more resistant to heat stress based on primarily their seedling weight and root growth under high temperature.

T2 seeds were plated on ½×MS salts, 1% phytagel, with 10 μg/ml BASTA (7 per plate with 2 control seeds; 9 seeds total per plate). Plates were placed at 4° C. for 3 days to stratify seeds. Plates were then incubated at room temperature for 3 hours and then held vertically for 11 additional days at temperature of 34° C. at day and 20° C. at night. Photoperiod was 16 h. Average light intensity was ~140 μmol/$m^2$/s. After 14 days of growth, plants were scored for glufosinate resistance, root length, final growth stage, visual color, and seedling fresh weight. A photograph of the whole plate was taken on day 14.

The seedling weight and root length were analyzed as quantitative responses according to example 1M. The final grow stage at day 14 was scored as success if 50% of the plants had reached 3 rosette leaves and size of leaves are greater than 1 mm (Boyes, et al., (2001) The Plant Cell 13, 1499-1510). The growth stage data was analyzed as a qualitative response according to example 1L. Table 6 provides a list of recombinant DNA constructs that improve heat tolerance in transgenic plants.

TABLE 6

| Pep SEQ ID | Construct_id | Gene | Orientation | Growth stage RS mean | p-value | c | Root Length delta | p-value | c | Seedling Weight delta | p-value | c |
|---|---|---|---|---|---|---|---|---|---|---|---|---|
| 354 | 19542 | CGPG3069 | SENSE | 0.842 | 0.021 | S | 0.296 | 0.023 | S | 1.616 | 0 | S |
| 355 | 19618 | CGPG3574 | SENSE | 1.072 | 0.005 | S | 0.328 | 0.006 | S | 1.569 | 0 | S |
| 356 | 19649 | CGPG3140 | SENSE | 0.72 | 0.042 | S | 0.243 | 0.054 | T | 1.665 | 0 | S |
| 357 | 19745 | CGPG3973 | SENSE | 0.65 | 0.016 | S | 0.19 | 0.021 | S | 1.505 | 0 | S |
| 358 | 19768 | CGPG4096 | SENSE | 1.06 | 0.035 | S | 0.17 | 0.034 | S | 1.171 | 0 | S |
| 436 | 19771 | CGPG4011 | SENSE | 0.822 | 0.023 | S | 0.201 | 0.001 | S | 1.43 | 0 | S |
| 359 | 19772 | CGPG3939 | SENSE | 0.247 | 0.014 | S | 0.151 | 0.014 | S | 1.344 | 0 | S |
| 360 | 19779 | CGPG4113 | SENSE | 0.605 | 0.051 | T | 0.181 | 0.003 | S | 1.436 | 0 | S |
| 361 | 19833 | CGPG4074 | SENSE | 0.965 | 0.026 | S | 0.266 | 0.007 | S | 1.01 | 0 | S |
| 362 | 19862 | CGPG3961 | SENSE | 0.341 | 0.119 | T | 0.132 | 0.007 | S | 1.22 | 0 | S |
| 363 | 19879 | CGPG4009 | SENSE | 0.734 | 0.002 | S | 0.22 | 0.001 | S | 1.499 | 0 | S |
| 364 | 70445 | CGPG3728 | SENSE | 0.413 | 0.062 | T | 0.148 | 0.114 | T | 1.249 | 0 | S |
| 365 | 70738 | CGPG3195 | SENSE | 0.687 | 0.055 | T | 0.205 | 0.041 | S | 1.261 | 0 | S |
| 366 | 71437 | CGPG4043 | SENSE | 0.094 | 0.198 | T | 0.092 | 0.064 | T | 1.301 | 0 | S |
| 367 | 71572 | CGPG4520 | SENSE | 0.938 | 0.052 | T | 0.441 | 0 | S | 1.633 | 0 | S |
| 368 | 71617 | CGPG1227 | SENSE | 0.809 | 0.012 | S | 0.143 | 0.029 | S | 1.05 | 0.003 | S |
| 408 | 72085 | CGPG5228 | SENSE | 1.234 | 0.02 | S | 0.192 | 0.043 | S | 1.162 | 0 | S |
| 369 | 72532 | CGPG4780 | SENSE | 1.028 | 0.022 | S | 0.198 | 0.052 | T | 1.043 | 0.001 | S |
| 409 | 72744 | CGPG5563 | SENSE | 0.17 | 0.146 | T | 0.04 | 0.359 | / | 0.827 | 0.004 | S |
| 370 | 72757 | CGPG5572 | SENSE | 1.82 | 0.004 | S | 0.14 | 0.091 | T | 1.121 | 0 | S |
| 407 | 72771 | CGPG2166 | SENSE | 1.776 | 0.001 | S | 0.36 | 0 | S | 1.428 | 0 | S |
| 444 | 72967 | CGPG5742 | SENSE | 0.273 | 0.063 | T | 0.147 | 0.102 | T | 1.03 | 0 | S |
| 410 | 73039 | CGPG810 | SENSE | −0.048 | 0.774 | / | −0.135 | 0.957 | / | 0.59 | 0.022 | S |
| 411 | 73054 | CGPG5754 | SENSE | 0.055 | 0.312 | / | 0.236 | 0.001 | S | 1.434 | 0 | S |
| 508 | 73055 | CGPG5768 | SENSE | 0.154 | 0.123 | T | 0.269 | 0 | S | 1.524 | 0 | S |
| 371 | 73412 | CGPG6448 | SENSE | 0.187 | 0.118 | T | 0.134 | 0.06 | T | 1.181 | 0 | S |
| 412 | 73501 | CGPG6456 | SENSE | 1.6 | 0.003 | S | 0.081 | 0.136 | T | 1.119 | 0 | S |
| 352 | 73515 | CGPG6473 | SENSE | −0.037 | 0.758 | / | −0.024 | 0.604 | / | 0.694 | 0.008 | S |
| 437 | 73549 | CGPG6460 | SENSE | 2.612 | 0 | S | 0.199 | 0.017 | S | 1.432 | 0 | S |
| 372 | 74102 | CGPG6550 | SENSE | 0.34 | 0.035 | S | 0.268 | 0.002 | S | 1.355 | 0 | S |
| 509 | 74103 | CGPG6558 | SENSE | −0.013 | 1 | / | −0.021 | 0.608 | / | 0.86 | 0 | S |
| 353 | 74684 | CGPG6360 | SENSE | 0.44 | 0.018 | S | 0.254 | 0.002 | S | 1.383 | 0 | S |
| 512 | 19703 | CGPG4172 | SENSE | 0.211 | 0.079 | T | 0.059 | 0.301 | / | 1.262 | 0 | S |
| 273 | 70423 | CGPG3165 | SENSE | 1.456 | 0 | S | 0.418 | 0 | S | 1.912 | 0 | S |
| 491 | 70469 | CGPG3791 | SENSE | 0.143 | 0.28 | / | 0.028 | 0.349 | / | 1.001 | 0.001 | S |
| 434 | 70932 | CGPG4089 | SENSE | 0.354 | 0.1 | T | 0.03 | 0.419 | / | 1.254 | 0 | S |
| 419 | 71134 | CGPG817 | SENSE | 0.522 | 0.106 | T | 0.077 | 0.248 | / | 1.225 | 0 | S |
| 466 | 71726 | CGPG3894 | SENSE | 0.196 | 0.225 | / | 0.082 | 0.2 | T | 1.243 | 0 | S |
| 505 | 72463 | CGPG4760 | SENSE | 1.182 | 0.003 | S | 0.202 | 0.026 | / | 1.702 | 0 | S |
| 445 | 72961 | CGPG5591 | SENSE | 1.195 | 0.013 | S | 0.106 | 0.105 | T | 1.084 | 0 | S |
| 306 | 74136 | CGPG6632 | SENSE | 0.886 | 0.012 | S | 0.306 | 0.009 | S | 1.42 | 0 | S |
| 504 | 74259 | CGPG5343 | SENSE | 1.044 | 0.023 | S | 0.081 | 0.187 | T | 1.274 | 0 | S |
| 310 | 74318 | CGPG5826 | SENSE | 0.407 | 0.075 | T | 0.116 | 0.052 | T | 1.118 | 0 | S |
| 479 | 74344 | CGPG5929 | SENSE | 1.256 | 0.018 | S | 0.118 | 0.125 | T | 1.275 | 0 | S |
| 533 | 74462 | CGPG6668 | SENSE | 0.846 | 0.022 | S | 0.26 | 0.011 | S | 1.425 | 0 | S |
| 313 | 74512 | CGPG32 | SENSE | 0.241 | 0.118 | T | 0.146 | 0.044 | S | 1.062 | 0 | S |
| 442 | 74587 | CGPG6774 | SENSE | 0 | / | / | 0.084 | 0.054 | T | 1.046 | 0 | S |

S: represents the transgenic plants showed statistically significant trait improvement as compared to the reference ($p < 0.05$)

T: represents the transgenic plants showed a trend of trait improvement as compared to the reference with $p < 0.2$ /: represents data points not determined or the transgenic plants didn't show any alteration or had unfavorable change in traits examined as compared to the reference in the current dataset D. Salt Stress Tolerance Screen This example sets forth the high salinity stress screen to identify *Arabidopsis* plants transformed with the gene of interest that are tolerant to high levels of salt based on their rate of development, root growth and chlorophyll accumulation under high salt conditions.

T2 seeds were plated on glufosinate selection plates containing 90 mM NaCl and grown under standard light and temperature conditions. All seedlings used in the experiment were grown at a temperature of 22° C. at day and 20° C. at night, a 16-hour photoperiod, an average light intensity of approximately 120 umol/$m^2$. On day 11, plants were measured for primary root length. After 3 more days of growth (day 14), plants were scored for transgenic status, primary root length, growth stage, visual color, and the seedlings were pooled for fresh weight measurement. A photograph of the whole plate was also taken on day 14.

The seedling weight and root length were analyzed as quantitative responses according to example 1M. The final growth stage at day 14 was scored as success if 50% of the plants reached 3 rosette leaves and size of leaves are greater than 1 mm (Boyes, D. C., et al., (2001), The Plant Cell 13, 1499/1510). The growth stage data was analyzed as a qualitative response according to example 1L. Table 7 provides a list of recombinant DNA constructs that improve high salinity tolerance in transgenic plants

TABLE 7

| Pep | | | | Growth Stage | | | Root Length at day 11 | | | Root Length at day 14 | | | Seedling Weight at day 14 | | |
|---|---|---|---|---|---|---|---|---|---|---|---|---|---|---|---|
| SEQ ID | Construct id | Gene | Orientation | RS mean | p-value | c | delta | p-value | c | delta | p-value | c | delta | p-value | c |
| 512 | 19703 | CGPG4172 | SENSE | 1.124 | 0.139 | T | 0.198 | 0.021 | S | 0.072 | 0.116 | T | 0.582 | 0.023 | S |
| 513 | 19946 | CGPG4097 | SENSE | 1.201 | 0.072 | T | 0.02 | 0.89 | / | 0.069 | 0.573 | / | 0.443 | 0.266 | / |
| 514 | 19980 | CGPG3914 | SENSE | 0.904 | 0.146 | T | 0.101 | 0.259 | / | 0.144 | 0.058 | T | 0.706 | 0.016 | S |
| 515 | 70435 | CGPG3701 | SENSE | 1.363 | 0.031 | S | −0.118 | 0.228 | / | 0.161 | 0.038 | S | 0.053 | 0.697 | / |
| 516 | 71114 | CGPG1657 | SENSE | 0.138 | 0.399 | / | 0.245 | 0.009 | S | 0.187 | 0.025 | S | 0.472 | 0.069 | T |
| 517 | 72451 | CGPG4733 | SENSE | 2.226 | 0.02 | S | 0.186 | 0.006 | S | 0.069 | 0.23 | / | 0.466 | 0.011 | S |
| 443 | 72453 | CGPG4735 | SENSE | 1.539 | 0.031 | S | 0.232 | 0.002 | S | 0.216 | 0 | S | 0.737 | 0.001 | S |
| 505 | 72463 | CGPG4760 | SENSE | 3.026 | 0.002 | S | 0.119 | 0.269 | / | 0.202 | 0.073 | T | 1.26 | 0 | S |
| 392 | 72519 | CGPG4749 | SENSE | 0.598 | 0.041 | S | 0.126 | 0.055 | T | 0.172 | 0.003 | S | 0.635 | 0.008 | S |
| 506 | 72902 | CGPG5597 | SENSE | 1.418 | 0.039 | S | 0.114 | 0.286 | / | 0.226 | 0.078 | T | 0.426 | 0.091 | T |
| 448 | 72916 | CGPG1814 | SENSE | 0.682 | 0.181 | T | 0.07 | 0.532 | / | 0.201 | 0.046 | S | 0.387 | 0.079 | T |
| 510 | 72921 | CGPG5781 | SENSE | 1.977 | 0.029 | S | 0.163 | 0.176 | T | 0.211 | 0.073 | T | 0.663 | 0.006 | S |
| 518 | 72947 | CGPG5607 | SENSE | 1.505 | 0.028 | S | 0.024 | 0.899 | / | 0.204 | 0.022 | S | 0.466 | 0.216 | / |
| 445 | 72961 | CGPG5591 | SENSE | 1.879 | 0.007 | S | 0.228 | 0.122 | T | 0.229 | 0.003 | S | 0.817 | 0.04 | S |
| 444 | 72967 | CGPG5742 | SENSE | 2.427 | 0.004 | S | 0.386 | 0.009 | S | 0.369 | 0.001 | S | 1.254 | 0 | S |
| 511 | 72968 | CGPG5772 | SENSE | 1.531 | 0.055 | T | 0.302 | 0.06 | T | 0.209 | 0.073 | T | 0.761 | 0.003 | S |
| 449 | 72969 | CGPG5789 | SENSE | 0.67 | 0.078 | T | 0.029 | 0.789 | / | 0.239 | 0.008 | S | 0.603 | 0.013 | S |
| 519 | 73012 | CGPG5786 | SENSE | 2.371 | 0.001 | S | 0.366 | 0 | S | 0.342 | 0 | S | 1.08 | 0 | S |
| 520 | 73022 | CGPG5622 | SENSE | 1.408 | 0.036 | S | 0.22 | 0.056 | T | 0.347 | 0 | S | 0.492 | 0.03 | S |
| 508 | 73055 | CGPG5768 | SENSE | 3.291 | 0.001 | S | 0.369 | 0.087 | T | 0.417 | 0.005 | S | 1.096 | 0.005 | S |
| 446 | 73070 | CGPG5627 | SENSE | 2.755 | 0.005 | S | 0.188 | 0.392 | / | 0.275 | 0.011 | S | 0.685 | 0.025 | S |
| 447 | 73475 | CGPG6385 | SENSE | 1.11 | 0.059 | T | 0.127 | 0.361 | / | 0.216 | 0.001 | S | 0.474 | 0.06 | T |
| 521 | 73488 | CGPG6394 | SENSE | 2.373 | 0.013 | S | 0.314 | 0.006 | S | 0.262 | 0.002 | S | 1.126 | 0.005 | S |
| 522 | 73901 | CGPG5237 | SENSE | 1.141 | 0.078 | T | 0.207 | 0.197 | T | 0.202 | 0.097 | T | 0.639 | 0.03 | S |
| 523 | 73964 | CGPG5804 | SENSE | 1.235 | 0.043 | S | 0.428 | 0.008 | S | 0.317 | 0.022 | S | 0.955 | 0.002 | S |
| 524 | 74019 | CGPG5706 | SENSE | 0.105 | 0.168 | T | 0.074 | 0.649 | / | 0.171 | 0.106 | T | 0.773 | 0.011 | S |
| 525 | 74022 | CGPG5724 | SENSE | 0.033 | 0.327 | / | −0.065 | 0.616 | / | 0.172 | 0.032 | S | 0.484 | 0.068 | T |
| 509 | 74103 | CGPG6558 | SENSE | 1.225 | 0.074 | T | 0.26 | 0.042 | S | 0.267 | 0.004 | S | 0.543 | 0.042 | S |
| 526 | 74114 | CGPG6551 | SENSE | 3.627 | 0 | S | 0.265 | 0.119 | T | 0.26 | 0 | S | 0.561 | 0.063 | T |
| 504 | 74259 | CGPG5343 | SENSE | 2.802 | 0.003 | S | 0.249 | 0.098 | T | 0.256 | 0.037 | S | 0.995 | 0 | S |
| 527 | 74262 | CGPG5353 | SENSE | 0.225 | 0.319 | / | 0.238 | 0.062 | T | 0.247 | 0 | S | 0.629 | 0.006 | S |
| 528 | 74292 | CGPG5367 | SENSE | 0.327 | 0.199 | T | 0.16 | 0.067 | T | 0.105 | 0.166 | T | 0.565 | 0.013 | S |
| 529 | 74302 | CGPG5384 | SENSE | 1.246 | 0.016 | S | 0.296 | 0.004 | S | 0.25 | 0 | S | 0.705 | 0.004 | S |
| 530 | 74325 | CGPG5898 | SENSE | 1.596 | 0.021 | S | −0.035 | 0.76 | / | 0.094 | 0.106 | T | 0.685 | 0.004 | S |
| 531 | 74429 | CGPG6689 | SENSE | 1.796 | 0.008 | S | 0.298 | 0.037 | S | 0.207 | 0.006 | S | 0.496 | 0.029 | S |
| 532 | 74440 | CGPG6682 | SENSE | 0.223 | 0.334 | / | 0.43 | 0.007 | S | 0.272 | 0.01 | S | 0.744 | 0.017 | S |
| 450 | 74449 | CGPG6659 | SENSE | 0.693 | 0.19 | T | 0.204 | 0.104 | T | 0.205 | 0.022 | S | 0.451 | 0.095 | T |
| 533 | 74462 | CGPG6668 | SENSE | 2.14 | 0.028 | S | 0.244 | 0.038 | S | 0.239 | 0.001 | S | 0.64 | 0.013 | S |
| 534 | 74465 | CGPG6692 | SENSE | 1.245 | 0.016 | S | 0.35 | 0.01 | S | 0.215 | 0.001 | S | 0.575 | 0.043 | S |
| 535 | 74474 | CGPG6669 | SENSE | 3.312 | 0.002 | S | 0.233 | 0.083 | T | 0.338 | 0.003 | S | 0.589 | 0.044 | S |
| 536 | 74505 | CGPG6783 | SENSE | 1.731 | 0.043 | S | 0.272 | 0.007 | S | 0.208 | 0.01 | S | 0.493 | 0.009 | S |
| 537 | 74507 | CGPG6799 | SENSE | 2.32 | 0.009 | S | 0.056 | 0.567 | / | 0.227 | 0.035 | S | 0.476 | 0.126 | T |
| 538 | 74562 | CGPG6764 | SENSE | 1.405 | 0.038 | S | −0.052 | 0.776 | / | 0.215 | 0.014 | S | 0.104 | 0.766 | / |
| 507 | 74572 | CGPG6640 | SENSE | 1.425 | 0.025 | S | 0.201 | 0.009 | S | 0.267 | 0.001 | S | 1.184 | 0 | S |
| 270 | 14324 | CGPG1560 | SENSE | 1.708 | 0.017 | S | 0.307 | 0.01 | S | 0.408 | 0 | S | 0.995 | 0.002 | S |
| 358 | 19768 | CGPG4096 | SENSE | 1.496 | 0.061 | T | 0.163 | 0.187 | T | 0.129 | 0.013 | S | 0.66 | 0.002 | S |
| 436 | 19771 | CGPG4011 | SENSE | 1.666 | 0.051 | T | 0.319 | 0.005 | S | 0.201 | 0.028 | S | 0.68 | 0.031 | S |
| 363 | 19879 | CGPG4009 | SENSE | 2.117 | 0.029 | S | 0.16 | 0.139 | T | 0.091 | 0.202 | / | 0.545 | 0.028 | S |
| 347 | 72715 | CGPG5521 | SENSE | 1.078 | 0.002 | S | 0.207 | 0.141 | T | 0.176 | 0.014 | S | 0.519 | 0.015 | S |
| 407 | 72771 | CGPG2166 | SENSE | 0.564 | 0.256 | / | −0.019 | 0.857 | / | 0.206 | 0.013 | S | 0.306 | 0.05 | S |
| 440 | 72903 | CGPG5584 | SENSE | 0.645 | 0.196 | T | −0.031 | 0.569 | / | 0.097 | 0.389 | / | 0.482 | 0.015 | S |
| 411 | 73054 | CGPG5754 | SENSE | 1.52 | 0.035 | S | 0.198 | 0.089 | T | 0.098 | 0.187 | T | 0.696 | 0.004 | S |
| 476 | 74107 | CGPG6590 | SENSE | 0.772 | 0.036 | S | 0.411 | 0 | S | 0.431 | 0.001 | S | 1.579 | 0 | S |
| 478 | 74131 | CGPG6592 | SENSE | 1.747 | 0.044 | S | 0.316 | 0.004 | S | 0.115 | 0.01 | S | 0.663 | 0.001 | S |
| 442 | 74587 | CGPG6774 | SENSE | 1.754 | 0.01 | S | 0.121 | 0.243 | / | 0.194 | 0.001 | S | 0.681 | 0 | S |

S: represents the transgenic plants showed statistically significant trait improvement as compared to the reference ($p < 0.05$)

T: represents the transgenic plants showed a trend of trait improvement as compared to the reference with $p < 0.2$ /: represents the transgenic plants didn't show any alteration or had unfavorable change in traits examined as compared to the reference in the current dataset E. Polyethylene Glycol (PEG) Induced Osmotic Stress Tolerance Screen There are numerous factors, which can influence seed germination and subsequent seedling growth, one being the availability of water. Genes, which can directly affect the success rate of germination and early seedling growth, are potentially useful agronomic traits for improving the germination and growth of crop plants under drought stress. In this assay, PEG was used to induce osmotic stress on germinating transgenic lines of *Arabidopsis thaliana* seeds in order to screen for osmotically resistant seed lines.

T2 seeds were plated on BASTA selection plates containing 3% PEG and grown under standard light and temperature conditions. Seeds were plated on each plate containing 3% PEG, ½×MS salts, 1% phytagel, and 10 μg/ml glufosinate. Plates were placed at 4° C. for 3 days to stratify seeds. On day 11, plants were measured for primary root length. After 3 more days of growth, i.e., at day 14, plants were scored for transgenic status, primary root length, growth stage, visual color, and the seedlings were pooled for fresh weight measurement. A photograph of the whole plate was taken on day 14.

Seedling weight and root length were analyzed as quantitative responses according to example 1M. The final growth stage at day 14 was scored as success or failure based on whether the plants reached 3 rosette leaves and size of leaves are greater than 1 mm. The growth stage data was analyzed as a qualitative response according to example 1L. Table 8 provides a list of recombinant DNA constructs that improve osmotic stress tolerance in transgenic plants.

TABLE 8

| Pep | | | | Growth Stage | | | Root Length at day 11 | | | Root Length at day 14 | | | Seedling Weight at day 14 | | |
|---|---|---|---|---|---|---|---|---|---|---|---|---|---|---|---|
| SEQ ID | Gene | Construct_id | Orientation | RS mean | p-value | c | delta | p-value | c | delta | p-value | c | delta | p-value | c |
| 413 | 19707 | CGPG4179 | SENSE | 2.653 | 0.019 | S | 0.074 | 0.58 | T | −0.031 | 0.81 | / | 0.427 | 0.063 | T |
| 414 | 19951 | CGPG3941 | SENSE | 1.432 | 0.134 | T | 0.017 | 0.864 | T | −0.08 | 0.28 | / | 0.476 | 0.054 | T |
| 415 | 19967 | CGPG4032 | SENSE | 2.691 | 0.014 | S | 0.01 | 0.934 | T | 0.19 | 0.039 | S | 0.537 | 0.056 | T |
| 416 | 70543 | CGPG3815 | SENSE | 1.735 | 0.077 | T | 0.084 | 0.561 | T | 0.323 | 0.007 | S | 0.676 | 0.006 | S |
| 402 | 70681 | CGPG4584 | SENSE | 2.528 | 0.006 | S | −0.065 | 0.682 | / | −0.179 | 0.05 | / | 0.374 | 0.146 | T |
| 417 | 70707 | CGPG1273 | ANTI-SENSE | 1.42 | 0.095 | T | 0.248 | 0.006 | S | 0.3 | 0.002 | S | 0.331 | 0.007 | S |
| 418 | 70719 | CGPG1712 | ANTI-SENSE | 1.43 | 0.106 | T | −0.007 | 0.968 | / | 0.101 | 0.255 | T | 0.155 | 0.349 | T |
| 419 | 71134 | CGPG817 | SENSE | 1.478 | 0.13 | T | 0.119 | 0.15 | T | 0.035 | 0.684 | T | 0.198 | 0.277 | T |
| 420 | 71146 | CGPG2928 | SENSE | 2.624 | 0.016 | S | 0.227 | 0.101 | T | 0.242 | 0.1 | T | 0.278 | 0.296 | T |
| 405 | 71508 | CGPG1541 | SENSE | 3.153 | 0.001 | S | 0.446 | 0.054 | T | 0.384 | 0.048 | S | 0.782 | 0.003 | S |
| 421 | 71660 | CGPG4690 | SENSE | 2.893 | 0.005 | S | −0.024 | 0.795 | / | 0.225 | 0.074 | T | 0.165 | 0.329 | T |
| 403 | 71663 | CGPG4638 | SENSE | 0.116 | 0.444 | T | −0.061 | 0.536 | / | 0.358 | 0.041 | S | 0.058 | 0.702 | T |
| 439 | 71928 | CGPG1617 | SENSE | 2.076 | 0.041 | S | 0.353 | 0.013 | S | 0.289 | 0.035 | S | 0.531 | 0.035 | S |
| 318 | 72081 | CGPG5279 | SENSE | 1.262 | 0.138 | T | 0.174 | 0.243 | T | 0.2 | 0.197 | T | −0.105 | 0.714 | / |
| 408 | 72085 | CGPG5228 | SENSE | 4 | 0 | S | 0.22 | 0.046 | S | 0.371 | 0.004 | S | 0.929 | 0 | S |
| 422 | 72086 | CGPG5236 | SENSE | 2.589 | 0.022 | S | 0.281 | 0.033 | S | 0.136 | 0.314 | T | 0.32 | 0.043 | S |
| 423 | 72632 | CGPG4852 | SENSE | 1.663 | 0.053 | T | 0.254 | 0.069 | T | 0.094 | 0.548 | T | 0.471 | 0.015 | S |
| 424 | 72716 | CGPG5529 | SENSE | 2.914 | 0.004 | S | 0.146 | 0.058 | T | 0.007 | 0.925 | T | 0.582 | 0.016 | S |
| 425 | 72723 | CGPG1848 | SENSE | 2.138 | 0.066 | T | 0.043 | 0.728 | T | 0.2 | 0.068 | T | −0.326 | 0.225 | / |
| 409 | 72744 | CGPG5563 | SENSE | 1.636 | 0.05 | / | 0.195 | 0.151 | T | 0.059 | 0.751 | T | 0.539 | 0.005 | S |
| 404 | 72769 | CGPG5573 | SENSE | 2.207 | 0.055 | T | 0.086 | 0.464 | T | −0.134 | 0.162 | / | 0.389 | 0.086 | T |
| 407 | 72771 | CGPG2166 | SENSE | 2.569 | 0.021 | S | 0.169 | 0.221 | T | 0.192 | 0.038 | S | 0.56 | 0.018 | S |
| 440 | 72903 | CGPG5584 | SENSE | 2.161 | 0.061 | T | 0.035 | 0.856 | T | 0.245 | 0.162 | T | 0.06 | 0.871 | T |
| 510 | 72921 | CGPG5781 | SENSE | 2.249 | 0.025 | S | 0.034 | 0.788 | T | 0.225 | 0.077 | T | 0.306 | 0.28 | T |
| 391 | 72948 | CGPG5617 | SENSE | 2.267 | 0.005 | S | 0.054 | 0.495 | T | 0.117 | 0.019 | S | 0.289 | 0.077 | T |
| 445 | 72961 | CGPG5591 | SENSE | 1.19 | 0.14 | T | 0.037 | 0.76 | T | 0.136 | 0.339 | T | 0.588 | 0.027 | S |
| 511 | 72968 | CGPG5772 | SENSE | 3.142 | 0.007 | S | 0.178 | 0.072 | T | −0.031 | 0.781 | / | 0.698 | 0.016 | S |
| 426 | 72987 | CGPG1787 | SENSE | 2.055 | 0.078 | T | −0.058 | 0.64 | / | 0.097 | 0.144 | T | 0.325 | 0.054 | T |
| 438 | 72994 | CGPG5803 | SENSE | 2.674 | 0.013 | S | 0.245 | 0.124 | T | 0.07 | 0.657 | T | 0.599 | 0.035 | S |
| 441 | 73017 | CGPG5733 | SENSE | 4 | 0 | S | 0.343 | 0.09 | T | 0.462 | 0.002 | S | 0.996 | 0 | S |
| 410 | 73039 | CGPG810 | SENSE | 4 | 0 | S | 0.319 | 0.019 | S | 0.237 | 0.05 | / | 0.426 | 0.011 | S |
| 411 | 73054 | CGPG5754 | SENSE | 3.048 | 0.002 | S | 0.556 | 0.003 | S | 0.26 | 0.063 | T | 1.12 | 0.002 | S |
| 446 | 73070 | CGPG5627 | SENSE | 3.439 | 0.001 | S | 0.139 | 0.49 | T | 0.19 | 0.135 | T | 0.24 | 0.365 | T |
| 447 | 73475 | CGPG6385 | SENSE | 1.933 | 0.033 | S | 0.04 | 0.476 | T | 0.009 | 0.897 | T | 0.459 | 0.073 | T |
| 412 | 73501 | CGPG6456 | SENSE | 1.29 | 0.121 | T | 0.143 | 0.118 | T | 0.043 | 0.564 | T | 0.433 | 0.013 | S |
| 427 | 74109 | CGPG6606 | SENSE | 3.517 | 0 | S | 0.159 | 0.136 | T | 0.249 | 0.004 | S | 0.333 | 0.025 | S |
| 428 | 74140 | CGPG6569 | SENSE | 2.05 | 0.039 | S | 0.168 | 0.138 | T | 0.196 | 0.086 | T | 0.71 | 0.012 | S |
| 429 | 74191 | CGPG6597 | SENSE | 2.565 | 0.019 | S | 0.336 | 0.092 | T | 0.199 | 0.112 | T | 0.54 | 0.02 | S |
| 406 | 74248 | CGPG5476 | SENSE | 3.158 | 0.007 | S | 0.14 | 0.192 | T | 0.204 | 0.051 | T | 0.377 | 0.037 | S |
| 430 | 74265 | CGPG5356 | SENSE | 2.208 | 0.023 | S | 0.317 | 0.034 | S | 0.419 | 0.006 | S | 0.577 | 0.008 | S |
| 431 | 74369 | CGPG6076 | SENSE | 3.522 | 0 | S | 0.347 | 0.045 | S | 0.272 | 0.107 | T | 0.624 | 0.02 | S |
| 442 | 74587 | CGPG6774 | SENSE | 3.325 | 0.002 | S | 0.073 | 0.468 | T | 0.414 | 0.002 | S | 0.577 | 0.016 | S |
| 405 | 71508 | CGPG1541 | SENSE | 3.153 | 0.001 | S | 0.446 | 0.054 | T | 0.384 | 0.048 | S | 0.782 | 0.003 | S |
| 439 | 71928 | CGPG1617 | SENSE | 2.076 | 0.041 | S | 0.353 | 0.013 | S | 0.289 | 0.035 | S | 0.531 | 0.035 | S |
| 422 | 72086 | CGPG5236 | SENSE | 2.589 | 0.022 | S | 0.281 | 0.033 | S | 0.136 | 0.314 | / | 0.32 | 0.043 | S |
| 469 | 72455 | CGPG4742 | SENSE | 1.367 | 0.15 | T | 0.026 | 0.764 | / | 0.024 | 0.786 | / | 0.255 | 0.04 | S |
| 382 | 72466 | CGPG4767 | SENSE | 0.735 | 0.101 | T | 0.068 | 0.333 | / | 0.249 | 0.006 | S | −0.341 | 0.278 | / |
| 373 | 72633 | CGPG4853 | SENSE | 1.179 | 0.122 | T | 0.227 | 0.009 | S | 0.097 | 0.065 | T | 0.442 | 0.013 | S |
| 370 | 72757 | CGPG5572 | SENSE | 2.272 | 0.017 | S | 0.125 | 0.361 | / | 0.11 | 0.317 | / | 0.425 | 0.047 | S |
| 472 | 72992 | CGPG5777 | SENSE | 2.233 | 0.056 | T | 0.176 | 0.261 | / | 0.116 | 0.34 | / | 0.511 | 0.019 | S |
| 438 | 72994 | CGPG5803 | SENSE | 2.674 | 0.013 | S | 0.245 | 0.124 | T | 0.07 | 0.657 | / | 0.599 | 0.035 | S |
| 441 | 73017 | CGPG5733 | SENSE | 4 | 0 | S | 0.343 | 0.09 | T | 0.462 | 0.002 | S | 0.996 | 0 | S |
| 411 | 73054 | CGPG5754 | SENSE | 3.048 | 0.002 | S | 0.556 | 0.003 | S | 0.26 | 0.063 | T | 1.12 | 0.002 | S |
| 300 | 73507 | CGPG6504 | SENSE | 0.343 | 0.334 | / | 0.347 | 0.007 | S | 0.261 | 0.032 | S | 0.3 | 0.122 | T |
| 352 | 73515 | CGPG6473 | SENSE | 3.336 | 0.002 | S | 0.279 | 0.009 | S | 0.241 | 0.003 | S | 0.328 | 0.05 | S |
| 428 | 74140 | CGPG6569 | SENSE | 2.05 | 0.039 | S | 0.168 | 0.138 | T | 0.196 | 0.086 | T | 0.71 | 0.012 | S |
| 430 | 74265 | CGPG5356 | SENSE | 2.208 | 0.023 | S | 0.317 | 0.034 | S | 0.419 | 0.006 | S | 0.577 | 0.008 | S |
| 431 | 74369 | CGPG6076 | SENSE | 3.522 | 0 | S | 0.347 | 0.045 | S | 0.272 | 0.107 | T | 0.624 | 0.02 | S |
| 422 | 74587 | CGPG6774 | SENSE | 3.325 | 0.002 | S | 0.073 | 0.468 | / | 0.414 | 0.002 | S | 0.577 | 0.016 | S |

S: represents the transgenic plants showed statistically significant trait improvement as compared to the reference (p < 0.05)

T: represents the transgenic plants showed a trend of trait improvement compared to the reference with p < 0.2

/: represents the transgenic plants didn't show any alteration or had unfavorable change in traits examined as compared to the reference in the current dataset F. Cold Shock Tolerance Screen This example set forth a screen to identify *Arabidopsis* plants transformed with the genes of interest that are more tolerant to cold stress subjected during day 8 to day 28 after seed planting. During these crucial early stages, seedling growth and leaf area increase were measured to assess tolerance when *Arabidopsis* seedlings were exposed to low temperatures. Using this screen, genetic alterations can be found that enable plants to germinate and grow better than wild type plants under sudden exposure to low temperatures.

Eleven seedlings from T2 seeds of each transgenic line plus one control line were plated together on a plate containing ½× Gamborg Salts with 0.8 Phytagel™, 1% Phytagel, and 0.3% Sucrose. Plates were then oriented horizontally and stratified for three days at 4° C. At day three, plates were removed from stratification and exposed to standard conditions (16 hr photoperiod, 22° C. at day and 20° C. at night) until day 8. At day eight, plates were removed from standard conditions and exposed to cold shock conditions (24 hr photoperiod, 8° C. at both day and night) until the final day of the assay, i.e., day 28. Rosette areas were measured at day 8 and day 28, which were analyzed as quantitative responses according to example 1M. Table 9 provides a list of recombinant nucleotides that improve cold shock stress tolerance in plants.

G. Cold Germination Tolerance Screen

This example sets forth a screen to identify *Arabidopsis* plants transformed with the genes of interests are resistant to cold stress based on their rate of development, root growth and chlorophyll accumulation under low temperature conditions.

T2 seeds were plated and all seedlings used in the experiment were grown at 8° C. Seeds were first surface disinfested using chlorine gas and then seeded on assay plates containing an aqueous solution of ½× Gamborg's B/5 Basal Salt Mixture (Sigma/Aldrich Corp., St. Louis, Mo., USA G/5788), 1% Phytagel™ (Sigma-Aldrich, P-8169), and 10 ug/ml glufosinate with the final pH adjusted to 5.8 using KOH. Test plates were held vertically for 28 days at a constant temperature of 8° C., a photoperiod of 16 hr, and average light intensity of approximately 100 umol/$m^2$/s. At 28 days post planting, root length was measured, growth stage was observed, the visual color was assessed, and a whole plate photograph was taken.

The root length at day 28 was analyzed as a quantitative response according to example 1M. The growth stage at day 7 was analyzed as a qualitative response according to example 1L. Table 10 provides a list of recombinant DNA constructs that improve cold stress tolerance in transgenic plants.

TABLE 9

| | | | | rosette area at day 8 | | | rosette area at day 28 | | | difference in rosette area between day 28 and day 8 | | |
|---|---|---|---|---|---|---|---|---|---|---|---|---|
| Pep SEQ ID | Construct_id | Gene | Orientation | delta | p-value | c | delta | p-value | c | delta | p-value | c |
| 270 | 14324 | CGPG1560 | SENSE | 0.054 | 0.429 | / | 0.258 | 0.017 | S | −0.071 | 0.631 | / |
| 271 | 17484 | CGPG2630 | SENSE | −0.189 | 0.759 | / | 0.544 | 0.025 | S | 0.275 | 0.121 | T |
| 272 | 19109 | CGPG1381 | ANTI-SENSE | −0.016 | 0.523 | / | 0.541 | 0.008 | S | 0.818 | 0.014 | S |
| 273 | 70423 | CGPG3165 | SENSE | 0.316 | 0.012 | S | 0.521 | 0.022 | S | 0.89 | 0.018 | S |
| 274 | 70424 | CGPG3180 | SENSE | 0.474 | 0.003 | S | 0.695 | 0.003 | S | 0.693 | 0.043 | S |
| 275 | 70480 | CGPG3833 | SENSE | −0.066 | 0.591 | / | 0.175 | 0.159 | T | 0.474 | 0.059 | T |
| 276 | 70509 | CGPG2420 | SENSE | 0.023 | 0.438 | / | 0.117 | 0.216 | / | 0.609 | 0.032 | S |
| 277 | 70647 | CGPG4334 | SENSE | −0.508 | 0.894 | / | 0.604 | 0.049 | S | 0.895 | 0.047 | S |
| 278 | 70675 | CGPG4519 | SENSE | 0.2 | 0.2 | / | 0.303 | 0.153 | T | 0.507 | 0.034 | S |
| 279 | 70829 | CGPG518 | SENSE | −0.319 | 0.823 | / | 0.804 | 0.002 | S | 1.082 | 0.002 | S |
| 280 | 70849 | CGPG596 | SENSE | −0.039 | 0.564 | / | 0.698 | 0.001 | S | 0.707 | 0.001 | S |
| 281 | 71627 | CGPG1270 | SENSE | −0.146 | 0.748 | / | 0.349 | 0.05 | T | 0.3 | 0.12 | T |
| 282 | 71934 | CGPG2294 | SENSE | −0.068 | 0.796 | / | 0.757 | 0 | S | 0.922 | 0 | S |
| 283 | 72615 | CGPG4829 | SENSE | 0.477 | 0.007 | S | 0.834 | 0 | S | 0.979 | 0.001 | S |
| 286 | 73559 | CGPG6535 | SENSE | 0.143 | 0.093 | T | −0.265 | 0.878 | / | −0.344 | 0.821 | / |
| 287 | 74251 | CGPG5489 | SENSE | 0.377 | 0.021 | S | 0.439 | 0.045 | S | 0.45 | 0.07 | T |
| 389 | 70437 | CGPG3706 | SENSE | −0.273 | 0.916 | / | 0.147 | 0.165 | T | 0.682 | 0.034 | S |
| 402 | 70681 | CGPG4584 | SENSE | 0.352 | 0.155 | T | 0.252 | 0.261 | / | 0.269 | 0.328 | / |
| 403 | 71663 | CGPG4638 | SENSE | 0.358 | 0.013 | S | 0.032 | 0.423 | / | −0.031 | 0.585 | / |
| 404 | 72769 | CGPG5573 | SENSE | 0.381 | 0.049 | S | 0.881 | 0.006 | S | 1.102 | 0.005 | S |
| 407 | 72771 | CGPG2166 | SENSE | 0.993 | 0 | S | 1.381 | 0.003 | S | 1.536 | 0.003 | S |
| 432 | 70217 | CGPG6 | SENSE | 0.275 | 0.067 | T | 0.126 | 0.289 | / | 0.362 | 0.215 | / |
| 433 | 72711 | CGPG1846 | SENSE | 0.774 | 0.001 | S | 0.579 | 0.004 | S | 0.429 | 0.038 | S |
| 438 | 72994 | CGPG5803 | SENSE | 0.116 | 0.381 | / | 0.708 | 0.068 | T | 0.744 | 0.069 | T |
| 510 | 72921 | CGPG5781 | SENSE | 0.265 | 0.057 | T | 0.31 | 0.162 | T | 0.367 | 0.11 | T |
| 414 | 19951 | CGPG3941 | SENSE | 0.729 | 0.006 | S | 0.473 | 0.017 | s | 0.846 | 0.006 | S |
| 273 | 70423 | CGPG3165 | SENSE | 0.316 | 0.012 | S | 0.521 | 0.022 | S | 0.89 | 0.018 | S |
| 416 | 70543 | CGPG3815 | SENSE | 1.584 | 0 | S | 0.86 | 0 | S | 0.82 | 0.002 | S |
| 368 | 71617 | CGPG1227 | SENSE | 0.204 | 0.136 | T | 0.408 | 0.025 | S | 0.458 | 0.057 | T |
| 439 | 71928 | CGPG1617 | SENSE | 0.104 | 0.265 | / | 0.786 | 0 | S | 0.836 | 0.001 | S |
| 382 | 72466 | CGPG4767 | SENSE | 0.497 | 0.017 | S | 0.565 | 0.017 | S | 0.963 | 0.002 | S |
| 383 | 72524 | CGPG4770 | SENSE | 0.438 | 0.02 | S | 0.377 | 0.025 | S | 0.385 | 0.043 | S |
| 409 | 72744 | CGPG5563 | SENSE | 0.52 | 0.058 | T | 0.859 | 0.026 | S | 0.454 | 0.189 | T |
| 444 | 72967 | CGPG5742 | SENSE | 0.955 | 0 | S | 0.629 | 0.009 | S | 0.403 | 0.189 | T |
| 435 | 73518 | CGPG6497 | SENSE | 0.114 | 0.278 | / | 0.319 | 0.01 | S | 0.195 | 0.114 | T |
| 306 | 74136 | CGPG6632 | SENSE | 0.606 | 0.007 | S | 0.523 | 0.036 | S | 0.598 | 0.025 | S |
| 398 | 74240 | CGPG5454 | SENSE | −0.099 | 0.644 | / | 1.277 | 0.003 | S | 1.498 | 0.006 | S |
| 431 | 74369 | CGPG6076 | SENSE | 0.623 | 0.002 | S | 0.62 | 0.04 | S | 0.737 | 0.096 | T |

S: represents the transgenic plants showed statistically significant trait improvement as compared to the reference ($p < 0.05$)

T: represents the transgenic plants showed a trend of trait improvement compared to the reference with $p < 0.2$ /: represents the transgenic plants didn't show any alteration or had unfavorable change in traits examined as compared to the reference in the current dataset.

TABLE 10

| | | | | Growth stage at day 28 | | | Root Length at day 28 | | |
|---|---|---|---|---|---|---|---|---|---|
| Pep SEQ ID | Construct_id | Gene | Orientation | RS mean | p-value | c | delta | p-value | c |
| 288 | 19631 | CGPG3627 | SENSE | 2.229 | 0.052 | T | 0.094 | 0.252 | / |
| 289 | 70121 | CGPG2380 | SENSE | 2.732 | 0.042 | S | 0.126 | 0.238 | / |
| 290 | 70654 | CGPG4352 | SENSE | 2.474 | 0.026 | S | 0.263 | 0.019 | S |
| 291 | 70696 | CGPG4590 | SENSE | 3.092 | 0.01 | S | 0.086 | 0.145 | T |
| 292 | 70713 | CGPG1462 | ANTI-SENSE | 4 | 0 | S | 0.268 | 0.014 | S |
| 293 | 70740 | CGPG3700 | SENSE | 2.485 | 0.024 | S | 0.244 | 0.012 | S |
| 294 | 71321 | CGPG4418 | SENSE | 1.837 | 0.126 | T | 0.014 | 0.474 | / |
| 295 | 71835 | CGPG4634 | SENSE | 3.349 | 0.002 | S | 0.353 | 0.036 | S |
| 296 | 72934 | CGPG5798 | SENSE | 2.222 | 0.023 | S | 0.243 | 0.101 | T |
| 297 | 72945 | CGPG5787 | SENSE | 3.478 | 0.001 | S | 0.236 | 0.011 | S |
| 298 | 72980 | CGPG5773 | SENSE | 3.265 | 0.003 | S | 0.239 | 0.006 | S |
| 299 | 73504 | CGPG6480 | SENSE | 4 | 0 | S | 0.521 | 0 | S |
| 300 | 73507 | CGPG6504 | SENSE | 4 | 0 | S | 0.404 | 0.001 | S |
| 301 | 73573 | CGPG6462 | SENSE | 4 | 0 | S | 0.268 | 0.004 | S |
| 302 | 73586 | CGPG6471 | SENSE | 4 | 0 | S | 0.314 | 0.064 | T |
| 303 | 73770 | CGPG5435 | SENSE | 3.091 | 0.01 | S | 0.303 | 0.085 | T |
| 304 | 74105 | CGPG6574 | SENSE | 3.329 | 0.002 | S | 0.109 | 0.116 | T |
| 305 | 74111 | CGPG6622 | SENSE | 2.226 | 0.021 | S | 0.445 | 0.006 | S |
| 306 | 74136 | CGPG6632 | SENSE | 3.192 | 0.005 | S | 0.328 | 0.002 | S |
| 307 | 74139 | CGPG6561 | SENSE | 4 | 0 | S | 0.254 | 0.092 | T |
| 308 | 74267 | CGPG5364 | SENSE | 3.054 | 0.002 | S | 0.3 | 0 | S |
| 309 | 74291 | CGPG5363 | SENSE | 4 | 0 | S | 0.142 | 0.142 | T |
| 310 | 74318 | CGPG5826 | SENSE | 4 | 0 | S | 0.272 | 0.008 | S |
| 311 | 74319 | CGPG5831 | SENSE | 3.207 | 0.005 | S | 0.201 | 0.002 | S |
| 312 | 74324 | CGPG5885 | SENSE | 3.144 | 0.007 | S | 0.232 | 0.017 | S |
| 313 | 74512 | CGPG32 | SENSE | 4 | 0 | S | 0.332 | 0.011 | S |
| 314 | 74583 | CGPG6649 | SENSE | 3.249 | 0.004 | S | 0.28 | 0.001 | S |
| 315 | 70427 | CGPG3067 | SENSE | 1.567 | 0.108 | T | 0.222 | 0.044 | S |
| 352 | 73515 | CGPG6473 | SENSE | 4 | 0 | S | 0.324 | 0.003 | S |
| 353 | 74684 | CGPG6360 | SENSE | 2.927 | 0.004 | S | 0.426 | 0.003 | S |
| 373 | 72633 | CGPG4853 | SENSE | 2.121 | 0.027 | S | 0.289 | 0.048 | S |
| 405 | 71508 | CGPG1541 | SENSE | 1.99 | 0.039 | S | 0.263 | 0.033 | S |
| 406 | 74248 | CGPG5476 | SENSE | 2.385 | 0.011 | S | 0.217 | 0.017 | S |
| 434 | 70932 | CGPG4089 | SENSE | 3.268 | 0.003 | S | 0.146 | 0.067 | T |
| 435 | 73518 | CGPG6497 | SENSE | 3.373 | 0.002 | S | 0.352 | 0.032 | S |
| 439 | 71928 | CGPG1617 | SENSE | 3.062 | 0.011 | S | 0.18 | 0.002 | S |
| 504 | 74259 | CGPG5343 | SENSE | 3.511 | 0 | S | 0.308 | 0.024 | S |
| 505 | 72463 | CGPG4760 | SENSE | 2.736 | 0.01 | S | 0.032 | 0.386 | / |
| 506 | 72902 | CGPG5597 | SENSE | 3.105 | 0.009 | S | 0.278 | 0.037 | S |
| 507 | 74572 | CGPG6640 | SENSE | 4 | 0 | S | 0.125 | 0.155 | T |
| 508 | 73055 | CGPG5768 | SENSE | 3.173 | 0.006 | S | 0.407 | 0.004 | S |
| 413 | 19707 | CGPG4179 | SENSE | 1.829 | 0.061 | T | 0.169 | 0.018 | S |
| 360 | 19779 | CGPG4113 | SENSE | 4 | 0 | S | 0.213 | 0.017 | S |
| 361 | 19833 | CGPG4074 | SENSE | / | / | / | 0.292 | 0.022 | S |
| 363 | 19879 | CGPG4009 | SENSE | 4 | 0 | S | 0.34 | 0.001 | S |
| 514 | 19980 | CGPG3914 | SENSE | 0.798 | 0.122 | T | 0.278 | 0.011 | S |
| 273 | 70423 | CGPG3165 | SENSE | 2.906 | 0.004 | S | 0.105 | 0.114 | T |
| 459 | 70725 | CGPG2097 | ANTI-SENSE | 1.949 | 0.044 | S | 0.122 | 0.148 | T |
| 461 | 71112 | CGPG934 | SENSE | 2.579 | 0.018 | S | 0.185 | 0.17 | T |
| 444 | 72967 | CGPG5742 | SENSE | 4 | 0 | S | 0.287 | 0.007 | S |
| 438 | 72994 | CGPG5803 | SENSE | 1.072 | 0.098 | T | 0.161 | 0.04 | S |
| 521 | 73488 | CGPG6394 | SENSE | 4 | 0 | S | 0.211 | 0.012 | S |
| 477 | 74117 | CGPG6575 | SENSE | 2.567 | 0.02 | S | 0.123 | 0.04 | S |

S: represents the transgenic plants showed statistically significant trait improvement as compared to the reference ($p < 0.05$)

T: represents the transgenic plants showed a trend of trait improvement as compared to the reference with $p < 0.2$ /: represents data points not determined or the transgenic plants didn't show any alteration or had unfavorable change in traits examined compared to the reference in the current dataset H. Shade Tolerance Screen Plants undergo a characteristic morphological response in shade that includes the elongation of the petiole, a change in the leaf angle, and a reduction in chlorophyll content. While these changes may confer a competitive advantage to individuals, in a monoculture the shade avoidance response is thought to reduce the overall biomass of the population. Thus, genetic alterations that prevent the shade avoidance response are associated with higher yields. Genes that favor growth under low light conditions may also promote yield, as inadequate light levels frequently limit yield. This protocol describes a screen to look for *Arabidopsis* plants that show an attenuated shade avoidance response and/or grow better than control plants under low light intensity. Of particular interest, we were looking for plants that didn't extend their petiole length, had an increase in seedling weight relative to the reference and had leaves that were more close to parallel with the plate surface.

T2 seeds were plated on glufosinate selection plates with ½ MS medium. Seeds were sown on ½×MS salts, 1% Phytagel, 10 ug/ml BASTA. Plants were grown on vertical plates at a temperature of 22° C. at day, 20° C. at night and under low light (approximately 30 uE/$m^2$/s, far/red ratio (655/665/725/735)-0.35 using PLAQ lights with GAM color filter #680). Twenty-three days after seedlings were sown, measurements were recorded including seedling status, number of rosette leaves, status of flower bud, petiole leaf angle, petiole length, and pooled fresh weights. A digital image of the whole plate was taken on the measurement day. Seedling weight and petiole length were analyzed as quantitative responses according to example 1M. The number of rosette leaves, flowering bud formation and leaf angel were analyzed as qualitative responses according to example 1L.

Table 11 provides a list of recombinant DNA constructs that improve shade tolerance in plants

TABLE 11

| Pep | | | flowerbud formation at day 23 | | | Leaf Angle at day 23 | | | Petiole length at day 23 | | | Number of rosette leaves at day 23 | | | seedling weight at day 23 | | |
|---|---|---|---|---|---|---|---|---|---|---|---|---|---|---|---|---|---|
| SEQ ID | Construct_id | Orientation | RS mean | p-value | c | RS mean | p-value | c | RS mean | p-value | c | RS mean | p-value | c | delta | p-value | c |
| 376 | 70426 | SENSE | 0.719 | 0.09 | T | 0.163 | 0.244 | / | −0.206 | 0.185 | T | −0.225 | 0.984 | / | 0.484 | 0.003 | S |
| 377 | 70772 | SENSE | −0.501 | 0.858 | / | −0.066 | 0.724 | / | −0.692 | 0.004 | S | −0.626 | 0.983 | / | −0.693 | 0.023 | / |
| 378 | 71137 | SENSE | 0.26 | 0.384 | / | 0.11 | 0.168 | T | −0.869 | 0.029 | S | 1.064 | 0.073 | T | −0.453 | 0.288 | / |
| 379 | 71529 | SENSE | 0.89 | 0.108 | T | −0.014 | 1 | / | −0.44 | 0.006 | S | 1.817 | 0.024 | S | −0.022 | 0.914 | / |
| 380 | 71601 | SENSE | 1.79 | 0.066 | T | 0.195 | 0.172 | T | −0.057 | 0.59 | / | −0.483 | 0.961 | / | 0.264 | 0.308 | / |
| 381 | 72362 | SENSE | 1.763 | 0.072 | T | 0.218 | 0.262 | / | −0.109 | 0.242 | / | 0.003 | 0.484 | / | 0.311 | 0.119 | T |
| 374 | 72456 | SENSE | 0.563 | 0.313 | / | 0.751 | 0.186 | T | −0.848 | 0.001 | S | −0.624 | 0.999 | / | −0.85 | 0.025 | / |
| 382 | 72466 | SENSE | −1.382 | 1 | / | −0.092 | 0.645 | / | −0.894 | 0 | S | 1.212 | 0.122 | T | −0.879 | 0.027 | / |
| 383 | 72524 | SENSE | −0.153 | 1 | / | 0.152 | 0.09 | T | −0.952 | 0.002 | S | −0.57 | 1 | / | −1.269 | 0.01 | / |
| 373 | 72633 | SENSE | 3.513 | 0 | S | −0.431 | 0.977 | / | −0.426 | 0.001 | S | −0.735 | 0.994 | / | 0.269 | 0.129 | T |
| 375 | 72963 | SENSE | −0.911 | 0.988 | / | 0.236 | 0.396 | / | −0.753 | 0.003 | S | −0.083 | 0.665 | / | −0.485 | 0.015 | / |
| 384 | 73085 | SENSE | −0.073 | 0.756 | / | 1.212 | 0.122 | T | 0.175 | 0.097 | / | 4 | 0 | S | 0.51 | 0.027 | S |
| 385 | 74241 | SENSE | −0.195 | 0.935 | / | −0.098 | 0.64 | / | −1.077 | 0.01 | S | −0.821 | 0.999 | / | −1.024 | 0.002 | / |
| 386 | 74247 | SENSE | 0.43 | 0.16 | T | 0.203 | 0.095 | T | −0.22 | 0.197 | T | 1.166 | 0.07 | T | 0.483 | 0.018 | S |
| 387 | 74284 | SENSE | 0.062 | 0.22 | / | 2.077 | 0.038 | S | −0.014 | 0.943 | / | 2.348 | 0.04 | S | 0.03 | 0.938 | / |
| 388 | 74652 | SENSE | 0.015 | 0.442 | / | 0.093 | 0.455 | / | −0.073 | 0.621 | / | 0.967 | 0.184 | T | 0.173 | 0.569 | / |
| 363 | 19879 | SENSE | 0.585 | / | / | 0 | / | / | 0.152 | / | / | 0 | / | / | 0.708 | / | / |
| 293 | 70740 | SENSE | 0.44 | 0.137 | T | 0.609 | 0.103 | T | 0.161 | 0.186 | / | / | / | / | 0.45 | 0.001 | S |
| 316 | 71811 | SENSE | −0.025 | 0.637 | / | 0.725 | 0.113 | T | −0.205 | 0.01 | S | / | / | / | −0.517 | 0.037 | / |
| 397 | 71840 | SENSE | 1.498 | 0.12 | T | 0.712 | 0.178 | T | −0.379 | 0.001 | S | −0.188 | 0.765 | / | −0.95 | 0.124 | / |
| 468 | 72450 | SENSE | 0.068 | 0.349 | / | −0.042 | 1 | / | 0.166 | 0.016 | / | 1.62 | 0.049 | S | 0.501 | 0.038 | S |
| 370 | 72757 | SENSE | 3.595 | 0 | S | 0.872 | 0.079 | T | 0.064 | 0.138 | / | −0.767 | 0.997 | / | 0.546 | 0.001 | S |
| 444 | 72967 | SENSE | 1.829 | 0.063 | T | 1.123 | 0.065 | T | 0.133 | 0.196 | / | −0.18 | 0.794 | / | 0.509 | 0.008 | S |
| 511 | 72968 | SENSE | 0.185 | 0.005 | S | 0.48 | 0.179 | T | 0.22 | 0.162 | / | 1.698 | 0.085 | T | 0.382 | 0.031 | S |
| 300 | 73507 | SENSE | 0.248 | 0.086 | T | 0.307 | 0.287 | / | −0.304 | 0.031 | S | / | / | / | 0.05 | 0.86 | / |
| 307 | 74139 | SENSE | −0.011 | 0.556 | / | −0.071 | 1 | / | −0.124 | 0.068 | T | −0.511 | 1 | / | −0.413 | 0.124 | / |
| 535 | 74474 | SENSE | 0.755 | 0.154 | T | −0.145 | 0.857 | / | 0.142 | 0.396 | / | / | / | / | 0.765 | 0.005 | S |
| 400 | 74610 | SENSE | 0.572 | 0.222 | / | 0.177 | 0.22 | / | −0.18 | 0.071 | T | / | / | / | −0.341 | 0.173 | / |

S: represents the transgenic plants showed statistically significant trait improvement as compared to the reference ($p < 0.05$)

T: represents the transgenic plants showed a trend of trait improvement as compared to the reference with $p < 0.2$ /: represents data points not determined or the transgenic plants didn't show any alteration or had unfavorable change in traits examined compared to the reference in the current dataset.

I. Early Plant Growth and Development Screen

This example sets forth a plate based phenotypic analysis platform for the rapid detection of phenotypes that are evident during the first two weeks of growth. In this screen, we were looking for genes that confer advantages in the processes of germination, seedling vigor, root growth and root morphology under non-stressed growth conditions to plants. The transgenic plants with advantages in seedling growth and development were determined by the seedling weight and root length at day 14 after seed planting.

T2 seeds were plated on glufosinate selection plates and grown under standard conditions (~100 □E/$m^2$/s, 16 h photoperiod, 22° C. at day, 20° C. at night). Seeds were stratified for 3 days at 4° C. Seedlings were grown vertically (at a temperature of 22° C. at day 20° C. at night). Observations were taken on day 10 and day 14. Both seedling weight and root length at day 14 were analyzed as quantitative responses according to example 1M.

Table 12 provides a list recombinant DNA constructs that improve early plant growth and development.

TABLE 12

| | | | | Root Length | | | Seedling Weight | | |
|---|---|---|---|---|---|---|---|---|---|
| Pep SEQ ID | Construct_id | gene | Orientation | delta | p-value | c | delta | p-value | c |
| 432 | 70217 | CGPG6 | SENSE | 0.038 | 0.469 | / | 0.375 | 0.047 | S |
| 433 | 72711 | CGPG1846 | SENSE | 0.132 | 0.021 | S | 0.601 | 0.001 | S |
| 434 | 70932 | CGPG4089 | SENSE | 0.328 | 0.005 | S | 0.473 | 0.017 | S |
| 435 | 73518 | CGPG6497 | SENSE | 0.287 | 0 | S | 0.634 | 0.036 | S |
| 436 | 19771 | CGPG4011 | SENSE | 0.218 | 0.076 | T | 0.581 | 0.018 | S |
| 437 | 73549 | CGPG6460 | SENSE | 0.139 | 0.003 | S | 0.349 | 0.03 | S |
| 438 | 72994 | CGPG5803 | SENSE | 0.44 | 0.004 | S | 0.791 | 0.001 | S |
| 439 | 71928 | CGPG1617 | SENSE | 0.073 | 0.427 | / | 0.494 | 0.005 | S |
| 440 | 72903 | CGPG5584 | SENSE | 0.298 | 0.002 | S | 0.399 | 0.044 | S |
| 441 | 73017 | CGPG5733 | SENSE | 0.284 | 0.004 | S | 0.199 | 0.488 | / |
| 442 | 74587 | CGPG6774 | SENSE | 0.111 | 0.075 | T | 0.538 | 0.006 | S |
| 443 | 72453 | CGPG4735 | SENSE | 0.215 | 0.005 | S | 0.416 | 0.069 | T |
| 444 | 72967 | CGPG5742 | SENSE | 0.103 | 0.212 | / | 0.568 | 0.008 | S |
| 445 | 72961 | CGPG5591 | SENSE | 0.177 | 0.046 | S | 0.548 | 0.006 | S |
| 446 | 73070 | CGPG5627 | SENSE | 0.221 | 0.007 | S | 0.652 | 0.005 | S |
| 447 | 73475 | CGPG6385 | SENSE | 0.084 | 0.014 | S | 0.336 | 0.014 | S |
| 448 | 72916 | CGPG1814 | SENSE | 0.182 | 0.067 | T | 0.353 | 0.012 | S |
| 449 | 72969 | CGPG5789 | SENSE | 0.133 | 0.245 | / | 0.45 | 0.069 | T |
| 450 | 74449 | CGPG6659 | SENSE | 0.314 | 0.002 | S | 0.579 | 0.027 | S |
| 451 | 16615 | CGPG2539 | SENSE | 0.223 | 0.023 | S | 0.571 | 0.009 | S |
| 452 | 19187 | CGPG3310 | SENSE | 0.264 | 0.001 | S | 0.51 | 0.08 | T |
| 453 | 19648 | CGPG3134 | SENSE | 0.218 | 0.013 | S | 0.27 | 0.106 | T |
| 454 | 70354 | CGPG3995 | SENSE | 0.152 | 0.046 | S | 0.406 | 0.029 | S |
| 455 | 70421 | CGPG2942 | SENSE | 0.179 | 0.225 | / | 0.581 | 0.013 | S |
| 456 | 70459 | CGPG3758 | SENSE | 0.187 | 0.036 | S | −0.034 | 0.884 | / |
| 457 | 70465 | CGPG3775 | SENSE | −0.009 | 0.899 | / | 0.188 | 0.196 | T |
| 458 | 70683 | CGPG4587 | SENSE | 0.133 | 0.088 | T | 0.402 | 0.014 | S |
| 459 | 70725 | CGPG2097 | ANTI-SENSE | 0.326 | 0.001 | S | 0.116 | 0.548 | / |
| 460 | 70852 | CGPG1465 | SENSE | 0.237 | 0 | S | 0.297 | 0.127 | T |
| 461 | 71112 | CGPG934 | SENSE | 0.199 | 0.013 | S | 0.316 | 0.034 | S |
| 462 | 71127 | CGPG945 | SENSE | 0.097 | 0.02 | S | 0.4 | 0.054 | T |
| 463 | 71132 | CGPG1561 | SENSE | 0.195 | 0.02 | S | 0.08 | 0.524 | / |
| 464 | 71217 | CGPG95 | SENSE | 0.234 | 0 | S | 0.566 | 0.036 | S |
| 465 | 71645 | CGPG4688 | SENSE | 0.475 | 0.003 | S | 0.361 | 0.133 | T |
| 466 | 71726 | CGPG3894 | SENSE | 0.223 | 0.056 | T | 0.458 | 0.033 | S |
| 467 | 72432 | CGPG4562 | SENSE | 0.209 | 0 | S | 0.581 | 0.041 | S |
| 468 | 72450 | CGPG4732 | SENSE | 0.335 | 0 | S | 0.79 | 0 | S |
| 469 | 72455 | CGPG4742 | SENSE | 0.278 | 0.019 | S | 0.482 | 0.051 | T |
| 470 | 72727 | CGPG5522 | SENSE | 0.123 | 0.002 | S | 0.315 | 0.004 | S |
| 471 | 72817 | CGPG4987 | SENSE | 0.254 | 0.023 | S | 0.485 | 0 | S |
| 472 | 72992 | CGPG5777 | SENSE | 0.219 | 0.023 | S | 0.664 | 0.015 | S |
| 473 | 73007 | CGPG5760 | SENSE | 0.139 | 0.093 | T | 0.462 | 0.008 | S |
| 474 | 73073 | CGPG5688 | SENSE | 0.164 | 0.022 | S | 0.285 | 0.247 | / |
| 475 | 73506 | CGPG6496 | SENSE | 0.512 | 0 | S | 0.986 | 0 | S |
| 476 | 74107 | CGPG6590 | SENSE | 0.282 | 0.002 | S | 0.538 | 0.057 | T |
| 477 | 74117 | CGPG6575 | SENSE | 0.211 | 0.002 | S | 0.449 | 0.005 | S |
| 478 | 74131 | CGPG6592 | SENSE | 0.142 | 0.047 | S | 0.586 | 0.003 | S |
| 479 | 74344 | CGPG5929 | SENSE | 0.27 | 0.01 | S | 0.474 | 0.105 | T |
| 323 | 13502 | CGPG1354 | SENSE | 0.57 | 0.002 | S | 0.625 | 0 | S |
| 330 | 18259 | CGPG3368 | SENSE | 0.226 | 0.026 | S | 0.551 | 0.021 | S |
| 361 | 19833 | CGPG4074 | SENSE | 0.259 | 0 | S | 0.472 | 0.016 | S |
| 334 | 70417 | CGPG3427 | SENSE | 0.187 | 0.056 | T | 0.113 | 0.65 | / |
| 273 | 70423 | CGPG3165 | SENSE | 0.03 | 0.747 | / | 0.185 | 0.007 | S |
| 515 | 70435 | CGPG3701 | SENSE | 0.131 | 0.051 | T | 0.394 | 0.014 | S |
| 493 | 70601 | CGPG2917 | SENSE | 0.177 | 0 | S | 0.365 | 0.063 | T |
| 291 | 70696 | CGPG4590 | SENSE | 0.079 | 0.205 | / | 0.331 | 0.024 | S |
| 365 | 70738 | CGPG3195 | SENSE | 0.012 | 0.864 | / | 0.472 | 0.003 | S |
| 293 | 70740 | CGPG3700 | SENSE | 0.103 | 0.082 | T | 0.387 | 0.021 | S |
| 419 | 71134 | CGPG817 | SENSE | 0.063 | 0.548 | / | 0.279 | 0.066 | T |
| 422 | 72086 | CGPG5236 | SENSE | 0.083 | 0.234 | / | 0.398 | 0.05 | S |
| 505 | 72463 | CGPG4760 | SENSE | −0.131 | 0.416 | / | 0.422 | 0.003 | S |
| 285 | 73014 | CGPG5692 | SENSE | 0.11 | 0.391 | / | 0.373 | 0.096 | T |
| 521 | 73488 | CGPG6394 | SENSE | 0.018 | 0.793 | / | 0.398 | 0.1 | T |

TABLE 12-continued

| Pep SEQ ID | Construct_id | gene | Orientation | Root Length | | | Seedling Weight | | |
|---|---|---|---|---|---|---|---|---|---|
| | | | | delta | p-value | c | delta | p-value | c |
| 299 | 73504 | CGPG6480 | SENSE | −0.152 | 0.479 | / | 0.538 | 0.012 | S |
| 300 | 73507 | CGPG6504 | SENSE | 0.15 | 0.002 | S | 0.053 | 0.854 | / |
| 301 | 73573 | CGPG6462 | SENSE | 0.112 | 0.07 | T | 0.375 | 0.006 | S |
| 302 | 73586 | CGPG6471 | SENSE | 0.309 | 0 | S | 0.611 | 0 | S |
| 303 | 73770 | CGPG5435 | SENSE | 0.21 | 0.059 | T | 0.281 | 0.484 | / |
| 509 | 74103 | CGPG6558 | SENSE | 0.374 | 0 | S | 0.561 | 0.024 | S |
| 428 | 74140 | CGPG6569 | SENSE | 0.16 | 0.017 | S | 0.376 | 0.066 | T |
| 527 | 74262 | CGPG5353 | SENSE | 0.203 | 0.012 | S | 0.375 | 0.045 | S |
| 430 | 74265 | CGPG5356 | SENSE | 0.107 | 0.259 | T | 0.432 | 0.067 | T |
| 529 | 74302 | CGPG5384 | SENSE | 0.115 | 0.101 | T | 0.269 | 0.056 | T |
| 431 | 74369 | CGPG6076 | SENSE | 0.138 | 0.03 | S | 0.195 | 0.21 | / |
| 534 | 74465 | CGPG6692 | SENSE | 0.2 | 0.02 | S | 0.688 | 0.042 | S |
| 507 | 74572 | CGPG6640 | SENSE | 0.162 | 0.023 | S | 0.617 | 0 | S |
| 314 | 74583 | CGPG6649 | SENSE | 0.144 | 0.023 | S | 0.403 | 0.008 | S |

S: represents the transgenic plants showed statistically significant trait improvement as compared to the reference ($p < 0.05$)

T: represents the transgenic plants showed a trend of trait improvement as compared to the reference with $p < 0.2$ /: represents the transgenic plants didn't show any alteration or had unfavorable change in traits examined as compared to the reference in the current dataset J. Late Plant Growth And Development Screen This example sets forth a soil based phenotypic platform to identify genes that confer advantages in the processes of leaf development, flowering production and seed maturity to plants.

*Arabidopsis* plants were grown on a commercial potting mixture (Metro Mix 360, Scotts Co., Marysville, Ohio) consisting of 30-40% medium grade horticultural vermiculite, 35-55% sphagnum peat moss, 10-20% processed bark ash, I-15% pine bark and a starter nutrient charge. Soil was supplemented with Osmocote time-release fertilizer at a rate of 30 mg/$ft^3$. T2 seeds were imbibed in 1% agarose solution for 3 days at 4° C. and then sown at a density of 5 per 2½" pot. Thirty-two pots were ordered in a 4 by 8 grid in standard greenhouse flat. Plants were grown in environmentally controlled rooms under a 16 h day length with an average light intensity of ~200 μmoles/$m^2$/s. Day and night temperature set points were 22° C. and 20° C., respectively. Humidity was maintained at 65%. Plants were watered by sub-irrigation every two days on average until mid-flowering, at which point the plants were watered daily until flowering was complete.

Application of the herbicide glufosinate was performed to select T2 individuals containing the target transgene. A single application of glufosinate was applied when the first true leaves were visible. Each pot was thinned to leave a single glufosinate-resistant seedling ~3 days after the selection was applied.

The rosette radius was measured at day 25. The silique length was measured at day 40. The plant parts were harvested at day 49 for dry weight measurements if flowering production was stopped. Otherwise, the dry weights of rosette and silique were carried out at day 53. The seeds were harvested at day 58. All measurements were analyzed as quantitative responses according to example 1M.

Table 13 provides a list of recombinant DNA constructs that improve late plant growth and development.

TABLE 13

| Pep SEQ ID | Construct_id | Orientation | Rosette Dry Weight | | | Rosette Radius | | | Seed Dry Weight | | | Silique Dry Weight | | | Slilique Length | | |
|---|---|---|---|---|---|---|---|---|---|---|---|---|---|---|---|---|---|
| | | | delta | p-value | c | delta | p-value | c | delta | p-value | c | delta | p-value | c | delta | p-value | c |
| 480 | 14320 | SENSE | −0.145 | 0.94 | / | 0.137 | 0.038 | S | −0.702 | 1 | / | 0.477 | 0.002 | S | 0.016 | 0.276 | / |
| 481 | 16756 | SENSE | 0.485 | 0.016 | S | 0.223 | 0.025 | S | 0.148 | 0.042 | S | 0.481 | 0.002 | S | 0.147 | 0.013 | S |
| 482 | 17448 | SENSE | −0.288 | 0.991 | / | −0.054 | 0.829 | / | 0.376 | 0.008 | S | 0.185 | 0.034 | S | −0.064 | 0.981 | / |
| 483 | 17633 | SENSE | 0.018 | 0.359 | / | 0.13 | 0.106 | T | 0.416 | 0.055 | T | 0.399 | 0.044 | S | 0.116 | 0.08 | T |
| 484 | 18876 | SENSE | 0.257 | 0.016 | S | 0.026 | 0.448 | / | −0.213 | 0.786 | / | 0.388 | 0 | S | −0.015 | 0.705 | / |
| 485 | 19120 | ANTI-SENSE | −0.252 | 0.936 | / | 0.022 | 0.006 | S | −1.042 | 0.95 | / | 0.165 | 0.076 | T | 0.046 | 0.021 | S |
| 486 | 19221 | SENSE | −0.316 | 0.986 | / | 0.153 | 0.097 | T | −0.35 | 0.903 | / | 0.394 | 0.068 | T | 0.183 | 0.028 | S |
| 487 | 70206 | SENSE | 0.125 | 0 | S | 0.074 | 0.18 | T | 0.712 | 0.022 | S | 0.12 | 0.026 | S | 0.019 | 0.403 | / |
| 488 | 70223 | SENSE | 0.197 | 0.026 | S | 0.23 | 0.018 | S | −0.781 | 0.998 | / | 0.134 | 0.039 | S | −0.205 | 0.915 | / |
| 489 | 70347 | SENSE | 0.156 | 0.038 | S | −0.082 | 0.868 | / | −0.153 | 0.752 | / | 0.405 | 0.006 | S | 0.056 | 0.068 | T |
| 490 | 70406 | SENSE | −0.275 | 0.948 | / | −0.245 | 0.992 | / | 0.759 | 0.025 | S | −0.282 | 0.949 | / | −0.121 | 0.939 | / |
| 491 | 70469 | SENSE | 0.032 | 0.392 | / | 0.348 | 0.004 | S | −0.733 | 0.996 | / | 0.325 | 0.059 | T | −0.141 | 0.922 | / |
| 492 | 70564 | SENSE | 0.17 | 0.037 | S | 0.051 | 0.234 | / | 0.772 | 0 | S | −0.381 | 0.977 | / | −0.015 | 0.655 | / |
| 493 | 70601 | SENSE | 0.231 | 0.086 | T | 0.247 | 0.004 | S | −0.257 | 0.959 | / | 0.323 | 0.024 | S | 0.082 | 0.03 | S |
| 494 | 70612 | SENSE | 0.053 | 0.112 | T | 0.082 | 0.096 | T | 1.049 | 0.011 | S | −0.212 | 0.992 | / | 0.07 | 0.004 | S |
| 495 | 70720 | ANTI-SENSE | −0.16 | 0.898 | / | 0.028 | 0.384 | / | 1.312 | 0.009 | S | 0.219 | 0.121 | T | 0.128 | 0.018 | S |
| 496 | 70735 | SENSE | −0.058 | 0.672 | / | 0.156 | 0.087 | T | 0.421 | 0.036 | S | 0.532 | 0.003 | S | 0.033 | 0.038 | S |
| 497 | 70846 | SENSE | 0.086 | 0.255 | / | 0.134 | 0.063 | T | −0.33 | 0.918 | / | 0.142 | 0.151 | T | 0.011 | 0.439 | / |
| 498 | 70923 | SENSE | 0.484 | 0.011 | S | 0.108 | 0.081 | T | −0.4 | 0.844 | / | 0.091 | 0.198 | T | 0.099 | 0.001 | S |
| 499 | 71149 | SENSE | −1.085 | 0.993 | / | −0.043 | 0.681 | / | 0.346 | 0.017 | S | 0.136 | 0.133 | T | 0.066 | 0.077 | T |
| 500 | 71608 | SENSE | −0.849 | 0.907 | / | −0.132 | 0.976 | / | 0.816 | 0.006 | S | 0.279 | 0.004 | S | 0.038 | 0.238 | / |
| 501 | 71739 | SENSE | −0.275 | 0.937 | / | −0.107 | 0.955 | / | 0.334 | 0 | S | −0.075 | 0.815 | / | −0.119 | 0.874 | / |

TABLE 13-continued

| Pep | | | Rosette Dry Weight | | | Rosette Radius | | | Seed Dry Weight | | | Silique Dry Weight | | | Slilique Length | | |
|---|---|---|---|---|---|---|---|---|---|---|---|---|---|---|---|---|---|
| SEQ ID | Construct_id | Orientation | delta | p-value | c | delta | p-value | c | delta | p-value | c | delta | p-value | c | delta | p-value | c |
| 502 | 72014 | SENSE | −0.038 | 0.94 | / | 0.07 | 0.278 | / | 0.732 | 0.06 | T | −0.026 | 0.584 | / | −0.013 | 0.596 | / |
| 503 | 72051 | SENSE | 0.026 | 0.28 | / | 0.311 | 0.003 | S | 0.222 | 0.236 | / | 0.453 | 0.009 | S | 0.052 | 0.168 | T |
| 432 | 70217 | SENSE | −0.202 | 0.893 | / | 0.203 | 0.024 | S | −0.079 | 0.743 | / | 0.27 | 0.07 | T | −0.063 | 0.856 | / |
| 454 | 70354 | SENSE | 0.134 | 0.147 | T | −0.119 | 0.684 | / | 0.48 | 0.02 | S | −0.119 | 0.736 | / | 0.014 | 0.3 | / |
| 334 | 70417 | SENSE | −0.35 | 0.988 | / | −0.041 | 0.637 | / | 0.69 | 0.012 | S | −0.136 | 0.978 | / | 0.004 | 0.411 | / |
| 515 | 70435 | SENSE | 0.664 | 0.014 | S | 0.146 | 0.036 | S | 0.138 | 0.097 | T | 0.33 | 0.038 | S | 0.039 | 0.16 | T |
| 457 | 70465 | SENSE | −0.106 | 0.79 | / | / | / | / | 0.883 | 0.001 | S | −0.27 | 0.945 | / | −0.097 | 0.818 | / |
| 460 | 70852 | SENSE | 0.178 | 0.031 | S | 0.145 | 0.034 | S | −0.525 | 0.904 | / | −0.315 | 0.861 | / | −0.059 | 0.774 | / |
| 405 | 71508 | SENSE | 0.195 | 0.162 | T | 0.251 | 0.017 | S | −0.515 | 0.929 | / | −0.322 | 0.997 | / | −0.196 | 0.982 | / |
| 295 | 71835 | SENSE | 0.139 | 0.055 | T | 0.163 | 0.049 | S | 0.538 | 0.019 | S | 0.27 | 0.068 | T | 0 | 0.496 | / |
| 467 | 72432 | SENSE | 0.146 | 0.021 | S | 0.139 | 0.02 | S | 0.325 | 0.012 | S | 0.074 | 0.149 | T | −0.106 | 0.879 | / |
| 443 | 72453 | SENSE | 0.204 | 0.037 | S | 0.116 | 0.046 | S | −2.198 | 0.995 | / | 0.016 | 0.448 | / | −0.013 | 0.534 | / |
| 433 | 72711 | SENSE | 0.292 | 0.058 | T | 0.143 | 0.024 | S | −0.114 | 0.76 | / | −0.04 | 0.667 | / | −0.093 | 0.946 | / |
| 449 | 72969 | SENSE | 0.046 | 0.072 | T | −0.158 | 0.887 | / | 0.39 | 0.031 | S | 0.477 | 0.001 | S | 0.095 | 0.054 | T |
| 426 | 72987 | SENSE | 0.385 | 0.006 | S | / | / | / | 0.098 | 0.104 | T | 0.153 | 0.016 | S | 0.057 | 0.061 | T |
| 525 | 74022 | SENSE | 0.11 | 0.226 | / | −0.069 | 0.844 | / | 0.71 | 0.009 | S | −0.05 | 0.613 | / | −0.004 | 0.544 | / |
| 287 | 74251 | SENSE | −0.56 | 0.961 | / | −0.184 | 0.916 | / | 0.611 | 0.001 | S | 0.174 | 0.229 | / | −0.137 | 0.923 | / |
| 537 | 74507 | SENSE | 0.255 | 0.017 | S | 0.178 | 0.03 | S | 0.318 | 0.032 | S | 0.188 | 0.011 | S | 0.013 | 0.078 | T |
| 313 | 74512 | SENSE | −0.247 | 0.953 | / | 0.107 | 0.015 | S | −0.073 | 0.86 | / | 0.113 | 0.034 | S | 0.05 | 0.175 | T |

S: represents the transgenic plants showed statistically significant trait improvement as compared to the reference ($p < 0.05$)

T: represents data points not determined or the transgenic plants showed a trend of trait improvement compared to the reference with $p < 0.2$ /: represents the transgenic plants didn't show any alteration or had unfavorable change in traits examined as compared to the reference in the current dataset K. Limited Nitrogen Tolerance Screen Under low nitrogen conditions, *Arabidopsis* seedlings become chlorotic and have less biomass. This example sets forth the limited nitrogen tolerance screen to identify *Arabidopsis* plants transformed with the gene of interest that are altered in their ability to accumulate biomass and/or retain chlorophyll under low nitrogen condition.

T2 seeds were plated on glufosinate selection plates containing 0.5×N-Free Hoagland's T 0.1 mM $NH_4NO_3$ T 0.1% sucrose T 1% phytagel media and grown under standard light and temperature conditions. At 12 days of growth, plants were scored for seedling status (i.e., viable or non-viable) and root length. After 21 days of growth, plants were scored for visual color, seedling weight, number of green leaves, number of rosette leaves, root length and formation of flowering buds. A photograph of each plant was also taken at this time point.

The seedling weight and root length were analyzed as quantitative responses according to example 1M. The number green leaves, the number of rosette leaves and the flowerbud formation were analyzed as qualitative responses according to example 1L.

Table 14 provides a list of recombinant DNA constructs that improve low nitrogen availability tolerance in plants.

TABLE 14

| | | | Flowerbud formation | | | Number of green leaves | | | Root Length | | | Number of rosette leaves | | | Seedling Weight | | |
|---|---|---|---|---|---|---|---|---|---|---|---|---|---|---|---|---|---|
| Pep SEQ ID | Construct_id | Orientation | RS mean | p-value | c | RS mean | p-value | c | delta | p-value | c | RS mean | p-value | c | delta | p-value | c |
| 375 | 72963 | SENSE | 1.1 | 0.004 | S | 0.293 | 0.021 | S | −0.446 | 0.002 | S | −0.246 | 0.786 | / | 0.137 | 0.001 | S |
| 389 | 70437 | SENSE | −0.28 | 0.982 | / | −0.08 | 0.769 | / | 0.259 | 0.006 | S | 0.5 | 0.005 | S | 0.133 | 0.003 | S |
| 390 | 71633 | SENSE | 0.26 | 0.26 | / | 0.254 | 0.114 | T | −0.1 | 0.539 | / | 0.647 | 0.06 | T | 0.106 | 0.023 | S |
| 391 | 72948 | SENSE | 0.587 | 0.06 | T | 0.539 | 0.029 | S | −0.237 | 0.003 | S | 0.479 | 0.1 | T | 0.078 | 0.121 | T |
| 392 | 72519 | SENSE | 0.749 | 0.033 | S | 0.209 | 0.104 | T | −0.09 | 0.274 | / | 0.276 | 0.264 | / | 0.116 | 0.006 | S |
| 393 | 10475 | SENSE | 1.256 | 0.026 | S | 0.588 | 0.005 | S | −0.378 | 0.002 | S | 0.081 | 0.319 | / | 0.018 | 0.75 | / |
| 394 | 11120 | ANTI-SENSE | 0.795 | 0.033 | S | 0.608 | 0.015 | S | −0.45 | 0.001 | S | 0.287 | 0.106 | T | −0.041 | 0.387 | / |
| 395 | 19736 | SENSE | −0.24 | 0.907 | / | 0.355 | 0.033 | S | 0.014 | 0.864 | / | 0.64 | 0.006 | S | −0.075 | 0.005 | / |
| 396 | 71606 | SENSE | 0.605 | 0.088 | T | 0.176 | 0.11 | T | −0.033 | 0.708 | / | 1.239 | 0.005 | S | 0.133 | 0.002 | S |
| 397 | 71840 | SENSE | 0.408 | 0.235 | / | 0.879 | 0.006 | S | −0.137 | 0.248 | / | 0.524 | 0.032 | S | 0.066 | 0.198 | T |
| 398 | 74240 | SENSE | −0.06 | 0.602 | / | 0.13 | 0.076 | T | −0.107 | 0.306 | / | 0.714 | 0.034 | S | 0.108 | 0.002 | S |
| 399 | 74331 | SENSE | −0.44 | 1 | / | 0.054 | 0.203 | / | 0.132 | 0.055 | T | 1.045 | 0.021 | S | 0.134 | 0.003 | S |
| 400 | 74610 | SENSE | −0.59 | 1 | / | −0.08 | 0.922 | / | 0.289 | 0 | S | 1.241 | 0.017 | S | 0.137 | 0.001 | S |
| 401 | 75527 | SENSE | 0.242 | 0.228 | / | 0.376 | 0.028 | S | −0.183 | 0.045 | / | 0.352 | 0.083 | T | −0.005 | 0.8 | / |
| 316 | 71811 | SENSE | −0.45 | 0.91 | / | / | / | / | −0.112 | 0.202 | / | 0.438 | 0.014 | S | −0.054 | 0.161 | / |
| 505 | 72463 | SENSE | −0.16 | 0.976 | / | / | / | / | 0.112 | 0.109 | T | 0.366 | 0.024 | S | 0.13 | 0.006 | S |
| 351 | 75701 | SENSE | 0.736 | 0.048 | S | 0.07 | 0.861 | / | −0.4 | 0.018 | S | / | / | / | −0.109 | 0.193 | / |

S: represents the transgenic plants showed statistically significant trait improvement as compared to the reference ($p < 0.05$)

T: represents the transgenic plants showed a trend of trait improvement compared than the reference with $p < 0.2$ /: represents data points not determined or the transgenic plants didn't show any alteration or had unfavorable change in traits examined as compared to the reference in the current dataset L. Statistic analysis for qualitative responses Table 15 provides a list of responses that were analyzed as qualitative responses

TABLE 15

| response | Screen | categories (success vs. failure) |
|---|---|---|
| wilting response Risk Score | Soil drought tolerance screen | non-wilted vs. wilted |
| growth stage at day 14 | heat stress tolerance screen | 50% of plants reach stage1.03 vs. not |
| growth stage at day 14 | salt stress tolerance screen | 50% of plants reach stage1.03 vs. not |
| growth stage at day 14 | PEG induced osmotic stress tolerance screen | 50% of plants reach stage1.03 vs. not |
| growth stage at day 7 | cold germination tolerance screen | 50% of plants reach stage 0.5 vs. not |
| number of rosette leaves at day 23 | Shade tolerance screen | 5 leaves appeared vs. not |
| flower bud formation at day 23 | Shade tolerance screen | flower buds appear vs. not |
| leaf angle at day 23 | Shade tolerance screen | >60 degree vs. <60 degree |
| number of green leaves at day 21 | limited nitrogen tolerance screen | 6 or 7 leaves appeared vs. not |
| number of rosette leaves at day 21 | limited nitrogen tolerance screen | 6 or 7 leaves appeared vs. not |
| Flower bud formation at day 21 | limited nitrogen tolerance screen | flower buds appear vs. not |

Plants were grouped into transgenic and reference groups and were scored as success or failure according to criteria in Table 15. First, the risk (R) was calculated, which is the proportion of plants that were scored as of failure plants within the group. Then the relative risk (RR) was calculated as the ratio of R (transgenic) to R (reference). Risk score (RS) was calculated as $-\log_2^{RR}$. Subsequently the risk scores from multiple events for each transgene of interest were evaluated for statistical significance by t-test using S-PLUS statistical software (S-PLUS 6, Guide to statistics, Insightful, Seattle, Wash., USA). RS with a value greater than 0 indicates that the transgenic plants perform better than the reference. RS with a value less than 0 indicates that the transgenic plants perform worse than the reference. The RS with a value equal to 0 indicates that the performance of the transgenic plants and the reference don't show any difference.

M. Statistic Analysis for Quantitative Responses

Table 16 provides a list of responses that were analyzed as quantitative responses.

TABLE 16

| response | screen |
|---|---|
| seed yield | Soil drought stress tolerance screen |
| seedling weight at day 14 | heat stress tolerance screen |
| root length at day 14 | heat stress tolerance screen |
| seedling weight at day 14 | salt stress tolerance screen |
| root length at day 14 | salt stress tolerance screen |
| root length at day 11 | salt stress tolerance screen |
| seedling weight at day 14 | PEG induced osmotic stress tolerance screen |
| root length at day 11 | PEG induced osmotic stress tolerance screen |
| root length at day 14 | PEG induced osmotic stress tolerance screen |
| rosette area at day 8 | cold shock tolerance screen |
| rosette area at day28 | cold shock tolerance screen |
| difference in rosette area from day 8 to day 28 | cold shock tolerance screen |
| root length at day 28 | cold germination tolerance screen |
| seedling weight at day 23 | Shade tolerance screen |
| petiole length at day 23 | Shade tolerance screen |
| root length at day 14 | Early plant growth and development screen |
| Seedling weight at day 14 | Early plant growth and development screen |
| Rosette dry weight at day 53 | Late plant growth and development screen |
| rosette radius at day 25 | Late plant growth and development screen |
| seed dry weight at day 58 | Late plant growth and development screen |
| silique dry weight at day 53 | Late plant growth and development screen |
| silique length at day 40 | Late plant growth and development screen |
| Seedling weight at day 21 | Limited nitrogen tolerance screen |
| Root length at day 21 | Limited nitrogen tolerance screen |

The measurements (M) of each plant were transformed by $\log_2$ calculation. The Delta was calculated as $\log_2$M(transgenic)$-\log_2$M(reference). Subsequently the mean delta from multiple events of the transgene of interest was evaluated for statistical significance by t-test using S-PLUS statistical software (S-PLUS 6, Guide to statistics, Insightful, Seattle, Wash., USA). The Delta with a value greater than 0 indicates that the transgenic plants perform better than the reference. The Delta with a value less than 0 indicates that the transgenic plants perform worse than the reference. The Delta with a value equal to 0 indicates that the performance of the transgenic plants and the reference don't show any difference.

Example 2

Identification of Homologs

A BLAST searchable "All Protein Database" was constructed of known protein sequences using a proprietary sequence database and the National Center for Biotechnology Information (NCBI) non-redundant amino acid database (nr.aa). For each organism from which a DNA sequence provided herein was obtained, an "Organism Protein Database" was constructed of known protein sequences of the organism; the Organism Protein Database is a subset of the All Protein Database based on the NCBI taxonomy ID for the organism.

The All Protein Database was queried using amino acid sequence of cognate protein for gene DNA used in trait-improving recombinant DNA, i.e., sequences of SEQ ID NO: 240 through SEQ ID NO: 478 using "blastp" with E-value cutoff of 1e-8. Up to 1000 top hits were kept, and separated by organism names. For each organism other than that of the query sequence, a list was kept for hits from the query organism itself with a more significant E-value than the best hit of the organism. The list contains likely duplicated genes, and is referred to as the Core List. Another list was kept for all the hits from each organism, sorted by E-value, and referred to as the Hit List.

The Organism Protein Database was queried using amino acid sequences of SEQ ID NO: 270 through SEQ ID NO: 538 using "blastp" with E-value cutoff of 1e-4. Up to 1000 top hits were kept. A BLAST searchable database was constructed based on these hits, and is referred to as "SubDB". SubDB was queried with each sequence in the Hit List using "blastp" with E-value cutoff of 1e-8. The hit with the best E-value was compared with the Core List from the corresponding organism. The hit is deemed a likely ortholog if it belongs to the Core List, otherwise it is deemed not a likely ortholog and there is no further search of sequences in the Hit List for the same organism. Likely orthologs from a large number of distinct organisms were identified and are reported by amino acid sequences of SEQ ID NO: 539 to SEQ ID NO: 22568. The relationship of the homologs to the identified trait-improving genes on an amino acid sequence basis is found in Table 17 where the amino acid sequence of a protein encoded by a trait-improving DNA, e.g., SEQ ID NO:270, is followed by the amino acid sequences of protein encoded by homologous genes, e.g., SEQ ID NO:19844, 4248, 2761, 15944, etc. The source organism of each homolog is reported in the Sequence Listing.

TABLE 17

| Sequence IDs for homolog proteins | | | | | | | | | | | | |
|---|---|---|---|---|---|---|---|---|---|---|---|---|
| Seq ID NO: | homolog Seq ID NOs | | | | | | | | | | | |
| 270: | 19844 | 4248 | 2761 | 15944 | 11776 | 16144 | 10470 | 9742 | 6776 | 1010 | 2285 | 16333 |
| | 9154 | 20620 | 16454 | 20025 | 8388 | 10646 | 1208 | 6001 | 1706 | 2448 | 14768 | 10226 |
| | 12626 | 19846 | 9302 | 17295 | 17794 | 6354 | 5098 | 1789 | 6430 | 17749 | 821 | 10109 |
| | 7542 | 17855 | 15562 | 17462 | | | | | | | | |
| 271: | 1715 | 5418 | 7208 | 19338 | 7440 | 711 | 8113 | 17151 | 17592 | 18879 | 4807 | 8671 |
| | 9936 | 11315 | 10681 | 3177 | 10519 | 6830 | 13563 | 12162 | 15155 | 1860 | 18072 | 20945 |
| | 6715 | 15032 | 5192 | 10928 | | | | | | | | |
| 272: | 0 | | | | | | | | | | | |
| 273: | 13771 | 8553 | 4219 | 10043 | 10800 | 8345 | 17501 | 13569 | 954 | 17197 | 6188 | 3760 |
| | 13267 | 16169 | 8132 | 2667 | 11216 | 15637 | 4652 | 2270 | 10309 | 5708 | 18374 | 9446 |
| | 12844 | 7790 | 7569 | 4786 | 9725 | 14187 | 12859 | 16948 | 18626 | 13741 | 5525 | 7877 |
| | 4550 | 15544 | 9706 | 7616 | 14358 | 15163 | 13182 | 14560 | 16722 | 1129 | 1472 | 4261 |
| | 10693 | 20144 | 6437 | 21413 | 17893 | 17984 | 17116 | 9925 | 19953 | 20648 | 983 | 2837 |
| | 5663 | 2943 | 10465 | 1841 | 12497 | 6435 | 14763 | 13495 | 12676 | 7513 | 8363 | 16389 |
| | 8162 | 7945 | 14956 | 15029 | 12433 | 22241 | 16071 | 13003 | 16940 | 18847 | 12354 | 7732 |
| | 14013 | 5735 | 11505 | 8833 | 17658 | 16048 | 17609 | 575 | 6641 | 6331 | 3738 | 10842 |
| | 18927 | 21518 | 20097 | 14117 | 5309 | 13744 | 15880 | 19484 | 9648 | 22509 | 1221 | 15515 |
| | 6785 | 852 | 6466 | 17423 | 14164 | 658 | 8704 | 16710 | 19375 | 3306 | 14050 | 16883 |
| | 16322 | 1722 | 15481 | 13636 | 10680 | 6347 | 3552 | 8885 | 21794 | 17703 | 22557 | 14777 |
| | 21189 | 13711 | 3601 | 3968 | 3692 | 4003 | 20044 | 12943 | 19749 | 1865 | 6355 | 14902 |
| | 6137 | 22370 | 19468 | 10410 | 21460 | 10451 | 17175 | 20965 | 12916 | 1206 | 6796 | 11329 |
| | 9139 | 11008 | 10569 | 9058 | 7988 | 19743 | 20088 | 14111 | 8231 | 4522 | 18497 | 11952 |
| | 2866 | 15466 | 3609 | 2403 | 16796 | 13539 | 14806 | 5364 | 12620 | 20699 | 12940 | 15426 |
| | 4409 | 12452 | 5296 | 9156 | 629 | 12665 | 20947 | 3649 | 7530 | | | |
| 274: | 16167 | 5178 | 2412 | 10455 | 20036 | 11246 | 19666 | 6400 | 5573 | 22539 | 8547 | 21845 |
| | 2413 | 20290 | 4036 | 19351 | 5886 | 6071 | 17184 | 9738 | | | | |
| 275: | 14665 | 16694 | 12678 | 14928 | 21489 | 7918 | 1571 | 3959 | 2490 | 2517 | 14615 | 3788 |
| | 10022 | 16096 | 21248 | 13293 | 8541 | 13446 | 6120 | 4360 | 3812 | 15574 | 18938 | 19203 |
| | 2284 | 2215 | 10054 | 14052 | 9653 | 10183 | 17752 | 20776 | 4240 | 22343 | 8270 | 9192 |
| | 17217 | 7374 | 12141 | 20657 | 7674 | 6445 | 2522 | | | | | |
| 276: | 12496 | 3460 | 13599 | 7043 | 9150 | 1664 | | | | | | |
| 277: | 16949 | 9640 | 8150 | 2014 | 12188 | 5779 | 17876 | 14612 | 18293 | 11053 | 15958 | 15263 |
| | 18370 | 20984 | 13094 | 18734 | 7380 | 10318 | 21641 | 12737 | 13028 | 20561 | 7087 | 10686 |
| | 9894 | 7528 | 12573 | 16043 | 14846 | 20513 | 2802 | 8897 | 14716 | 10257 | 16407 | 2727 |
| | 6151 | 1484 | 6831 | 16916 | 10146 | 17756 | 13193 | 7670 | 15946 | 7750 | 9397 | 20046 |
| | 12547 | 5399 | 18644 | 11883 | 12531 | 12530 | 17188 | 2130 | 3805 | 17493 | 16821 | 10181 |
| | 3639 | 3934 | 1419 | 780 | | | | | | | | |
| 278: | 16531 | 9228 | 5799 | 19821 | 10980 | 17656 | 3449 | 19982 | 13335 | 20959 | 11238 | 13084 |
| | 10281 | 17610 | 19623 | 17614 | 9736 | 21375 | 19978 | 5859 | 4943 | 12390 | 18806 | 1349 |
| | 8759 | 21741 | 20400 | 13707 | 9170 | 15899 | 11361 | 4333 | 10631 | 12909 | 2136 | 12776 |
| | 20323 | 7676 | 5847 | 9065 | 19902 | 4545 | 6768 | 546 | 9246 | 14134 | 4442 | 20731 |
| | 9931 | 6700 | 8677 | 19305 | 4828 | 3655 | 17550 | 7579 | 21629 | 9044 | 19475 | 637 |
| | 4209 | 3519 | 3873 | 15884 | 12247 | 10177 | 1407 | 10312 | 15957 | 16955 | 17469 | 20241 |
| | 7267 | 21862 | 16864 | 22192 | 19599 | 6365 | 12324 | 10985 | 6424 | 6449 | 14564 | 3115 |
| | 14885 | 10603 | 911 | 18609 | 3359 | 7059 | 2851 | 5801 | 9613 | 8391 | 18695 | 7987 |
| | 14964 | 1081 | 15171 | 1312 | 14747 | 3060 | 13390 | 22115 | 5060 | 16536 | 19729 | 13468 |
| | 11109 | 21989 | 2230 | 9462 | 9096 | 18775 | 10721 | 11999 | 8340 | 16607 | 22199 | 8687 |
| | 3652 | 8147 | 22073 | 4090 | 3491 | 20506 | 7835 | 10890 | 6781 | 7839 | 14478 | 16371 |
| | 579 | 6442 | 9721 | 5423 | 2566 | 7876 | 17580 | 2023 | 13164 | 9424 | 14096 | 8115 |
| | 15304 | 14818 | 7282 | 6422 | 4841 | 10106 | 1075 | 12995 | 9297 | 21280 | 2309 | 895 |
| | 12373 | 5366 | 22159 | 4499 | 737 | 11369 | 4308 | 13974 | 2794 | 12771 | 16584 | 9250 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 6930 | 8792 | 10185 | 17718 | 13148 | 5054 | 22383 | 9674 | 9868 | 21546 | 15881 | 20000 |
| | 19029 | 4938 | 14024 | 15026 | 15535 | 16386 | 15402 | 21036 | 12653 | 9490 | 4170 | 11551 |
| | 3711 | 4179 | 18619 | 16370 | 14161 | 11294 | 9094 | 2689 | 21881 | | | |
| 279: | 13577 | 10344 | 17371 | 5840 | 13904 | 12689 | 11795 | 21912 | 17226 | 14519 | 8854 | 14229 |
| | 7998 | 8326 | 1400 | 16163 | 11785 | 10117 | 21511 | 21043 | 18205 | 2933 | 2043 | 22181 |
| | 21628 | 20090 | 18018 | 20578 | 19081 | 11011 | 4768 | 2834 | 4635 | 13475 | 6306 | 13119 |
| | 1671 | 21348 | 16926 | 20801 | 6361 | 4269 | 4366 | 15615 | 941 | 7046 | 3166 | 16526 |
| | 6250 | 4790 | 825 | 16541 | 14270 | 3574 | 8127 | 18015 | 13147 | 17950 | 15243 | 6671 |
| | 20662 | 3487 | 11787 | 6762 | 5488 | 7117 | 9417 | 15702 | 4859 | 20527 | 19240 | 17200 |
| | 7115 | 19523 | 12823 | 9115 | 11770 | 20530 | 4791 | 20334 | 11019 | 20645 | 14383 | 1914 |
| | 8945 | 15358 | 9347 | 2496 | 3098 | 11604 | 16441 | 19352 | 18451 | 12451 | 8877 | 15655 |
| | 791 | 12609 | 12588 | 19785 | 18328 | 8143 | 22185 | 1488 | 10212 | 14002 | 16826 | 11779 |
| | 1890 | 3879 | 20130 | 21633 | 20930 | 17222 | 2691 | 18852 | 7120 | 7853 | 644 | 21495 |
| | 14630 | 21041 | 5676 | 8447 | 16750 | 10436 | 4523 | 2686 | 8237 | 2948 | 13559 | 19008 |
| | 3686 | 18465 | 3895 | 7416 | 10170 | 18867 | 14574 | 1159 | | | | |
| 280: | 16310 | 3796 | 10205 | 19486 | 13581 | 11022 | 21960 | 15598 | 12604 | 9662 | 20210 | 21764 |
| | 8626 | 17323 | 11666 | 21316 | 6121 | 7438 | 982 | 2135 | 17499 | 12340 | 20711 | 6553 |
| | 10296 | 17874 | 914 | 17716 | 3723 | | | | | | | |
| 281: | 20551 | 21096 | 13717 | 4006 | 19762 | 10017 | 14425 | 17785 | 6291 | 3855 | 15232 | 11917 |
| | 21856 | 18564 | 19010 | 3910 | 13621 | 19087 | 670 | 10539 | 851 | 5698 | 9112 | 12694 |
| | 14218 | 11947 | 18104 | 21227 | 22348 | 14178 | 1862 | 9829 | 9325 | 14533 | 13149 | 8679 |
| | 17127 | 6507 | 10375 | 2782 | 3357 | 594 | 7548 | 9316 | 5728 | 7981 | 8022 | 13688 |
| | 1294 | 13817 | 21893 | 10781 | 5263 | 11292 | 5492 | 9542 | 8000 | 16102 | 6328 | 11687 |
| | 13695 | 15807 | 4068 | 3478 | 6486 | 13660 | 22165 | 17881 | 19166 | 3613 | 7013 | 6393 |
| | 15983 | 17688 | 5124 | 4243 | 19684 | 17008 | 12366 | 7161 | 20062 | 12194 | 15870 | 14385 |
| | 9124 | 9865 | 6211 | 628 | 6448 | 700 | 8869 | 17941 | 10697 | 21134 | 5586 | 4469 |
| | 21167 | 855 | 20538 | 9251 | 1036 | 10678 | 1977 | 17337 | 4575 | 19974 | 3520 | 10195 |
| | 14572 | 3870 | 21293 | 19011 | 12921 | 20120 | 11647 | 15054 | 13976 | 21163 | 20362 | 12988 |
| | 15636 | 2345 | 4740 | 3205 | 17504 | 1953 | 15208 | 16834 | 7654 | 15907 | 8961 | |
| 282: | 19261 | 3860 | 7076 | 12616 | 1790 | 4886 | 9735 | 12611 | 20478 | 4501 | 18874 | 7032 |
| | 18024 | 7225 | 4544 | 11443 | 2127 | 19283 | 7367 | 1338 | 4482 | 15213 | 20554 | 3826 |
| | 14978 | 21769 | 11755 | 4250 | 15506 | 20020 | 6593 | 1286 | 20750 | 18985 | 16069 | 4571 |
| | 22536 | 3773 | 11152 | 9745 | 13196 | 2190 | 8120 | 7914 | 16863 | 11987 | 16172 | 15399 |
| | 14422 | 12490 | 8076 | 17180 | 19067 | 14493 | 13105 | 16459 | 18285 | 15863 | 14085 | 18130 |
| | 11566 | 17352 | 20003 | 2995 | 5386 | 8757 | 19103 | 15685 | 20563 | 18739 | 20815 | 19454 |
| | 7820 | 20771 | 7972 | | | | | | | | | |
| 283: | 0 | | | | | | | | | | | |
| 284: | 10750 | 5276 | 3894 | 3486 | 12240 | 18158 | 12170 | 15393 | 9765 | 11266 | 5031 | 2792 |
| | 9334 | 20684 | 1144 | 13799 | 10858 | 16622 | 20849 | 22001 | 6897 | 17710 | 15401 | 18589 |
| | 9550 | 1757 | 10249 | 21993 | 2001 | 19689 | 15058 | 4297 | 19990 | 643 | 11414 | 18208 |
| | 19995 | | | | | | | | | | | |
| 285: | 17916 | 15231 | 15741 | 15829 | 4645 | 21977 | 10291 | 1806 | 21573 | 474 | 6018 | 2663 |
| | 8036 | 9618 | 16693 | 3960 | 15864 | 14578 | 17125 | 15924 | 21826 | 13440 | 17249 | 8650 |
| | 20159 | 1986 | 15742 | 19706 | 22092 | 8766 | 6813 | 17830 | 10853 | 21281 | 13394 | 5285 |
| | 8139 | 21004 | 14220 | 17563 | 2086 | 2488 | 1597 | 4698 | 13233 | 4654 | 1250 | 15737 |
| | 2907 | 1469 | 9957 | 13288 | 6516 | 22526 | 16496 | 14873 | 10471 | 18290 | 3086 | 11953 |
| | 18592 | 3185 | 9418 | 17135 | 8081 | 9593 | 19180 | 4673 | 7979 | 16544 | 13933 | 1300 |
| | 16782 | 15551 | 8460 | 15960 | 3405 | 13997 | 1566 | 21046 | 8636 | 17134 | 6512 | 6596 |
| | 13346 | 15639 | 14396 | 9252 | 12093 | 21591 | 15042 | 6953 | 18637 | 16784 | 22523 | 6262 |
| | 16933 | 22448 | 4612 | 19863 | 6076 | 4133 | 19601 | 3344 | 12192 | 16828 | 17089 | 19303 |
| | 6118 | 15088 | 14986 | 21070 | 771 | 3291 | 2153 | 21234 | 18173 | 11970 | 21215 | 10644 |
| | 20638 | 4377 | 21183 | 9519 | 13810 | 10948 | 17764 | 3781 | 21029 | 16613 | 18091 | 6526 |
| | 5846 | 22213 | 22003 | 20765 | 3801 | 21866 | 21771 | 14860 | 861 | 6743 | 5007 | 5529 |
| | 14267 | 14880 | 21391 | 10210 | 5693 | 5970 | 3793 | 15855 | 1007 | 13001 | 6878 | 9875 |
| | 16912 | 19329 | 13614 | 10333 | 13714 | 6903 | 21112 | 8204 | 1133 | 21262 | 16852 | 15703 |
| | 21338 | 6248 | 21547 | 15242 | 13567 | 16788 | 11020 | 18655 | 10528 | 19496 | 17440 | 22414 |
| | 17480 | 8142 | 7760 | 20388 | 2829 | 16249 | 12914 | 2569 | 14595 | 7096 | 6689 | 12534 |
| | 6105 | 16041 | 9242 | 9145 | 1552 | 10313 | 1379 | 9596 | 11771 | 5820 | 593 | 15445 |
| | 3268 | 14744 | 18410 | 6984 | 10872 | 10053 | 9713 | 8837 | 1383 | 4305 | 10421 | 2944 |
| | 20363 | 19120 | 7463 | 16753 | 20969 | 18430 | 12905 | 10227 | 11066 | 6057 | 13677 | 18640 |
| | 4083 | 1527 | 19285 | 5385 | 17557 | 20851 | 15693 | 17304 | 1683 | 14391 | 15965 | 19854 |
| | 8425 | 14916 | | | | | | | | | | |
| 286: | 16099 | 8075 | 8242 | 429 | 13036 | 10217 | 18174 | 507 | 11062 | 15313 | 16399 | 14594 |
| | 3820 | 5216 | 5717 | 10394 | 20464 | 15374 | 15526 | 18461 | 17556 | 14810 | 4502 | 12391 |
| | 11462 | 14924 | 1652 | 18690 | 9504 | 13188 | 8137 | 3327 | 12056 | 2537 | 4030 | 1064 |
| | 15390 | 6367 | 19001 | 8581 | 6859 | 7602 | 14778 | 7681 | 18172 | 18107 | 12112 | 7417 |
| | 13896 | 2465 | 12130 | 19906 | 4949 | 17359 | 16220 | 13607 | 526 | 20229 | 16469 | 10705 |
| | 15889 | 16978 | 8246 | 16554 | 18467 | 9002 | 9780 | 17882 | 21655 | 20242 | 21051 | 3977 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 19627 | 9063 | 10810 | 15051 | 5705 | 9204 | 11991 | 9915 | 15840 | 16148 | 14589 | 6171 |
| | 6614 | 20389 | 6007 | 6226 | 5373 | 19830 | 9030 | 14898 | 11912 | 16971 | 18279 | 19602 |
| | 13078 | 18533 | 1840 | 4491 | 7812 | 8977 | 13027 | 6371 | 15170 | 21310 | 6443 | 9755 |
| | 12535 | 2819 | 14876 | 3052 | 12267 | 8377 | 3804 | 7983 | 22450 | 22167 | 22369 | 21674 |
| | 891 | 13549 | 7113 | 14532 | 11064 | 9354 | 7858 | 8394 | 2489 | 17243 | 2044 | 9345 |
| | 6836 | 2341 | 19148 | 17763 | 13516 | 14240 | 9032 | 15489 | 8304 | 7822 | 17083 | 9993 |
| | 8188 | 5481 | 11010 | 1093 | 7789 | 21699 | 21306 | 11113 | 8956 | 18128 | 7880 | 3416 |
| | 2857 | 17664 | 21589 | 11961 | 19154 | 11542 | 4812 | 7486 | 21609 | 5307 | 21506 | 3533 |
| | 6663 | 4677 | 18511 | 4730 | 696 | 9569 | 17797 | 18687 | 7097 | 20259 | 15252 | 13221 |
| | 3425 | 3261 | 450 | 6778 | 14692 | 22502 | 14915 | 21157 | 20371 | 3563 | 12591 | 16308 |
| | 7626 | 4212 | 19798 | 16130 | 21296 | 2832 | 830 | 14553 | 14135 | 6434 | 18295 | 17956 |
| | 20230 | 476 | 10392 | 12043 | 3289 | 20779 | 1281 | 17745 | 21065 | 5487 | 3754 | 8587 |
| | 2882 | 12578 | 11548 | 12705 | 15830 | 16586 | 7955 | 15449 | 988 | 20859 | 1768 | 11129 |
| | 6547 | 22518 | 5552 | 9854 | 11376 | 6669 | 5359 | 9132 | 10964 | 22087 | 1879 | 17298 |
| | 13137 | 3333 | 20301 | 13752 | 19370 | 2425 | 6946 | 19538 | 14273 | 8003 | 15340 | 6427 |
| | 17165 | 15603 | 12419 | 10809 | 13658 | 14064 | 4221 | 7387 | 3386 | 13284 | 20981 | 2316 |
| | 3116 | 8418 | 3578 | 6508 | 18217 | 992 | 22249 | 14855 | 13442 | 3471 | 19949 | 5277 |
| | 19885 | 2816 | 10917 | 21954 | 9436 | 18538 | 18659 | 12816 | 12308 | 20364 | 15943 | 2649 |
| | 2515 | 14701 | 9329 | 8193 | 17579 | 22076 | 8890 | 21073 | 8376 | 15177 | 10882 | 859 |
| | 5990 | 9814 | 16053 | 12078 | 3144 | 5209 | 13848 | 22428 | 19076 | 9604 | 5454 | 3141 |
| | 17056 | 14918 | 953 | 4088 | 6615 | 15729 | 11270 | 5837 | 14568 | 12544 | 17630 | 2371 |
| | 4694 | 12396 | 15369 | 16597 | 3697 | 10741 | 13396 | 21621 | 16662 | 8841 | 11120 | 14081 |
| | 13456 | 21472 | 7487 | 12898 | 12787 | 7866 | 11748 | 8692 | 9484 | 2336 | 15204 | 6565 |
| | 14320 | 2978 | 9294 | 7482 | 9493 | 1277 | 4576 | 15513 | 21001 | 3242 | 4952 | 7813 |
| | 7306 | 12296 | 12021 | 6645 | 21060 | 9286 | 22489 | 6264 | 13745 | 16653 | 19069 | 7780 |
| | 15219 | 16969 | 9271 | 18873 | 14762 | 10802 | 10479 | 16663 | 3678 | 16713 | 7751 | 13703 |
| | 3630 | 4691 | 9472 | 10709 | 8542 | 7060 | 6112 | 22457 | 21974 | 20476 | 7333 | 6482 |
| | 14526 | 7151 | 2644 | 835 | 10655 | 12264 | 17372 | 788 | 15452 | 14361 | 11678 | 2754 |
| | 15289 | 14415 | 9468 | 1673 | 2117 | 17672 | 3643 | 6809 | 9280 | 22095 | 18903 | 3706 |
| | 15256 | 18593 | 5764 | 11115 | 12583 | 11568 | 622 | 13613 | 2331 | 5136 | 8073 | 15998 |
| | 5630 | 10889 | 9673 | 9014 | 7950 | 6748 | 9771 | 11716 | 18929 | 14842 | 6789 | 1773 |
| | 981 | 18575 | 19878 | 21485 | 14269 | 9584 | 12794 | 21399 | 20485 | 9218 | 18691 | 3350 |
| | 18263 | 4846 | 544 | 19667 | 9933 | 4140 | 1318 | 20418 | 11128 | 20105 | 16734 | 2376 |
| | 15699 | 7061 | 4232 | 15357 | 14036 | 5339 | 7107 | 19030 | 7165 | 21370 | 12103 | 4848 |
| | 13211 | 22530 | 15360 | 12863 | 9975 | 6398 | 14067 | 16683 | 21170 | 1924 | 890 | 8155 |
| | 15866 | 10131 | 7187 | 4332 | 1235 | 20330 | 12927 | 7088 | 5099 | 2302 | 12424 | 8303 |
| | 17466 | 14322 | 11383 | 2282 | 14043 | 15956 | 1818 | 3414 | 12982 | 18548 | 15665 | 10961 |
| | 21084 | 10824 | 18440 | 16819 | 3730 | 13940 | 18821 | 14864 | 19607 | 7969 | 6546 | 16771 |
| | 5441 | 8459 | 18266 | 5000 | 15749 | 13014 | 14274 | 8444 | 4707 | 13097 | 15930 | 6281 |
| | 18662 | 7992 | 9661 | 19875 | 11156 | 3619 | 14086 | 20948 | 16946 | 3456 | 6143 | 6097 |
| | 786 | 6709 | 13766 | 5954 | 9650 | 17926 | 9083 | 20839 | 17473 | 5462 | 22351 | 12788 |
| | 5453 | 13277 | 11817 | 9672 | 8255 | 6463 | 15113 | 9053 | 15528 | 1319 | 926 | 17317 |
| | 6368 | 7704 | 18694 | 3644 | 12154 | 3794 | 21257 | 21638 | 18386 | 18111 | 21498 | 10731 |
| | 13776 | 5539 | 14530 | 20282 | 7762 | 9529 | 17675 | 15191 | 12380 | 14865 | 15825 | 2818 |
| | 16442 | 10262 | 10965 | 15558 | 5973 | 22476 | 19408 | 5773 | 5016 | 20819 | 18982 | 19997 |
| | 4572 | 640 | 19168 | 17905 | 2970 | 2132 | 20312 | 4655 | 16568 | 21093 | 13882 | 5730 |
| | 7976 | 7079 | 13035 | 3505 | 2800 | 12522 | 8939 | 11219 | 2155 | 15905 | 3206 | 2017 |
| | 15587 | 6277 | 1297 | 1423 | 9549 | 6119 | 18728 | 12545 | 2037 | 11704 | 9571 | 21379 |
| | 13089 | 11197 | 13107 | 22367 | 2420 | 17943 | 7599 | 5997 | 1801 | 21374 | 16528 | 8722 |
| | 16672 | | | | | | | | | | | |
| 287: | 8532 | 19537 | 5344 | 9149 | 21995 | 6924 | 15909 | 4097 | 11901 | 8844 | 7649 | 2133 |
| | 2202 | 5183 | 18294 | 19005 | 11338 | 19082 | 14317 | | | | | |
| 288: | 19787 | 18784 | 5642 | 15617 | 18773 | 2850 | 21740 | 18774 | 8659 | 17768 | 4774 | 15786 |
| | 13450 | 5349 | 3435 | 11594 | 3337 | 19500 | 18011 | 5026 | 20455 | 17036 | 22287 | 17395 |
| | 9621 | 6514 | 1386 | 11394 | 7035 | 21823 | 15347 | 11387 | 15362 | 4210 | 5017 | 10279 |
| | 19441 | 22361 | 7943 | 7642 | 8141 | 16188 | 15181 | 3603 | 7428 | 2749 | 21346 | 17018 |
| | 10086 | | | | | | | | | | | |
| 289: | 652 | 22063 | 8339 | 21393 | 2555 | 8373 | 21778 | 11080 | 15895 | 10755 | 10659 | 16023 |
| | 19651 | 17328 | 17996 | 10829 | | | | | | | | |
| 290: | 7684 | 9445 | 17343 | 1187 | 6793 | 10461 | 6245 | 10467 | 20367 | 12284 | | |
| 291: | 19558 | 4465 | 12410 | 21267 | 12416 | | | | | | | |
| 292: | 13619 | 7334 | 20532 | 21542 | 12253 | 16189 | 8764 | 2507 | 21921 | 6586 | 19095 | 9485 |
| | 5381 | 5599 | 12372 | 14529 | 13331 | 15295 | 19004 | 1397 | 21520 | 14556 | 20510 | 22236 |
| | 2986 | 7080 | 8521 | 6732 | 13272 | 16558 | 4313 | 20499 | 22483 | 14588 | 9523 | 7470 |
| | 18752 | 12181 | 20429 | 12348 | 695 | 10907 | 14321 | 14033 | 18144 | 3919 | 8802 | 20993 |
| | 8165 | 3312 | 17714 | 14662 | 16218 | 6883 | 15696 | 5826 | 8318 | 13408 | 11637 | 4264 |
| | 1882 | 4226 | 19194 | 12589 | 20866 | 1376 | 21972 | 8106 | 9328 | 11225 | 6391 | 8315 |
| | 20980 | 16513 | 6488 | 21387 | 10825 | 871 | 22553 | 7860 | 20986 | 5123 | 7178 | 8148 |
| | 19174 | 5633 | 3500 | 7737 | 17944 | 19517 | 19101 | 2424 | 1678 | 1758 | 16439 | 22408 |
| | 11623 | 7905 | 18353 | 18641 | 17321 | 18471 | 6775 | 8307 | 11843 | 9722 | 15205 | 20080 |

TABLE 17-continued

Sequence IDs for homolog proteins

| Seq ID NO: | homolog Seq ID NOs | | | | | | | | | | |
|---|---|---|---|---|---|---|---|---|---|---|---|
| | 16600 | 6416 | 10161 | 8449 | 8858 | 14419 | 19903 | 14156 | 15652 | 13343 | 15817 | 3739 |
| | 12654 | 14241 | 7430 | 8851 | 6919 | 22017 | 6531 | 1962 | 3371 | 18557 | 2125 | 6815 |
| | 15392 | 19947 | 6480 | 15023 | 1479 | 1138 | 21122 | 20521 | 21201 | 1677 | 17815 | 9610 |
| | 8319 | 5949 | 7617 | 10353 | 9342 | 4915 | 6495 | 1682 | 14875 | 17940 | 1204 | 13538 |
| | 16452 | 19603 | 8029 | 2886 | 14466 | 19507 | 12125 | 6822 | 10351 | 4123 | 9222 | 9605 |
| | 18244 | 18276 | 17153 | 17212 | 12619 | 14496 | 11337 | 8683 | 15935 | 10084 | 14862 | 5228 |
| | 2090 | 99138 | 702 | 17034 | 5542 | 16281 | 16905 | 2247 | 17007 | 15480 | 13602 | 16745 |
| | 3223 | 6163 | 1245 | 10228 | 21595 | 18522 | 6698 | 5750 | 8543 | 21981 | 15735 | 3961 |
| | 16417 | | | | | | | | | | | |
| 293: | 10002 | 18611 | 6406 | 14073 | 5127 | 8351 | 1241 | 12550 | 10077 | 11772 | 10606 | 3231 |
| | 10112 | 15857 | 13002 | 6686 | 8210 | 8327 | 4270 | 16125 | 8696 | 5110 | 12311 | 7006 |
| | 19199 | 6994 | 12597 | 5342 | 12722 | 21575 | 5723 | 2670 | 6046 | 12012 | | |
| 294: | 9532 | 10331 | 15934 | 2046 | 6293 | 19503 | 22316 | 15147 | 14129 | 5699 | 7047 | 13130 |
| | 2151 | 1110 | 20162 | 9143 | 9176 | 4233 | 8431 | 6088 | 7434 | 18942 | 5356 | 18099 |
| | 10361 | 3212 | 21551 | 20873 | 2419 | 8077 | 3140 | 13009 | 21068 | 6829 | 20236 | 14326 |
| | 6208 | 847 | 2330 | 15785 | 1052 | 14929 | 4869 | 4567 | 16757 | 19546 | 10070 | 1727 |
| | 6317 | 8558 | 3880 | 18261 | 6409 | 6931 | 17666 | 21501 | 12516 | 16760 | 16947 | 3896 |
| | 3358 | 6554 | 14909 | 1974 | 4835 | 20560 | 11275 | 2659 | 12987 | 18209 | 16896 | 15952 |
| | 20752 | 15130 | 15569 | 7406 | 13923 | 1051 | 11602 | 3912 | 10042 | 4592 | 22204 | 2430 |
| | 1382 | 18088 | 15862 | 20314 | 9057 | 10845 | 5041 | 7582 | 21742 | 12835 | 17242 | 15658 |
| | 8522 | 22493 | 7831 | 1594 | 13654 | 7414 | 12151 | 12808 | 14165 | 15368 | 17979 | 10215 |
| | 8018 | 22247 | 22220 | 7254 | 654 | 20380 | 2845 | 5061 | 7274 | 5018 | 9568 | 9818 |
| | 1494 | 3725 | 11235 | 6804 | 8938 | 12700 | 17001 | 19302 | 11190 | 4028 | 3173 | |
| 295: | 21192 | | | | | | | | | | | |
| 296: | 10114 | 6052 | 18680 | 17170 | 11936 | 20081 | 9148 | 3938 | 18585 | 12840 | 14672 | 14951 |
| | 1544 | 20775 | 4870 | 8723 | 3360 | 19138 | 1416 | 1901 | 18744 | 2625 | 951 | 6936 |
| | 16543 | 3550 | 9203 | 11070 | 9360 | 21434 | 3920 | 1693 | 10869 | 11881 | 12895 | 1003 |
| | 5405 | 14684 | 21089 | 14531 | 21626 | 20145 | 17875 | 7549 | 2428 | 2613 | 18036 | 1421 |
| | 18003 | 6973 | 20577 | 12790 | 22102 | 3375 | 13691 | 15302 | 6589 | 15430 | 18154 | 16596 |
| | 19645 | 21006 | 17187 | 14709 | 19975 | 1854 | 17428 | 11844 | 10033 | 1792 | 934 | 845 |
| | 5533 | 21419 | 6582 | 2314 | 19307 | 8902 | 8278 | 20861 | 7030 | 10654 | 9636 | 16002 |
| | 2969 | 15306 | 5928 | 1894 | 592 | 13534 | 4985 | 5623 | 5150 | 2342 | 22174 | 1686 |
| | 2688 | 10718 | 20383 | 19440 | 19860 | 618 | 22308 | 10355 | 12565 | 8585 | 15993 | 12725 |
| | 22563 | 5578 | 14369 | 13712 | 9428 | 20205 | 10767 | 1546 | 5387 | 8364 | 18905 | 18948 |
| | 2545 | 17156 | 20131 | 22338 | 2223 | 7037 | 15860 | 5111 | 16844 | 14702 | 1634 | 13698 |
| | 16173 | 17860 | 16802 | 21238 | 20479 | 18313 | 18815 | 16556 | 12453 | 18481 | 19778 | 12153 |
| | 19470 | 20701 | 1477 | 19657 | 2220 | 5033 | 6117 | 12286 | 12326 | 6566 | 16110 | 13469 |
| | 17077 | 20231 | 4058 | 9834 | 3780 | 19094 | 6308 | 9548 | 1549 | 21687 | 13080 | 7340 |
| | 18746 | 2266 | 11139 | 2005 | 14735 | 5543 | 4941 | 2921 | 8468 | 19501 | 3139 | 16192 |
| | 10723 | 6333 | 11355 | 3845 | 11452 | 19385 | 14092 | 1395 | 5545 | 2216 | 10682 | 21311 |
| | 15661 | 21100 | 2597 | 9008 | 17498 | 17514 | 9946 | 20269 | 5669 | 5062 | 15447 | |
| | | | 14697 | | | | | | | | | |
| | 2775 | 6975 | 12793 | 12639 | 8185 | 19766 | 8932 | 4278 | 14889 | 4981 | 22471 | 5952 |
| | 6818 | 16336 | 21140 | 14098 | 21953 | 4979 | 13968 | 16410 | 18878 | 9696 | 4978 | 16146 |
| | 2609 | 22097 | 16986 | 20921 | 22527 | 16920 | 18126 | 16034 | 5362 | 933 | 15779 | 16770 |
| | 1772 | 9517 | 6866 | 16982 | 19232 | 19937 | | | | | | |
| 297: | 9912 | 18441 | 5938 | 12696 | 19188 | 22233 | 2840 | 10426 | 16052 | 9508 | 12778 | 15536 |
| | 19286 | 9563 | 19034 | 20209 | 15518 | 6498 | 21608 | 11026 | 14044 | 10165 | 12621 | 12028 |
| | 16923 | 21297 | 5646 | 16170 | 12477 | 16660 | 1378 | 2624 | 3809 | 12760 | 16057 | 7256 |
| | 15500 | 18959 | 10317 | 10326 | 5977 | 4830 | 1143 | 1499 | 10983 | 2571 | 15543 | 13839 |
| | 12370 | 9041 | 1331 | 8508 | 16831 | 13832 | 4303 | 18599 | 21584 | 9787 | 1548 | 8292 |
| | 1560 | 18466 | 11683 | 17762 | 17468 | 9815 | 4374 | 18826 | 20637 | 18709 | 16467 | 7307 |
| | 16512 | 904 | 18899 | 17113 | 10700 | 5006 | 22084 | 5463 | 20856 | 18792 | 1535 | 13608 |
| | 11312 | 8634 | 19381 | 11435 | 870 | 7232 | 5079 | 6299 | 13314 | 10487 | 15382 | 14552 |
| | 14878 | 20590 | 14820 | 7911 | 8924 | 12070 | 7581 | 2122 | 18063 | 8338 | 12227 | 14479 |
| | 3229 | 17500 | 9776 | 16213 | 12767 | 17455 | 5438 | 1839 | 4649 | | | |
| | | | | | | | | 9982 | | | | |
| 298: | 18555 | 7838 | 6652 | 1982 | 15254 | 2218 | 6543 | 13709 | 5154 | 14481 | 4355 | 8406 |
| | 21382 | 21663 | 19102 | | | | | | | | | |
| 299: | 19421 | 10037 | 3803 | 5108 | 3343 | 20336 | 11002 | 8946 | 12661 | 9168 | 15378 | 18020 |
| | 16075 | 5607 | 19118 | 22336 | 19724 | 8555 | 2295 | 21579 | 1259 | 8494 | 18083 | 960 |
| | 13560 | 20787 | 22477 | 19264 | 6401 | 8583 | 9620 | 5248 | 701 | 10759 | 22290 | 2593 |
| | 21024 | 17543 | 1417 | 15845 | 17793 | 18019 | 6222 | 10575 | 1775 | 8903 | 15288 | 2885 |
| | 7993 | 20494 | 10001 | 13641 | 11853 | 614 | 12502 | 13330 | 17952 | 13069 | 9420 | 1771 |
| | 17636 | 13434 | 5588 | 2165 | 19494 | 4998 | 1751 | 16904 | 10306 | 3123 | 12413 | 16515 |
| | 21706 | 9144 | 19364 | 2394 | 2677 | 15207 | 13710 | 9045 | 11258 | 1042 | 11230 | 13140 |
| | 18738 | 15056 | 11058 | 930 | 22417 | 8107 | 16349 | 7322 | 16450 | 15822 | 16451 | 6646 |
| | 18926 | 2197 | 302 | 8630 | 17924 | 14996 | 19753 | 4515 | 10245 | 7300 | 6710 | 21723 |
| | 12990 | 8111 | 14791 | 13977 | 19581 | 12911 | 22090 | 603 | 15053 | 14851 | 21092 | 14284 |
| | 20327 | 13846 | 9587 | 21947 | 7441 | 12133 | 14923 | 3660 | 13939 | 6002 | 5590 | 11909 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 22216 | 4929 | 14884 | 9941 | 9040 | 12896 | 7903 | 21683 | 11508 | 22006 | 11550 | 5658 |
| | 2777 | 9977 | 15523 | 5791 | 21963 | 16141 | 18240 | 5322 | 2499 | 19702 | 9292 | 20325 |
| | 5274 | 9028 | 10531 | 1688 | 20146 | 5153 | 7485 | 18445 | 4165 | 5614 | 10277 | 16781 |
| | 4563 | 3161 | 6533 | 5957 | 7089 | 2687 | 7105 | 21351 | 21515 | 22453 | 19592 | 7173 |
| | 1968 | 19358 | 11469 | 8780 | 17266 | 7586 | 12142 | 3066 | 7281 | 14577 | 9430 | 3270 |
| | 13924 | 12341 | 15761 | 12637 | 10962 | 2998 | 19035 | 4877 | 659 | 9821 | 20906 | 12168 |
| | 1736 | 20717 | 2543 | 16421 | 1821 | 18042 | 14352 | 15050 | 8399 | 19775 | 21325 | 7525 |
| | 17680 | 18001 | 19979 | 18487 | 6598 | 5555 | 10444 | 21216 | 21128 | 8987 | 1493 | 17533 |
| | 16118 | 1639 | 12595 | 6855 | 22098 | 18912 | 3290 | 5745 | 6378 | 9285 | 11287 | 14670 |
| | 11840 | 9243 | 9669 | 14995 | 13742 | 20118 | 9371 | 11429 | 12747 | 19245 | 1590 | 13573 |
| | 3695 | 20005 | 2712 | 20008 | 9988 | 1732 | 20129 | 19987 | | | | |
| 300: | 16422 | 16652 | 2702 | 1006 | 429 | 10217 | 533 | 507 | 306 | 535 | 478 | 10780 |
| | 18650 | 18461 | 13998 | 11343 | 7459 | 5240 | 10390 | 15192 | 6367 | 19001 | 17659 | 17306 |
| | 18166 | 3899 | 19411 | 17674 | 6453 | 14183 | 9624 | 20799 | 11585 | 14626 | 21314 | 12049 |
| | 7812 | 18212 | 3745 | 13797 | 8320 | 4940 | 22404 | 21496 | 12527 | 18023 | 6674 | 2559 |
| | 15926 | 17879 | 9075 | 14547 | 21758 | 1689 | 16481 | 15621 | 18121 | 13519 | 12731 | 5774 |
| | 10662 | 11761 | 10902 | 17148 | 12381 | 2857 | 17664 | 21589 | 11961 | 19154 | 6201 | 21437 |
| | 11195 | 20933 | 21506 | 3533 | 4677 | 18511 | 4730 | 696 | 9569 | 17797 | 18687 | 7097 |
| | 20259 | 15252 | 13221 | 450 | 11335 | 20777 | 12713 | 22502 | 14915 | 21157 | 20371 | 3563 |
| | 12591 | 16308 | 7626 | 4212 | 19798 | 19458 | 5691 | 18292 | 16130 | 21296 | 2832 | 830 |
| | 14553 | 6434 | 18295 | 17956 | 829 | 12043 | 20779 | 1281 | 17745 | 1768 | 6547 | 16586 |
| | 7955 | 12705 | 11376 | 15449 | 988 | 20859 | 11129 | 22518 | 5552 | 9854 | 6669 | 5359 |
| | 9132 | 10964 | 1879 | 22087 | 13137 | 17298 | 3333 | 13752 | 20301 | 19370 | 2425 | 6946 |
| | 19538 | 14273 | 17165 | 15340 | 6427 | 15603 | 12419 | 10809 | 8003 | 13658 | 14064 | 4221 |
| | 7387 | 13284 | 20981 | 2316 | 3116 | 8418 | 3578 | 3386 | 6508 | 18217 | 22249 | 992 |
| | 13442 | 3471 | 14855 | 19949 | 5277 | 19885 | 2816 | 10917 | 9436 | 18538 | 18659 | 12816 |
| | 12308 | 15943 | 2515 | 20364 | 14701 | 8193 | 17579 | 22076 | 8890 | 2649 | 9329 | 21073 |
| | 8376 | 15177 | 10882 | 859 | 5990 | 9814 | 16053 | 5209 | 3144 | 13848 | 22428 | 19076 |
| | 5454 | 17056 | 14918 | 4088 | 11270 | 5837 | 9604 | 22455 | 19840 | 801 | 12234 | 21301 |
| | 1149 | 953 | 9960 | 1656 | 3755 | 12278 | 22119 | 21098 | 1005 | 10264 | 13037 | 11702 |
| | 20954 | 5581 | 5063 | 1118 | 6454 | 20632 | 1696 | 19474 | 14911 | 9381 | 4111 | 13374 |
| | 2932 | 3071 | 18551 | 22362 | 1431 | 12923 | 6509 | 19229 | 14012 | 5372 | 12362 | 17380 |
| | 20272 | 16391 | 13395 | 5132 | 901 | 9540 | 19228 | 14568 | 17630 | 2371 | 4694 | 12396 |
| | 15369 | 16597 | 3697 | 10741 | 16309 | 4927 | 13396 | 21621 | 8841 | 16662 | 11120 | 14081 |
| | 8692 | 9484 | 15204 | 6565 | 14320 | 2978 | 9294 | 7482 | 9493 | 1277 | 4952 | 7813 |
| | 7306 | 12296 | 12021 | 6645 | 9286 | 22489 | 13745 | 16653 | 19069 | 7780 | 15219 | 16969 |
| | 14762 | 18330 | 10802 | 10479 | 16663 | 3678 | 16713 | 7751 | 13703 | 3630 | 4691 | 9472 |
| | 10709 | 8542 | 7060 | 6112 | 22457 | 21974 | 20476 | 7333 | 6482 | 14526 | 7151 | 2644 |
| | 835 | 10655 | 12264 | 9315 | 2786 | 16253 | 9488 | 5634 | 17372 | 788 | 9280 | 22095 |
| | 18903 | 3706 | 15256 | 18593 | 5764 | 11115 | 12583 | 11568 | 13613 | 2331 | 5136 | 8073 |
| | 15998 | 5630 | 11304 | 19137 | 5817 | 5580 | 18341 | 8588 | 12540 | 2454 | 4970 | 17445 |
| | 2401 | 11869 | 6193 | 21516 | 10889 | 5190 | 13207 | 16465 | 9673 | 9771 | 11716 | 18575 |
| | 9584 | 12794 | 21399 | 20485 | 9218 | 18691 | 3350 | 18263 | 4846 | 544 | 19667 | 9933 |
| | 4140 | 1318 | 20418 | 11128 | 20105 | 16734 | 2376 | 15699 | 7061 | 4232 | 15357 | 14036 |
| | 5339 | 7107 | 19030 | 7165 | 21370 | 12103 | 4848 | 13211 | 22530 | 15360 | 12863 | 9975 |
| | 6398 | 14067 | 16683 | 21170 | 1924 | 890 | 8155 | 15866 | 10131 | 7187 | 4332 | 1235 |
| | 20330 | 12927 | 7088 | 5099 | 2302 | 12424 | 8303 | 17466 | 14322 | 11383 | 2282 | 15956 |
| | 3414 | 12982 | 18548 | 15665 | 10961 | 21084 | 10824 | 18440 | 16819 | 3730 | 13940 | 18821 |
| | 14864 | 1818 | 19607 | 7969 | 6546 | 16771 | 5441 | 8459 | 18266 | 5000 | 15749 | 13014 |
| | 14274 | 8444 | 4707 | 13097 | 15930 | 11872 | 2621 | 7158 | 6942 | 18502 | 5408 | 10837 |
| | 21928 | 13800 | 5188 | 19614 | 16117 | 4719 | 19714 | 1833 | 13499 | 3107 | 21492 | 12503 |
| | 21929 | 7921 | 1429 | 14398 | 22189 | 6439 | 12993 | 12307 | 6650 | 18994 | 747 | 5932 |
| | 18630 | 6683 | 1921 | 15651 | 5594 | 6958 | 13597 | 19763 | 10097 | 14124 | 14687 | 1094 |
| | 5780 | 7770 | 7688 | 15110 | 5797 | 7907 | 21169 | 3329 | 12627 | 4065 | 19882 | 22067 |
| | 19211 | 2061 | 7038 | 8909 | 16914 | 13129 | 19881 | 13235 | 16317 | 1551 | 14888 | 1201 |
| | 20264 | 7800 | 7526 | 2209 | 5887 | 10798 | 15317 | 10223 | 11351 | 10105 | 10661 | 15014 |
| | 2908 | 16412 | 22277 | 19851 | 12003 | 19616 | 11003 | 7768 | 6166 | 4620 | 13850 | 16231 |
| | 7016 | 20541 | 3458 | 1240 | 15787 | 20099 | 9282 | 11480 | 4994 | 6281 | 18662 | 7992 |
| | 9661 | 19875 | 11156 | 3619 | 14086 | 20948 | 16946 | 3456 | 6143 | 786 | 6709 | 5954 |
| | 17926 | 20839 | 22351 | 13277 | 15113 | 6368 | 7704 | 18694 | 3644 | 12154 | 3794 | 21257 |
| | 21638 | 18386 | 18111 | 21498 | 10731 | 13776 | 5539 | 14530 | 20282 | 7762 | 9529 | 17675 |
| | 15191 | 12380 | 14865 | 15825 | 2818 | 16442 | 5901 | 8220 | 18578 | 13297 | 2495 | 21913 |
| | 4526 | 16085 | 10965 | 15558 | 18982 | 2984 | 11245 | 17095 | 7536 | 5117 | 2132 | 20312 |
| | 4655 | 16568 | 21093 | 13882 | 5730 | 7976 | 7079 | 13035 | 6801 | 2800 | 5619 | 10126 |
| | 12545 | 2037 | 11704 | 9571 | 21379 | 3712 | 7685 | 4483 | 18456 | 22341 | 11197 | 13107 |
| | 16006 | 21848 | 20337 | | | | | | | | | |
| 301: | 19000 | 5175 | 17102 | 15893 | 7025 | 2120 | 12938 | 12299 | 15442 | 11496 | 10074 | 5733 |
| | 14018 | 4497 | 12860 | 17771 | 17375 | 8161 | 11868 | 22009 | 7849 | 15996 | 13313 | 6451 |
| | 9249 | 12173 | 13520 | 22245 | 9579 | 19128 | 12786 | 1276 | 5812 | 2509 | 15030 | 5404 |
| | 7335 | 18498 | 6363 | 16355 | 19266 | 14084 | 8908 | 19966 | 8863 | 19169 | 539 | 3459 |
| | 13467 | 15720 | 2898 | 9093 | 9837 | 17258 | 1976 | 20125 | 1460 | 8614 | 10175 | 5871 |
| | 15351 | 6426 | 7149 | 12032 | 11271 | 8224 | 11194 | 11907 | 4519 | 3493 | 18304 | 22188 |
| | 18791 | 10516 | 18657 | 11078 | 6908 | 20626 | 14734 | 4564 | 18762 | 9992 | 1434 | 6230 |
| | 9846 | 4840 | 12934 | 18658 | 3437 | 11327 | 16354 | 4241 | 1568 | 14609 | 10156 | 19085 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 969 | 13387 | 20299 | 14003 | 18420 | 8635 | 5706 | 21190 | 1432 | 6124 | 1526 | 18029 |
| | 16093 | 11179 | 1324 | 22474 | 8016 | 22059 | 5181 | 15454 | 1309 | 4573 | 20643 | 18651 |
| | 6220 | 9683 | 15336 | 12171 | 3835 | 20676 | 15459 | 11187 | 6374 | 19257 | 8887 | 12249 |
| | 15479 | 8309 | 2813 | 3769 | 17901 | 16142 | 2063 | 6092 | 19535 | 21118 | 1210 | 8401 |
| | 7375 | 9531 | 10590 | 7738 | 17854 | 1657 | 9700 | 15494 | 7894 | 15287 | 1226 | 6551 |
| | 13070 | 19534 | 13610 | 1802 | 22458 | 17237 | 8915 | 14991 | 3591 | 9885 | 9545 | 21263 |
| | 14344 | 19754 | 11799 | 10504 | 11873 | 18078 | 16699 | 19633 | 15816 | 12846 | 4878 | 20466 |
| | 21081 | 22381 | 17475 | 18403 | 21905 | 22085 | 18453 | 5736 | 17957 | 4021 | 7834 | 14499 |
| | 2154 | 13058 | 11572 | 3583 | 10692 | 7183 | 16133 | 15670 | 12332 | 1756 | 16507 | 18601 |
| | 11306 | 18332 | 20634 | 7994 | 12919 | 9064 | 5045 | 14968 | 9551 | 2414 | 1646 | 4753 |
| | 1805 | 1502 | 18175 | 18991 | 19442 | 17821 | 1888 | 18587 | 10549 | 18855 | 4858 | 7028 |
| | 14908 | 22205 | 5964 | 4933 | 4340 | 5271 | 927 | 8374 | 3316 | 9426 | 12837 | 20014 |
| | 16546 | 20576 | 5008 | 9914 | 10822 | 13163 | 7197 | 6338 | 17347 | 21212 | 3445 | 14444 |
| | 561 | 1401 | 13989 | 15266 | 20426 | 12281 | 7477 | 7453 | 766 | 14757 | 19524 | 4093 |
| | 17235 | 17808 | 16762 | 10080 | 9217 | 14800 | 9794 | 18834 | 2718 | 6390 | 20406 | 7926 |
| | 924 | 20355 | 13005 | 19727 | 8981 | 4683 | 7215 | 4131 | 6381 | 3407 | 11741 | 12599 |
| | 16185 | 18844 | 16344 | 19195 | 11057 | 8355 | 8958 | 11977 | 19693 | 20196 | 6610 | 14503 |
| | 22133 | 4744 | | | | | | | | | | |
| 302: | 8946 | 9168 | 14628 | 299 | 6214 | 4182 | 16075 | 11899 | 18083 | 13560 | 20787 | 22477 |
| | 16789 | 19264 | 6401 | 9620 | 5248 | 701 | 22290 | 21024 | 4074 | 1417 | 17543 | 11432 |
| | 17793 | 6222 | 18019 | 21867 | 3019 | 20723 | 20357 | 10575 | 3819 | 6741 | 17742 | 1775 |
| | 8903 | 15288 | 14774 | 2885 | 20494 | 20292 | 10001 | 11853 | 13330 | 17952 | 16001 | 17214 |
| | 1751 | 16904 | 10306 | 20788 | 12413 | 1843 | 16515 | 21706 | 2394 | 15207 | 18738 | 15056 |
| | 9630 | 930 | 15269 | 6646 | 18926 | 4515 | 7300 | 14791 | 6976 | 603 | 21092 | 2483 |
| | 21947 | 7441 | 14923 | 3660 | 12133 | 22216 | 4929 | 5590 | 11909 | 14884 | 9941 | 6002 |
| | 9040 | 13939 | 12896 | 7903 | 14465 | 21683 | 11508 | 8978 | 22006 | 5322 | 21963 | 2499 |
| | 2777 | 18240 | 5791 | 16141 | 9977 | 5658 | 15523 | 9292 | 11550 | 19702 | 1688 | 20325 |
| | 5274 | 10531 | 9028 | 20146 | 5614 | 7485 | 10844 | 2674 | 18445 | 4072 | 7836 | 5153 |
| | 4165 | 15169 | 10277 | 16781 | 7814 | 3161 | 5957 | 6533 | 4563 | 7089 | 2687 | 21351 |
| | 21515 | 22453 | 19592 | 7105 | 7173 | 1968 | 19358 | 10994 | 20056 | 7763 | 9851 | 13457 |
| | 8780 | 11469 | 7586 | 17266 | 3066 | 12142 | 9430 | 14577 | 13924 | 7281 | 3270 | 19033 |
| | 15761 | 12341 | 2998 | 12637 | 2543 | 10962 | 19035 | 20906 | 4877 | 659 | 9821 | 12168 |
| | 20717 | 14352 | 1821 | 18042 | 16421 | 1736 | 15050 | 8399 | 19775 | 17680 | 18001 | 21325 |
| | 6598 | 18487 | 15537 | 14525 | 21216 | 7525 | 19979 | 5555 | 10444 | 11512 | 21128 | 1493 |
| | 8987 | 17533 | 22098 | 6855 | 12595 | 18912 | 15079 | 5745 | 6378 | 9285 | 11287 | 14670 |
| | 11840 | 14995 | 13573 | 3695 | 19886 | 12402 | 20005 | 2712 | 9988 | 1732 | 1437 | |
| 303: | 11613 | 15600 | 900 | 21525 | 7534 | 8911 | 20350 | 17575 | 7154 | 10397 | 5219 | 15446 |
| | 9261 | 1171 | 16015 | | | | | | | | | |
| 304: | 14477 | 14507 | 15421 | 17494 | 18062 | 2648 | 7991 | 15716 | 18037 | 11158 | 2783 | 2025 |
| | 16965 | 22007 | 22121 | 19530 | 11719 | 9318 | 11530 | 17738 | 1299 | 21214 | 12334 | 21809 |
| | 4864 | 10621 | 8796 | 1194 | 4280 | 19732 | 18120 | 15953 | 2967 | 3266 | 19426 | 6571 |
| | 6888 | 17781 | 1697 | 10045 | 1251 | 7276 | 7126 | 12814 | 4960 | 7248 | 3598 | 17583 |
| | 17847 | 7140 | 8316 | 18820 | 21056 | 7036 | 15143 | 13926 | 18581 | 5501 | 1142 | 3253 |
| | 7339 | 4338 | 10287 | 9635 | 11127 | 20511 | 19012 | 13060 | 4347 | 12691 | 12055 | 20545 |
| | 21425 | 3704 | 15743 | 19675 | 16542 | 16559 | 21229 | 11524 | 9274 | 11075 | 8804 | 17224 |
| | 3133 | 3607 | 10123 | 13418 | 2973 | 11620 | 15872 | 11732 | 19109 | 740 | 1359 | 17419 |
| | 6843 | 1680 | 16067 | 3406 | 4022 | 6395 | 9511 | 2595 | 20688 | 4623 | 22346 | 2369 |
| | 17333 | 5395 | 11866 | 17305 | 10611 | 7631 | 15733 | 18432 | 1959 | 6814 | 6323 | 13183 |
| | 9078 | 3032 | 21942 | 3286 | 13158 | 20759 | 22152 | 18157 | 1337 | 3062 | 16447 | 2772 |
| | 10847 | 14538 | 4797 | 21087 | 7452 | 19143 | 16659 | 16530 | 16620 | 11651 | 17070 | 1585 |
| | 22147 | 10166 | 6601 | 22431 | 15463 | 10652 | 13842 | 11862 | 1897 | 19136 | 9220 | 17946 |
| | 12697 | 22065 | 3138 | 16162 | 17146 | 7667 | 19062 | 9071 | 11793 | 11610 | 7968 | 7594 |
| | 7221 | 10376 | 5672 | 11711 | 3151 | 4084 | 14756 | 8726 | 18769 | 3480 | 10028 | 2838 |
| | 20595 | 20275 | 1292 | 17594 | 12254 | 4853 | 20642 | 8186 | 16379 | 11759 | 11502 | 8591 |
| | 4288 | 11992 | 15333 | 9201 | 14724 | 3846 | 15765 | 5294 | 9934 | 3608 | 4038 | 2297 |
| | 1916 | 7144 | 15894 | 19202 | 4614 | 3319 | 11943 | 21007 | 5703 | 7304 | 9147 | 4298 |
| | 11434 | 11341 | 10440 | 4734 | 13768 | 7039 | 7695 | 14607 | 13737 | 10493 | 13662 | 16005 |
| | 5151 | 2008 | 20772 | 4271 | 19954 | 15488 | 16991 | 11303 | 17894 | 5027 | 7608 | 5609 |
| | 16228 | 18306 | 2556 | 13676 | 8198 | 5829 | 17178 | 6626 | 16081 | 16487 | 20616 | 939 |
| | 20854 | 11693 | 16083 | 22378 | 12968 | 16437 | 7624 | 6039 | 10274 | 13230 | 16495 | 10978 |
| | 13806 | 5631 | 6912 | 22114 | 2955 | 21137 | 8847 | 12918 | 16985 | 22400 | 13954 | 16430 |
| | 1905 | 19874 | 9524 | 6234 | 15225 | 4942 | 7297 | 20802 | 5035 | 10180 | 21875 | 20321 |
| | 12454 | 9019 | 4029 | 11248 | 16017 | 3758 | 13953 | 2462 | 4887 | 8042 | 7962 | 11126 |
| | 15081 | 22027 | 16352 | 2791 | 1889 | 15457 | 8559 | 17058 | 7622 | 4393 | 1128 | 8437 |
| | 21033 | 5138 | 12634 | 1952 | 5842 | 21247 | 15955 | 3808 | 10420 | 14719 | 17939 | 4794 |
| | 21353 | 19950 | 18656 | 13160 | 3900 | 11932 | 16466 | 13358 | 19797 | 5206 | 2289 | 9733 |
| | 10875 | 12426 | 15784 | 10942 | 12064 | 7723 | 14341 | 5120 | 18048 | 8171 | 11041 | 17196 |
| | 16314 | 20434 | 21075 | 20432 | 4222 | 8716 | 4904 | 18464 | 630 | 8403 | 6184 | 18819 |
| | 17228 | 16302 | 10762 | 9202 | 16022 | 17350 | 15237 | 12703 | 11159 | 17792 | 4597 | 7291 |
| | 15512 | 1072 | 6812 | 15612 | 4183 | 5466 | 17341 | 9980 | 4892 | 1108 | 1406 | 22046 |
| | 1630 | 11923 | 17859 | 5617 | 18198 | 5043 | 6967 | 20318 | 22123 | 1264 | 12469 | 12218 |
| | 10452 | 13091 | 8047 | 6109 | 14712 | 428 | 22157 | 7745 | 16695 | 22271 | 6934 | 7635 |
| | 18516 | 6231 | 1574 | | | | | | | | | |

TABLE 17-continued

Sequence IDs for homolog proteins

| Seq ID NO: | homolog Seq ID NOs | | | | | | | | | | |
|---|---|---|---|---|---|---|---|---|---|---|---|
| 305: | 8099 | 12755 | 17111 | 978 | 1006 | 1542 | 15083 | 18937 | 12887 | 2035 | 10217 | 535 |
| | 533 | 507 | 306 | 478 | 8894 | 18461 | 12108 | 1501 | 12486 | 21909 | 7034 | 7130 |
| | 11072 | 14307 | 10425 | 15925 | 19332 | 1367 | 13146 | 7730 | 1937 | 9628 | 18825 | 609 |
| | 18335 | 21615 | 4370 | 7330 | 8575 | 15629 | 12213 | 5331 | 3191 | 19367 | 4875 | 5240 |
| | 11492 | 21592 | 7018 | 6367 | 19001 | 20564 | 13807 | 16754 | 21328 | 19708 | 4343 | 9940 |
| | 1066 | 2399 | 12207 | 1629 | 18478 | 7812 | 13667 | 3746 | 5720 | 16976 | 18312 | 3470 |
| | 5618 | 19921 | 17739 | 4546 | 14856 | 18520 | 3007 | 531 | 7912 | 8917 | 11529 | 6283 |
| | 8622 | 8288 | 17072 | 4299 | 7840 | 5830 | 6060 | 19606 | 3409 | 7000 | 8429 | 19346 |
| | 2857 | 17664 | 21589 | 11961 | 19154 | 18239 | 18127 | 11549 | 16493 | 21437 | 11195 | 20933 |
| | 21506 | 1079 | 9281 | 838 | 3533 | 4677 | 18511 | 4730 | 696 | 9569 | 17797 | 18687 |
| | 7097 | 20259 | 15252 | 13221 | 450 | 11335 | 20777 | 12713 | 22502 | 14915 | 21157 | 20371 |
| | 12591 | 3563 | 16308 | 7626 | 4212 | 19798 | 19458 | 5691 | 18292 | 16130 | 2832 | 21296 |
| | 830 | 14553 | 6434 | 18295 | 17956 | 829 | 476 | 12043 | 20779 | 1281 | 17745 | 7955 |
| | 9854 | 988 | 20859 | 6669 | 5359 | 9132 | 16586 | 12705 | 15449 | 1768 | 11129 | 6547 |
| | 22518 | 5552 | 11376 | 10964 | 1879 | 22087 | 13137 | 17298 | 19370 | 3333 | 13752 | 20301 |
| | 2425 | 6946 | 19538 | 14273 | 15340 | 6427 | 17165 | 15603 | 12419 | 8003 | 10809 | 13658 |
| | 14064 | 4221 | 7387 | 13284 | 20981 | 2316 | 3116 | 8418 | 3386 | 6508 | 19949 | 18217 |
| | 3578 | 22249 | 992 | 18538 | 13442 | 3471 | 14855 | 5277 | 19885 | 2816 | 10917 | 9436 |
| | 18659 | 12816 | 12308 | 15943 | 2515 | 20364 | 14701 | 8193 | 17579 | 22076 | 8890 | 2649 |
| | 9329 | 21073 | 8376 | 15177 | 10882 | 859 | 5990 | 9814 | 16053 | 5454 | 5209 | 3144 |
| | 9604 | 13848 | 22428 | 19076 | 17056 | 14918 | 4088 | 9960 | 11270 | 5837 | 22455 | 19840 |
| | 12234 | 21301 | 1149 | 801 | 953 | 1656 | 20632 | 3755 | 12278 | 22119 | 21098 | 1005 |
| | 10264 | 13037 | 11702 | 20954 | 5581 | 5063 | 1118 | 14568 | 17630 | 2371 | 4694 | 12396 |
| | 15369 | 16597 | 3697 | 10741 | 16309 | 4927 | 13396 | 21621 | 8841 | 16662 | 11120 | 14081 |
| | 8692 | 9484 | 15514 | 10745 | 15204 | 6565 | 14320 | 2978 | 9294 | 7482 | 9493 | 1277 |
| | 4952 | 7813 | 7306 | 12296 | 12021 | 6645 | 9286 | 22489 | 13745 | 16653 | 19069 | 7780 |
| | 15219 | 16969 | 14762 | 18330 | 10280 | 10802 | 10479 | 16663 | 3678 | 7751 | 16713 | 13703 |
| | 3630 | 4691 | 9472 | 10709 | 8542 | 7060 | 6112 | 22457 | 21974 | 5278 | 4682 | 10694 |
| | 19198 | 20476 | 7333 | 6482 | 14526 | 7151 | 2644 | 10655 | 12264 | 835 | 9315 | 2786 |
| | 16253 | 9488 | 5634 | 17372 | 788 | 15256 | 22095 | 18903 | 3706 | 9280 | 18593 | 5764 |
| | 12583 | 11568 | 13613 | 2331 | 5136 | 8073 | 5630 | 11115 | 11304 | 15998 | 19137 | 5817 |
| | 5580 | 18341 | 2454 | 8588 | 12540 | 4970 | 17445 | 2401 | 11869 | 7142 | 4488 | 19396 |
| | 10889 | 5190 | 13207 | 16465 | 9673 | 9771 | 11716 | 16290 | 14313 | 9218 | 15665 | 15699 |
| | 5441 | 20485 | 18548 | 18575 | 18821 | 3350 | 18263 | 20418 | 11128 | 16734 | 19030 | 21370 |
| | 13211 | 22530 | 15360 | 6398 | 14067 | 21170 | 15866 | 10131 | 4332 | 1235 | 12927 | 7088 |
| | 5099 | 2302 | 12424 | 9584 | 8303 | 11383 | 2282 | 8459 | 3414 | 15749 | 18691 | 12982 |
| | 12794 | 10961 | 10824 | 18440 | 16819 | 9975 | 21399 | 8444 | 4707 | 13097 | 15930 | 11872 |
| | 2621 | 7158 | 14864 | 6942 | 19607 | 7969 | 6546 | 5408 | 18266 | 10837 | 21928 | 13800 |
| | 21492 | 5339 | 20330 | 1833 | 4846 | 544 | 19667 | 9933 | 4140 | 1318 | 20105 | 2376 |
| | 7061 | 4232 | 15357 | 14036 | 7107 | 7165 | 12103 | 4848 | 12863 | 16683 | 1924 | 3730 |
| | 890 | 8155 | 7187 | 17466 | 14322 | 14398 | 22189 | 15956 | 21084 | 16117 | 13940 | 1818 |
| | 19714 | 16771 | 6683 | 1921 | 5000 | 13014 | 14274 | 18502 | 6650 | 13499 | 19763 | 10097 |
| | 5188 | 19614 | 4719 | 3107 | 5780 | 12503 | 21929 | 7921 | 1429 | 5797 | 6439 | 12993 |
| | 12307 | 15651 | 18994 | 747 | 5932 | 18630 | 7907 | 5594 | 6958 | 3329 | 4065 | 19882 |
| | 13597 | 14124 | 14687 | 7770 | 1094 | 7688 | 15110 | 21169 | 12627 | 22067 | 19211 | 16914 |
| | 2061 | 1201 | 19616 | 7038 | 8909 | 13129 | 19881 | 16317 | 1551 | 13235 | 14888 | 20264 |
| | 7800 | 7526 | 2209 | 11351 | 5887 | 10798 | 10105 | 15317 | 10223 | 10661 | 15014 | 2908 |
| | 16412 | 15519 | 22277 | 19851 | 12003 | 6166 | 7768 | 11003 | 20541 | 3458 | 1240 | 15787 |
| | 20099 | 9282 | 11480 | 4994 | 6281 | 18662 | 3619 | 7992 | 9661 | 19875 | 14086 | 11156 |
| | 20948 | 16946 | 3456 | 6143 | 786 | 6709 | 5954 | 17926 | 20839 | 22351 | 13277 | 13192 |
| | 15113 | 6368 | 18694 | 3644 | 12154 | 3794 | 21257 | 21638 | 7704 | 21498 | 14865 | 18386 |
| | 18111 | 10731 | 13776 | 5539 | 14530 | 20282 | 7762 | 9529 | 17675 | 15191 | 12380 | 16442 |
| | 15825 | 2818 | 8220 | 5901 | 18578 | 13297 | 2495 | 21913 | 4526 | 16085 | 10965 | 15558 |
| | 21784 | 775 | 7504 | 10887 | 3135 | 11204 | 15835 | 17679 | 3002 | 18189 | 7516 | 6483 |
| | 9518 | 14034 | 11913 | 9964 | 2126 | 10118 | 3160 | 10150 | 10347 | 14405 | 15486 | 7545 |
| | 12799 | 13960 | 1340 | 3431 | 18982 | 2984 | 15366 | 2275 | 6738 | 11245 | 5295 | 2132 |
| | 20312 | 4655 | 16568 | 21093 | 13882 | 5730 | 7976 | 7079 | 13035 | 18086 | 2800 | 4062 |
| | 8280 | 13990 | 6955 | 16633 | 12655 | 12545 | 2037 | 11704 | 9571 | 21379 | 3712 | 7685 |
| | 4483 | 22341 | 18456 | 11197 | 13107 | 16006 | 9320 | 19090 | | | | |
| 306: | 14420 | 1006 | 429 | 10217 | 10190 | 2439 | 478 | 314 | 18461 | 5240 | 6367 | 19001 |
| | 3122 | 4403 | 526 | 11601 | 7812 | 6192 | 17664 | 2857 | 21589 | 11961 | 19154 | 21437 |
| | 11195 | 20933 | 21506 | 3533 | 4677 | 18511 | 4730 | 696 | 9569 | 17797 | 18687 | 7097 |
| | 20259 | 15252 | 13221 | 450 | 11335 | 20777 | 12713 | 22502 | 14915 | 21157 | 20371 | 3563 |
| | 12591 | 16308 | 7626 | 4212 | 19798 | 19458 | 5691 | 18292 | 5019 | 17572 | 15704 | 16130 |
| | 21296 | 2832 | 830 | 14553 | 6434 | 18295 | 17956 | 829 | 476 | 12043 | 20779 | 1281 |
| | 17745 | 16586 | 7955 | 12705 | 15449 | 988 | 20859 | 1768 | 11129 | 6547 | 22518 | 5552 |
| | 9854 | 11376 | 6669 | 5359 | 9132 | 10964 | 1879 | 14844 | 22087 | 13137 | 17298 | 3333 |
| | 13752 | 20301 | 19370 | 2425 | 6946 | 19538 | 14273 | 15340 | 6427 | 17165 | 15603 | 12419 |
| | 18044 | 10809 | 8003 | 13658 | 14064 | 4221 | 7387 | 13284 | 20981 | 19949 | 2316 | 3116 |
| | 8418 | 3386 | 6508 | 18217 | 3578 | 22249 | 992 | 14855 | 13442 | 3471 | 5277 | 19885 |
| | 8739 | 2816 | 10917 | 15943 | 9436 | 18538 | 1973 | 18659 | 12816 | 12308 | 2515 | 20364 |
| | 14701 | 8193 | 17579 | 22076 | 8890 | 2649 | 9329 | 21073 | 8376 | 15177 | 10882 | 859 |
| | 5990 | 9814 | 16053 | 5209 | 3144 | 13848 | 22428 | 19076 | 14918 | 5454 | 17056 | 4088 |
| | 11270 | 5837 | 9604 | 953 | 22455 | 19840 | 12234 | 1149 | 801 | 21301 | 9960 | 1656 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 3755 | 12278 | 22119 | 21098 | 1005 | 10264 | 13037 | 11702 | 20954 | 5581 | 5063 | 1118 |
| | 6454 | 20632 | 1696 | 19474 | 14911 | 9381 | 22362 | 4111 | 13374 | 2932 | 3071 | 18551 |
| | 1431 | 12923 | 6509 | 19229 | 14012 | 5372 | 12362 | 17380 | 20272 | 16391 | 901 | 13395 |
| | 5132 | 9540 | 19228 | 6169 | 11589 | 13306 | 3179 | 14568 | 17630 | 2371 | 4694 | 12396 |
| | 15369 | 11784 | 16597 | 3697 | 10741 | 16309 | 4927 | 13396 | 21621 | 16662 | 8841 | 11120 |
| | 14081 | 8692 | 9484 | 15204 | 6565 | 14320 | 2978 | 9294 | 7482 | 9493 | 1277 | 4952 |
| | 7813 | 7306 | 12296 | 12021 | 6645 | 9286 | 22489 | 13745 | 16653 | 19069 | 7780 | 15219 |
| | 16969 | 14762 | 18330 | 10280 | 10802 | 10479 | 16663 | 3678 | 16713 | 7751 | 13703 | 3630 |
| | 4691 | 9472 | 10709 | 8542 | 7060 | 6112 | 22457 | 21974 | 20476 | 7333 | 6482 | 14526 |
| | 7151 | 2644 | 835 | 10655 | 12264 | 9315 | 2786 | 16253 | 9488 | 5634 | 17372 | 788 |
| | 18247 | 9280 | 22095 | 18903 | 3706 | 15256 | 18593 | 5764 | 11115 | 12583 | 11568 | 13613 |
| | 2331 | 5136 | 8073 | 15998 | 5630 | 11304 | 19137 | 5817 | 5580 | 18341 | 8588 | 12540 |
| | 2454 | 3016 | 4970 | 17445 | 2401 | 11869 | 6193 | 21516 | 2447 | 10889 | 5190 | 13207 |
| | 16465 | 9673 | 9771 | 11716 | 13123 | 18575 | 9584 | 12794 | 21399 | 20485 | 9218 | 18691 |
| | 3350 | 18263 | 4846 | 544 | 19667 | 9933 | 4140 | 1318 | 20418 | 11128 | 20105 | 16734 |
| | 2376 | 15699 | 7061 | 4232 | 15357 | 14036 | 5339 | 7107 | 19030 | 7165 | 21370 | 12103 |
| | 4848 | 13211 | 22530 | 15360 | 12863 | 9975 | 6398 | 14067 | 16683 | 21170 | 1924 | 890 |
| | 8155 | 15866 | 10131 | 7187 | 4332 | 1235 | 20330 | 12927 | 7088 | 5099 | 2302 | 12424 |
| | 8303 | 17466 | 14322 | 11383 | 2282 | 14274 | 15956 | 3414 | 12982 | 18548 | 15665 | 10961 |
| | 21084 | 10824 | 18440 | 16819 | 3730 | 13940 | 18821 | 14864 | 1818 | 19607 | 7969 | 6546 |
| | 16771 | 5441 | 8459 | 18266 | 5000 | 15749 | 13014 | 8444 | 4707 | 13097 | 15930 | 11872 |
| | 2621 | 7158 | 6942 | 18502 | 5408 | 10837 | 21928 | 13800 | 5188 | 19614 | 16117 | 4719 |
| | 1833 | 13499 | 3107 | 21492 | 12503 | 21929 | 7921 | 1429 | 14398 | 22189 | 6439 | 12993 |
| | 12307 | 19714 | 6650 | 18994 | 747 | 5932 | 18630 | 6683 | 1921 | 15651 | 19882 | 5594 |
| | 6958 | 13597 | 19763 | 10097 | 14124 | 14687 | 1094 | 5780 | 7770 | 7688 | 15110 | 5797 |
| | 7907 | 21169 | 3329 | 4065 | 12627 | 22067 | 19211 | 2061 | 13235 | 7038 | 8909 | 16914 |
| | 13129 | 16317 | 19881 | 1551 | 14888 | 1201 | 20264 | 7800 | 7526 | 2209 | 5887 | 10798 |
| | 15317 | 10223 | 11351 | 10105 | 10661 | 15014 | 2908 | 16412 | 12003 | 22277 | 19851 | 19616 |
| | 11003 | 7768 | 6166 | 13850 | 4620 | 16231 | 7016 | 2717 | 20886 | 14522 | 5254 | 15519 |
| | 20541 | 3458 | 1240 | 15787 | 20099 | 9282 | 11480 | 4994 | 6281 | 18662 | 7992 | 9661 |
| | 19875 | 11156 | 3619 | 14086 | 20948 | 16946 | 3456 | 6143 | 786 | 6709 | 5954 | 17926 |
| | 20839 | 22351 | 4726 | 13277 | 15113 | 6368 | 7704 | 18694 | 3644 | 12154 | 3794 | 21257 |
| | 21638 | 18386 | 18111 | 21498 | 10731 | 13776 | 5539 | 14530 | 20282 | 7762 | 9529 | 17675 |
| | 15191 | 12380 | 14865 | 15825 | 2818 | 16442 | 5901 | 8220 | 18578 | 13297 | 2495 | 21913 |
| | 4526 | 16085 | 10965 | 15558 | 18982 | 2984 | 11245 | 11137 | 12977 | 2132 | 20312 | 4655 |
| | 16568 | 21093 | 13882 | 5730 | 7976 | 7079 | 13035 | 2800 | 7101 | 509 | 307 | 305 |
| | 12545 | 2037 | 11704 | 9571 | 21379 | 3712 | 7685 | 4483 | 18456 | 22341 | 11197 | 13107 |
| | 14927 | 16006 | 532 | 428 | 372 | | | | | | | |
| 307: | 3349 | 11861 | 16061 | 5336 | 12949 | 18887 | 6597 | 3983 | 22099 | 2324 | 447 | 4512 |
| | 11806 | 9383 | 17441 | 7957 | 16578 | 12877 | 12285 | 6745 | 8158 | 22143 | 14055 | 16201 |
| | 1754 | 1561 | 18005 | 11717 | 9710 | 6672 | 1451 | 10276 | 2243 | 21572 | 5576 | 13128 |
| | 10885 | 6027 | 17037 | 15496 | 10454 | 6068 | 15308 | 2899 | 11018 | 14627 | 20697 | 3974 |
| | 7859 | 15270 | 15938 | 5811 | 2698 | 16879 | 8859 | 21272 | 14729 | 18033 | 840 | 5497 |
| | 13669 | 21714 | 19513 | 5502 | 16413 | 15747 | 1844 | 4651 | 13831 | 22094 | 8195 | 21288 |
| | 3065 | 16776 | 4822 | 18118 | 19091 | 5553 | 14834 | 21349 | 12572 | 16815 | 8955 | 13075 |
| | 12733 | 4648 | 22049 | 5403 | 1029 | 1877 | 22486 | 14277 | 19152 | 1410 | 21143 | 7372 |
| | 21858 | 17690 | 6467 | 9703 | 12831 | 4606 | 4506 | 19173 | 2942 | 1265 | 17141 | 18407 |
| | 8705 | 18889 | 4746 | 3811 | 9106 | 17506 | 7669 | 11911 | 20449 | 10409 | 22212 | 9181 |
| | 21792 | 22305 | 9003 | 8407 | 9234 | 9976 | 16656 | 2745 | 18946 | 4081 | 1944 | 12668 |
| | 7458 | 13728 | 15650 | 11471 | 11697 | 10966 | 5324 | 9173 | 19342 | 21172 | 9379 | 17192 |
| | 21538 | 8949 | 22434 | 3555 | 19594 | 13734 | 9786 | 21821 | 21772 | 21456 | 21196 | 9187 |
| | 10524 | 11998 | 20944 | 6938 | 7779 | 8979 | 13537 | 5360 | 18851 | 21252 | 15297 | 11734 |
| | 1781 | 17886 | 3931 | 16508 | 9825 | 5806 | 12904 | 4987 | 1438 | 8935 | 16959 | 16382 |
| | 1164 | 22141 | 2007 | 17210 | 14488 | 6399 | 14781 | 6373 | 22109 | 599 | 9398 | 9473 |
| | 5195 | 4504 | 5963 | 14256 | 6939 | 6345 | 1162 | 18406 | 17784 | 1442 | 4331 | 6935 |
| | 5879 | 18326 | 2240 | 20428 | 19414 | 11272 | 14731 | 3444 | 1809 | 21833 | 14869 | 12121 |
| | 5793 | 8845 | 20490 | 14861 | 12563 | 4528 | 17811 | 1567 | 9570 | 733 | 11892 | 13985 |
| | 11612 | 1512 | 1070 | 2951 | 19948 | 9341 | 9353 | 1718 | 16198 | 8546 | 15048 | 9919 |
| | 20674 | 3909 | 10843 | 16432 | 10218 | 15654 | 4043 | 14847 | 6714 | 8707 | 9886 | 20997 |
| | 22088 | 13038 | 8037 | 9178 | 5352 | 3851 | 6484 | 16180 | 20444 | 13259 | 20733 | 21480 |
| | 17651 | 22149 | 13792 | 13689 | 6933 | 21822 | 7825 | 13935 | 22010 | 15175 | 7093 | 21104 |
| | 21571 | 14166 | 13059 | 1320 | 19388 | 12387 | 18647 | 10615 | 2572 | 16738 | 17277 | 10671 |
| | 13485 | 4638 | 2352 | 7397 | 5048 | 13275 | 7941 | 11316 | 9127 | 6631 | 17029 | 14783 |
| | 5081 | 2879 | 3446 | 12504 | 11878 | 2839 | 3228 | 19752 | 1088 | 1402 | 6179 | 16798 |
| | 22525 | 16859 | 10813 | 2895 | 20050 | 10689 | 9920 | 13359 | 6382 | 16804 | 22048 | 15372 |
| | 17024 | 19135 | 2131 | 20708 | 19186 | 7679 | 13583 | 7611 | 8668 | 2471 | 18443 | 8080 |
| | 14254 | 18267 | 2356 | 17724 | 10645 | 21850 | 7740 | 18043 | 7128 | 21146 | 15408 | 8078 |
| | 2828 | 15730 | 8513 | 18968 | 650 | 14046 | 3085 | 13243 | 11222 | 15011 | 1105 | 3976 |
| | 1507 | 15891 | 10269 | 17937 | 6229 | 13505 | 13897 | 17262 | 1497 | 9774 | 5505 | 5939 |
| | 7480 | 3041 | 12199 | 18054 | 15132 | 17133 | 9987 | 21835 | 578 | 22529 | 20727 | 13110 |
| | 17553 | 15284 | 5186 | 15066 | 12304 | 21091 | 9863 | 4969 | 14128 | 13927 | 2253 | 22173 |
| | 20557 | 7177 | 21588 | 7134 | 20606 | 17839 | 15095 | 21594 | 19310 | 4399 | 21404 | 1167 |
| | 2570 | 8102 | 16155 | 14831 | 9194 | 9119 | 2558 | 21715 | 11856 | 11165 | 7573 | 10855 |
| | 15158 | 22322 | 8996 | 12383 | 18252 | 20458 | 20237 | 9891 | 4099 | 16104 | 8881 | 12231 |
| | 2561 | 647 | 22387 | 19765 | 4615 | 21305 | 15139 | 4964 | 20281 | 11812 | 22153 | 16216 |

TABLE 17-continued

Sequence IDs for homolog proteins

| Seq ID NO: | homolog Seq ID NOs | | | | | | | | | | |
|---|---|---|---|---|---|---|---|---|---|---|---|---|
| | 18833 | 21797 | 7671 | 15097 | 11028 | 2172 | 17562 | 12574 | 2664 | 9816 | 12353 | 2954 |
| | 21428 | 12735 | 2392 | 5226 | 8680 | 17177 | 18591 | 20343 | 15667 | 21341 | 11930 | 10157 |
| | 19825 | 5210 | 7091 | 22444 | 3844 | 717 | 18902 | 14808 | 11659 | 8670 | 1785 | 8233 |
| | 21693 | 8835 | 7167 | 12659 | 3869 | 22226 | 15589 | 13405 | 5280 | 13156 | 10456 | 10253 |
| | 16881 | 14660 | 15728 | 6461 | 7132 | 8140 | 20493 | 14049 | 12322 | 15683 | 846 | 12989 |
| | 4867 | 5866 | 20584 | 15020 | 1964 | 20885 | 21697 | 12785 | 2196 | 12335 | 15689 | 9927 |
| | 763 | 1531 | 20138 | 11358 | 1132 | 19079 | 14162 | 5361 | 7543 | 18763 | 17112 | 21617 |
| | 7915 | 20412 | 1643 | 20533 | 8020 | 9158 | 2930 | 19107 | 21064 | 3201 | 11077 | 14726 |
| | 20135 | 9411 | 15348 | 9402 | 12669 | 15995 | 8168 | 7755 | 3112 | 12219 | 551 | 21933 |
| | 8916 | 13876 | 14513 | 6877 | 8597 | 18116 | 8268 | 9085 | 9769 | 11890 | 21961 | 11709 |
| | 10758 | 12800 | 8640 | 1212 | 10509 | 21023 | 11267 | 21751 | 1557 | 18735 | 18051 | 21254 |
| | 15200 | 5771 | 17912 | 3381 | 18702 | 19564 | 12819 | 17593 | 8712 | 8128 | 1909 | 6496 |
| | 14338 | 16091 | 948 | 17565 | 16614 | 18595 | 11540 | 18075 | 9306 | 5464 | 18421 | 10608 |
| | 12167 | 17453 | 9268 | 11122 | 12880 | 13525 | 21522 | 5843 | 7885 | 10162 | 18002 | 13496 |
| | 9474 | 11489 | 14139 | 5078 | 13260 | 10989 | 5480 | 3428 | 22424 | 15138 | 4252 | 2826 |
| | 5882 | 20175 | 15811 | 16116 | 7879 | 12274 | 19326 | 5318 | 8325 | 1069 | 22306 | 6156 |
| | 14294 | 21302 | 22394 | 4521 | 10893 | 5702 | 4766 | 568 | 15271 | 1077 | 17778 | 9726 |
| | 14452 | 21497 | 5648 | 10532 | 15330 | 3647 | 8350 | 19227 | 17520 | 19834 | 16427 | 12852 |
| | 9016 | 11208 | 9994 | 5906 | 20197 | 1115 | 15244 | 22452 | 15164 | 4258 | 6471 | 14545 |
| | 6910 | 6417 | 21796 | 17471 | 17991 | 14998 | 15383 | 3215 | 10382 | 2580 | 8289 | 8452 |
| | 12605 | 11475 | 6041 | 3868 | 2991 | 13102 | 15010 | 21365 | 21059 | 6894 | 21208 | 11757 |
| 308: | 13659 | 8503 | 5417 | 2636 | 18255 | 14258 | 18186 | 14480 | 2997 | 12520 | 20393 | 16958 |
| | 14070 | 11296 | 3421 | 20754 | 17033 | 17928 | | | | | | |
| 309: | 22368 | 4230 | 16648 | 2237 | 2516 | 16152 | 10415 | 5473 | 14703 | 19022 | 18480 | 3997 |
| | 17101 | 4156 | 10514 | 13955 | 12976 | 4059 | | | | | | |
| 310: | 4051 | 3527 | 13345 | 2678 | 8550 | 12739 | 5968 | 11252 | 1249 | 13757 | 11908 | 13883 |
| | 642 | 18741 | 863 | 15128 | 20888 | 14323 | 4672 | 8571 | 16644 | 10920 | 80042 | 2023 |
| | 10377 | 10056 | 4837 | 19713 | 7234 | 1632 | 16113 | 13478 | 12526 | 19784 | 19698 | 2701 |
| | 14658 | 15220 | 8365 | 18917 | 19359 | 21121 | 8529 | 17053 | 2009 | 2989 | 6906 | 5789 |
| | 4862 | 8968 | 21524 | 13803 | 21337 | 5536 | 3377 | 936 | 20910 | 2445 | 21144 | 20276 |
| | 15766 | 10716 | 15947 | 17616 | 7904 | 2437 | 12791 | 8028 | 5119 | 21686 | 20353 | 6765 |
| | 13032 | 12566 | 2929 | 19589 | 6025 | 12404 | 5688 | 7908 | 7436 | 18460 | 14549 | 1975 |
| | 9403 | 18910 | 15871 | 5414 | 21648 | 22373 | 15001 | 8960 | 8512 | 14839 | 13626 | 2150 |
| | 18521 | 4687 | 4104 | 15162 | 19653 | | | | | | | |
| 311: | 7246 | 7633 | 13566 | 4922 | 7189 | 6648 | 3075 | 2678 | 8937 | 18998 | 20791 | 2442 |
| | 4593 | 2102 | 13757 | 8484 | 11908 | 21901 | 9697 | 3719 | 21432 | 10971 | 8004 | 22023 |
| | 10056 | 4837 | 6659 | 9021 | 8001 | 9591 | 4169 | 18319 | 12526 | 20405 | 19739 | 12836 |
| | 12342 | 14209 | 15108 | 19698 | 21200 | 14093 | 4820 | 21147 | 16711 | 686 | 18917 | 21915 |
| | 21121 | 8529 | 17053 | 2009 | 2989 | 6906 | 12853 | 7577 | 6127 | 14095 | 21524 | 6916 |
| | 13803 | 7336 | 19598 | 11276 | 21713 | 14811 | 21337 | 20910 | 936 | 2445 | 11616 | 15947 |
| | 17616 | 8331 | 11034 | 19471 | 5916 | 17862 | 12115 | 14492 | 18721 | 8414 | 19179 | 5371 |
| | 9277 | 5119 | 17025 | 20374 | 3996 | 5057 | 1399 | 16384 | 9470 | 18719 | 18399 | 3401 |
| | 8557 | 2158 | 3928 | 19925 | 15780 | 1172 | 19003 | 4754 | 6752 | 7557 | 21304 | 14324 |
| | 15694 | 2929 | 15268 | 11094 | 19589 | 8713 | 6025 | 14222 | 14987 | 11178 | 3467 | 7373 |
| | 1975 | 9403 | 2856 | 8286 | 16534 | 8056 | 9369 | 2719 | 15871 | 5414 | 22373 | 21648 |
| | 1955 | 5457 | 18895 | 17041 | 22161 | 13812 | 8512 | 14839 | 13626 | 18521 | 21678 | 2002 |
| | 4687 | 18560 | 4104 | 7854 | 18098 | 13647 | 15831 | 11038 | 19653 | 8205 | | |
| 312: | 12932 | 12556 | 10612 | 8324 | 20661 | 21261 | 10886 | 21109 | 3162 | 13645 | 12519 | 14154 |
| | 4627 | 9952 | 7890 | 12288 | 13254 | 22516 | 21541 | 11332 | 12510 | 6556 | 17293 | 7951 |
| | 6797 | 12554 | 2010 | | | | | | | | | |
| 313: | 15796 | 4326 | 10345 | 13029 | 13317 | 20973 | 19570 | 14613 | 13103 | 3759 | 11764 | 3247 |
| | 11747 | 9513 | 3029 | 20696 | 20193 | 9454 | 5495 | 18809 | 16012 | 8066 | 7668 | 15744 |
| | 1836 | 6499 | 12779 | 2481 | 14822 | | | | | | | |
| 314: | 7479 | 533 | 507 | 535 | 306 | 12575 | 15642 | 18461 | 5073 | 9804 | 18997 | 8666 |
| | 3659 | 6320 | 6367 | 19001 | 6157 | 11916 | 2258 | 21356 | 9857 | 2163 | 2584 | 3331 |
| | 20086 | 6423 | 4662 | 3838 | 14933 | 8860 | 19820 | 15915 | 7403 | 4850 | 4714 | 9730 |
| | 12137 | 14919 | 12016 | 19643 | 3913 | 17315 | 7812 | 21939 | 13951 | 1478 | 7199 | 10536 |
| | 9491 | 3917 | 15376 | 4608 | 20333 | 7216 | 21640 | 8527 | 16880 | 19870 | 10959 | 4725 |
| | 15069 | 5944 | 17598 | 6786 | 14232 | 4110 | 10546 | 16887 | 4811 | 15616 | 10586 | 10067 |
| | 11756 | 20433 | 13391 | 16270 | 10468 | 7655 | 21719 | 5755 | 2857 | 17664 | 21589 | 11961 |
| | 18800 | 19154 | 879 | 12644 | 16878 | 2030 | 4833 | 5428 | 3533 | 8904 | 4677 | 18511 |
| | 4730 | 696 | 9569 | 17797 | 18687 | 7097 | 20259 | 15252 | 13221 | 450 | 22502 | 14915 |
| | 21157 | 20371 | 3563 | 12591 | 16308 | 7626 | 4212 | 19798 | 19458 | 5691 | 18292 | 16130 |
| | 21296 | 2832 | 830 | 14553 | 6434 | 18295 | 476 | 12043 | 20779 | 1281 | 17745 | 16586 |
| | 7955 | 12705 | 15449 | 988 | 20859 | 1768 | 11129 | 6547 | 22518 | 5552 | 9854 | 11376 |
| | 6669 | 5359 | 9132 | 10964 | 1879 | 22087 | 13137 | 17298 | 3333 | 13752 | 20301 | 19370 |
| | 2425 | 6946 | 19538 | 14273 | 15340 | 6427 | 17165 | 15603 | 12419 | 10809 | 8003 | 13658 |
| | 14064 | 4221 | 7387 | 13284 | 20981 | 2316 | 3116 | 8418 | 3386 | 6508 | 18217 | 3578 |
| | 22249 | 992 | 13442 | 3471 | 14855 | 19949 | 5277 | 19885 | 2816 | 10917 | 9436 | 18538 |

TABLE 17-continued

Sequence IDs for homolog proteins

| Seq ID NO: | homolog Seq ID NOs | | | | | | | | | | |
|---|---|---|---|---|---|---|---|---|---|---|---|
| | 18659 | 12816 | 12308 | 15943 | 2515 | 20364 | 14701 | 8193 | 17579 | 22076 | 8890 | 2649 |
| | 9329 | 21073 | 8376 | 15177 | 10882 | 859 | 5990 | 9814 | 16053 | 5209 | 3144 | 13848 |
| | 22428 | 19076 | 14568 | 4694 | 12396 | 15369 | 16597 | 3697 | 10741 | 13396 | 21621 | 8841 |
| | 16662 | 11120 | 14081 | 15204 | 6565 | 14320 | 2978 | 9294 | 7482 | 9493 | 1277 | 7813 |
| | 7306 | 12296 | 12021 | 6645 | 9286 | 22489 | 13745 | 16653 | 19069 | 7780 | 15219 | 16969 |
| | 14762 | 10802 | 10479 | 16663 | 3678 | 16713 | 7751 | 13703 | 3630 | 4691 | 9472 | 10709 |
| | 8542 | 7060 | 6112 | 22457 | 21974 | 20476 | 7333 | 6482 | 14526 | 7151 | 2644 | 835 |
| | 10655 | 12264 | 788 | 9673 | 9771 | 11716 | 18575 | 9584 | 12794 | 21399 | 6281 | 18662 |
| | 7992 | 9661 | 19875 | 11156 | 3619 | 14086 | 786 | 20948 | 16946 | 3456 | 6143 | 6709 |
| | 5954 | 17926 | 20839 | 22351 | 13277 | 10965 | 15558 | 8891 | 10152 | 15189 | 13161 | 3256 |
| | 13226 | 1748 | 21271 | 22258 | 10136 | 18982 | 20726 | 10154 | 17115 | 12652 | 1426 | 12623 |
| | 4475 | 16706 | 17850 | 21904 | 545 | 2132 | 20312 | 4655 | 16568 | 21093 | 13882 | 5730 |
| | 7976 | 7079 | 13035 | 7273 | 14619 | 2800 | 12728 | 15228 | 19263 | 10088 | 305 | 16894 |
| | 6203 | 22106 | 19049 | 10427 | 11733 | 8133 | 372 | 12866 | 13782 | | | |
| 315: | 3342 | 12667 | 2100 | 12617 | 1136 | 6158 | 17567 | 4891 | 9212 | 13652 | 2310 | 14039 |
| | 8257 | 4890 | 20474 | 16825 | 8834 | 4127 | 1369 | 14688 | 17548 | | | |
| 316: | 10331 | 15934 | 2046 | 6293 | 19503 | 17105 | 13130 | 7604 | 20972 | 611 | 2151 | 19670 |
| | 1110 | 20162 | 9143 | 9176 | 19023 | 19084 | 18099 | 5356 | 15439 | 3212 | 10361 | 21551 |
| | 20873 | 18300 | 6915 | 11130 | 19131 | 17963 | 7910 | 4920 | 4372 | 18216 | 8334 | 5551 |
| | 11009 | 21068 | 13009 | 6829 | 20236 | 2330 | 15785 | 1052 | 14929 | 4869 | 4064 | 14251 |
| | 6409 | 4771 | 21722 | 3477 | 22283 | 4071 | 13419 | 2771 | 12516 | 2855 | 6554 | 5053 |
| | 15301 | 13629 | 22091 | 9959 | 8014 | 18394 | 7184 | 5437 | 10014 | 15912 | 7764 | 9611 |
| | 13654 | 12151 | 12808 | 1755 | 10215 | 21979 | 12492 | 8018 | 7254 | 20380 | 2845 | 654 |
| | 5061 | 7274 | 9568 | 5018 | 11235 | 6804 | 8938 | 12700 | 17001 | | | |
| 317: | 7147 | 17102 | 22335 | 21107 | 13529 | 17232 | 12299 | 15442 | 10074 | 12860 | 8161 | 6451 |
| | 9249 | 12173 | 13520 | 2381 | 7179 | 2397 | 4681 | 8032 | 10026 | 17837 | 1679 | 750 |
| | 13467 | 22304 | 9093 | 12920 | 8746 | 12849 | 8975 | 8614 | 11049 | 15351 | 6414 | 11194 |
| | 18365 | 22000 | 10060 | 950 | 10516 | 16860 | 18657 | 11078 | 20626 | 15349 | 9992 | 11321 |
| | 16068 | 13071 | 20575 | 10629 | 4241 | 12058 | 21534 | 18040 | 574 | 21837 | 6124 | 1526 |
| | 12392 | 2919 | 22474 | 21550 | 1309 | 19435 | 13170 | 2632 | 14407 | 19257 | 15479 | 17487 |
| | 7797 | 19535 | 13125 | 7697 | 9338 | 11284 | 15648 | 2144 | 9885 | 3591 | 21263 | 9545 |
| | 14344 | 6947 | 19431 | 21279 | 4756 | 13704 | 4125 | 11670 | 6044 | 22381 | 21905 | 15904 |
| | 14499 | 10692 | 12332 | 1756 | 4806 | 18332 | 7994 | 9064 | 18991 | 17391 | 20098 | 22081 |
| | 5015 | 11957 | 13991 | 17712 | 22029 | 21507 | 3779 | 6619 | 4824 | 1847 | 11561 | 2927 |
| | 7497 | 1618 | 16567 | 1625 | 1011 | 14504 | 1983 | 2353 | 13906 | 16938 | 11796 | 2922 |
| | 13819 | 606 | 3676 | 2458 | 20599 | 20531 | 13948 | 7520 | 12498 | 13705 | 8646 | 9042 |
| | 9750 | 14969 | 563 | 1092 | 8562 | 6341 | 3562 | 11565 | 15599 | 16895 | 12974 | 1939 |
| | 16577 | 1711 | 21985 | 5754 | 19800 | 15748 | 4371 | 12415 | 2463 | 4827 | 5656 | 6520 |
| | 14881 | 1513 | 19711 | 6790 | 20528 | 13821 | 9526 | 8611 | 6058 | 17821 | 1888 | 18587 |
| | 4858 | 18855 | 7028 | 14908 | 22205 | 5964 | 4340 | 5271 | 17773 | 927 | 8374 | 3316 |
| | 2666 | 20014 | 21527 | 9914 | 10822 | 7197 | 21212 | 13163 | 13989 | 17347 | 15266 | 1401 |
| | 6338 | 14444 | 3445 | 561 | 9349 | 20565 | 2095 | 7453 | 18711 | 19524 | 4093 | 8735 |
| | 14800 | 9217 | 16762 | 10080 | 19195 | 11057 | 11977 | 21372 | 20196 | 6610 | 14503 | 22133 |
| | 19181 | | | | | | | | | | | |
| 318: | 4562 | 9606 | 1444 | 14309 | 10107 | 21463 | 18996 | 14333 | 1334 | 13632 | 22339 | 19891 |
| | 15309 | 3134 | 19973 | 17693 | 15433 | 13252 | 20233 | 7289 | 15373 | 8208 | 21182 | 21283 |
| | 14523 | 6862 | 8920 | 22389 | 7427 | 19075 | 14622 | 18190 | 16360 | 12132 | 1586 | 14883 |
| | 3538 | 22299 | 4909 | 6348 | 9295 | 11703 | 6913 | 16728 | 19809 | 21668 | 18897 | 20235 |
| | 616 | 10625 | 12272 | 10812 | 4295 | 2449 | 11240 | 20715 | 10788 | 12331 | | |
| 319: | 11506 | 8025 | 19504 | 17096 | 9236 | 5967 | 13265 | 13150 | 20345 | 2575 | 15093 | 720 |
| | 9238 | 20846 | 7110 | 18462 | 16689 | 3666 | 13238 | 20249 | 22504 | 5681 | 15821 | 11308 |
| | 7263 | 2587 | 3204 | 8488 | 1135 | 3170 | 19880 | 7687 | 4736 | 5783 | 20141 | 8454 |
| | 11622 | 3641 | 10121 | 15474 | 15016 | 3635 | 12476 | 2148 | 6474 | 12754 | 10278 | 4251 |
| | 2157 | 17396 | 18150 | 5472 | 2435 | 9967 | 3440 | 12802 | 21724 | 16131 | 7711 | 10389 |
| | 5452 | 18194 | 15428 | 5298 | 16650 | 13697 | 3148 | 15338 | 9355 | 4542 | 7607 | 12624 |
| | 9835 | 6871 | 1450 | 17202 | 4346 | 18156 | 2256 | 5469 | 11562 | 11593 | 8125 | 13465 |
| | 21018 | 14122 | 6978 | 1534 | 5284 | 19934 | 13992 | 9438 | 9860 | 16616 | 13159 | 22237 |
| | 9239 | 12122 | 7442 | 20605 | 16637 | 625 | 10834 | 2546 | 3875 | 5692 | 13941 | |
| 320: | 5584 | 14500 | 1413 | 1303 | 11425 | 12432 | 20553 | 5678 | 19728 | 1702 | 21840 | 16132 |
| | 13978 | 8053 | 11638 | 17005 | 7048 | 12602 | 12897 | 18092 | 1532 | 16921 | 11347 | 8929 |
| | 2022 | 22014 | 21806 | 20100 | 17247 | 5940 | 13718 | 10507 | 20917 | 13044 | 3334 | 11629 |
| | 3850 | 19276 | 8082 | 15982 | 2091 | 8247 | 2827 | 4647 | 21352 | 16763 | 13875 | 2729 |
| | 11068 | 14988 | 22366 | 6081 | 6500 | 17279 | 7348 | 9062 | 12873 | 13199 | 7794 | 6832 |
| | 16726 | 7795 | 12202 | 12467 | 5788 | 10596 | 12756 | 21948 | 11263 | 10951 | 13316 | 8432 |
| | 13127 | 9984 | 13493 | 8019 | 12038 | 1826 | 14472 | 9125 | 4955 | 19548 | 16684 | 5905 |
| | 16785 | 3169 | 20313 | 12232 | 10211 | 6536 | 20084 | 4322 | 19294 | | | |
| 321: | 11679 | 7712 | 4765 | 2778 | 10428 | 15613 | 13759 | 8748 | 15529 | 4789 | 4143 | 22492 |
| | 10520 | 5899 | 5524 | 1150 | 15997 | 6728 | 7250 | 19339 | 3882 | 2486 | 16390 | 13804 |
| | 4361 | 20834 | 20825 | 586 | 2032 | 2861 | 14363 | 17505 | 15033 | 6284 | 9806 | 19295 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 8378 | 20979 | 6962 | 22356 | 6126 | 18081 | 16902 | 16016 | 11797 | 14905 | 12294 | 1932 |
| | 4974 | 560 | 4872 | 19916 | 7886 | 18272 | 11004 | 21567 | 6122 | 3929 | 10292 | 20964 |
| | 14636 | 4316 | 16294 | 16670 | 6202 | 3283 | 3979 | 708 | 10683 | 3722 | 9024 | 10315 |
| | 7707 | 21597 | 12187 | 21031 | 11517 | 17433 | 1323 | 3512 | 20375 | 12464 | 21941 | 10366 |
| | 13212 | 15089 | 3993 | 3918 | 17676 | 18119 | 2709 | 17107 | 15788 | | | |
| 322: | 10548 | 4897 | 5425 | 7818 | 3878 | 10642 | 3310 | 16365 | 9020 | 12789 | 17219 | 2142 |
| | 13865 | 19002 | 946 | 18211 | | | | | | | | |
| 323: | 12932 | 12556 | 10612 | 8471 | 9836 | 7200 | 3244 | 4931 | 6155 | 11441 | 5925 | 9952 |
| | 1283 | 20609 | 2129 | 3224 | 8050 | 2693 | 11630 | 8765 | 8258 | 10271 | 17801 | 10768 |
| | 7008 | 3010 | 16997 | 6501 | 20840 | 3978 | 2010 | | | | | |
| 324: | 10963 | 8235 | 5742 | 21966 | 17140 | | | | | | | |
| 325: | 15756 | 6758 | 15758 | 5287 | 19343 | 4588 | 17303 | 13336 | 21407 | 16436 | 6718 | |
| 326: | 16712 | 1166 | 15865 | 2733 | 17246 | 15303 | 1381 | 13492 | 6572 | 7728 | 13605 | 12382 |
| | 9290 | 21152 | 7868 | 21359 | 6654 | 2544 | | | | | | |
| 327: | 12913 | 16464 | 16273 | 20905 | 3701 | 8623 | 4539 | 11237 | 7785 | 12606 | 12734 | 1726 |
| | 4555 | 7538 | 13748 | 14436 | 18787 | 11199 | 15234 | 14408 | 15929 | 7578 | 1919 | 8057 |
| | 11210 | | | | | | | | | | | |
| 328: | 14125 | 20217 | 16758 | 5776 | 15086 | 18339 | 9344 | 13845 | 5197 | 20795 | 5897 | 9137 |
| | 9973 | 704 | 18058 | 11958 | 7252 | 2114 | 7827 | 5752 | 4689 | 7592 | 15102 | 22013 |
| | 12505 | 15413 | 5397 | 16345 | 11067 | 11445 | 21494 | 14366 | 3450 | 8189 | 13758 | 10214 |
| | 21577 | 10815 | 1385 | 19042 | | | | | | | | |
| 329: | 3497 | 2714 | 8101 | 4216 | 8074 | 1106 | 1600 | | | | | |
| 330: | 11223 | 1913 | 6535 | 17340 | 17586 | 15949 | 10628 | 5279 | 16989 | 13504 | 22441 | 20437 |
| | 16847 | 20368 | 18727 | 20627 | 677 | 8442 | 2847 | 12004 | 5478 | | | |
| 331: | 13633 | 5900 | 8539 | 14672 | 12233 | 964 | 10478 | 20775 | 5875 | 5805 | 1804 | 1598 |
| | 8760 | 4906 | 10137 | 12276 | 20894 | 3902 | 1838 | 1416 | 13999 | 8927 | 20239 | 21067 |
| | 2846 | 1536 | 951 | 9346 | 9547 | 21436 | 4596 | 12781 | 4010 | 11786 | 8601 | 10761 |
| | 6187 | 19637 | 20291 | 12933 | 1404 | 16680 | 16262 | 4172 | 6985 | 11107 | 10370 | 17700 |
| | 13722 | 7971 | 3488 | 17731 | 14386 | 6750 | 13862 | 2765 | 17564 | 11582 | 6358 | 16691 |
| | 21558 | 16323 | 14350 | 16234 | 10634 | 8984 | 7275 | 21757 | 12586 | 15643 | 921 | 10884 |
| | 20529 | 8362 | 4086 | 15778 | 8213 | 645 | 8641 | 14759 | 21903 | 9293 | 2872 | 7350 |
| | 12282 | 7277 | 21911 | 19806 | 10064 | 12113 | 15339 | 20238 | 1645 | 15286 | 17911 | 15808 |
| | 9799 | 12685 | 4914 | 19213 | 10728 | 2852 | 4839 | 20536 | 7995 | 7379 | 15240 | 12971 |
| | 591 | 20690 | 5666 | 5145 | 10145 | 1126 | 13494 | 13052 | 13798 | 22187 | 6567 | 2224 |
| | 22255 | 22276 | 19919 | 8963 | 4880 | 11857 | 15344 | 20168 | 20601 | 21712 | 7009 | 15363 |
| | 10724 | 8126 | 7044 | 2098 | 12067 | 13898 | 7690 | 17967 | 22554 | | | |
| 332: | 4051 | 7246 | 14199 | 4757 | 2211 | 19939 | 7119 | 18627 | 18219 | 10672 | 19725 | 20509 |
| | 7686 | 2989 | 10561 | 7284 | 936 | 20910 | 3464 | 21563 | 5884 | 11537 | 21063 | 1972 |
| | 3103 | 11411 | 17085 | 21614 | 20041 | 6920 | 896 | 19271 | 21101 | 6679 | 18617 | 19003 |
| | 7557 | 2937 | 8512 | | | | | | | | | |
| 333: | 11864 | 18401 | 7916 | 16388 | 781 | 8033 | 2364 | 22015 | 9748 | 2475 | 765 | 14146 |
| | 13993 | 16445 | 7070 | 19406 | 13139 | 11260 | 21048 | 22437 | 16423 | 12388 | 15277 | 9405 |
| | 13452 | 21701 | 15472 | 21519 | 18268 | 18140 | 17189 | 10852 | 15461 | 8741 | 9641 | 20297 |
| | 21384 | 9522 | 16319 | 4702 | 6436 | 9574 | 18726 | 3628 | 16593 | 18634 | 13820 | 16639 |
| | 4189 | 17966 | 3524 | 13210 | 12214 | 13114 | 18483 | 11648 | 5974 | 15580 | 4570 | 17225 |
| | 19309 | 11814 | 7466 | 15434 | 16431 | 13455 | 9128 | 17770 | 17597 | 11744 | 5668 | 18077 |
| | 20332 | 12252 | 6487 | 5722 | 19526 | 13902 | 14620 | 19013 | 12349 | 14056 | 3612 | 8715 |
| | 15923 | 4913 | 11247 | 1777 | 16114 | 9983 | 8124 | 7153 | 20006 | 10025 | 1074 | 21879 |
| | 4977 | 19631 | 8517 | 5456 | 9877 | 4139 | 21162 | 4364 | 7696 | 9702 | 1769 | 9365 |
| | 5341 | 7159 | 5323 | 19419 | 19967 | 19719 | 15541 | 14191 | 10391 | 612 | 17071 | 22520 |
| | 2596 | 16797 | 826 | 17040 | 18360 | 6069 | 16301 | 22129 | 12523 | 19596 | 3074 | 6712 |
| | 12666 | 21205 | 18284 | 21965 | | | | | | | | |
| 334: | 22427 | 862 | 20385 | 6265 | 12399 | 22070 | 17740 | 7828 | 4067 | 1153 | 11326 | 2935 |
| | 9841 | 19586 | 16621 | 4285 | 4474 | 5816 | 1468 | 12636 | 2870 | 12256 | 15396 | 20978 |
| | 13936 | 20481 | 9196 | 15850 | 17759 | 14083 | 17877 | 11918 | 14099 | 22052 | 4350 | 14967 |
| | 3030 | 4936 | 6573 | 20255 | 16179 | 17938 | 6661 | 14748 | 18841 | 8544 | 17559 | 16186 |
| | 13096 | 10817 | 20956 | 15131 | 16981 | 20307 | 6896 | 9262 | 16287 | 14784 | 4658 | 18310 |
| | 6506 | 1358 | 8689 | 18061 | 6280 | 1214 | 4418 | 13166 | 8421 | 2972 | 19253 | 6332 |
| | 1033 | 16181 | 10378 | 16100 | 12772 | 1621 | 974 | 9705 | 11370 | 21857 | 9111 | 13663 |
| | 6502 | 15769 | 18274 | 20182 | 18579 | 16062 | 18202 | 10290 | 15049 | 10207 | 10284 | 15057 |
| | 16286 | 790 | 10968 | 5513 | 1193 | 17665 | 4712 | 12568 | 13764 | 17032 | 778 | 11095 |
| | 19866 | 6900 | 21331 | 931 | 14040 | 5675 | 18493 | 5449 | 2779 | 10498 | 12780 | 10602 |
| | 10664 | 9704 | 2890 | 2696 | 4265 | 20376 | 6349 | 5782 | 11580 | 15846 | 4001 | 15619 |

TABLE 17-continued

Sequence IDs for homolog proteins

| Seq ID NO: | homolog Seq ID NOs | | | | | | | | | | |
|---|---|---|---|---|---|---|---|---|---|---|---|
| | 21400 | 16911 | 11079 | 4939 | 15709 | 14567 | 17601 | 14494 | 2988 | 2987 | 3279 | 14867 |
| | 3013 | 15708 | | | | | | | | | | |
| 335: | 15578 | 12136 | 19850 | 745 | 14354 | 11893 | 10400 | 16221 | 5102 | 12842 | 19938 | 8836 |
| | 6356 | | | | | | | | | | | |
| 336: | 1655 | 8875 | 17969 | 16217 | 19832 | 4954 | 10256 | 13907 | 2280 | 7705 | 2896 | 5571 |
| | 6016 | 2423 | 14230 | 7769 | 16575 | 6956 | 11570 | 638 | 22347 | 12730 | 3084 | 7136 |
| | 21153 | 979 | 18133 | 14470 | 4762 | 13775 | 13517 | 18643 | 14115 | 20989 | 4195 | 14211 |
| | 17841 | 21732 | 2378 | 6456 | 2604 | 16482 | 9054 | 9876 | 6696 | 20958 | 9729 | 13852 |
| | 22311 | 12997 | 5664 | 17434 | 511 | 11309 | 2192 | 7514 | 21788 | 10558 | 17846 | 13447 |
| | 19287 | 9827 | 17314 | 19480 | 8685 | 19289 | 9913 | 16783 | 7798 | 15355 | 21362 | |
| 337: | 16000 | 2106 | 21931 | 7956 | 15630 | 12717 | 10346 | 15324 | 20316 | 3593 | 13203 | 3167 |
| | 2799 | 12590 | 13815 | 4459 | 3056 | 18383 | 12953 | 14071 | 22160 | 2913 | 15509 | 16846 |
| | 14685 | 8814 | 5931 | 19964 | 20780 | 14871 | 13615 | 6779 | 997 | | | |
| 338: | 20669 | 3012 | 4857 | 6538 | 14648 | 21791 | 21544 | 15892 | 20656 | 17483 | 5020 | 19379 |
| | 16363 | 12470 | 5494 | 9395 | 17737 | 5910 | 3081 | 8480 | 20365 | 7510 | 1412 | 19099 |
| | 8801 | 14807 | 16161 | 2393 | 10298 | 8123 | 1239 | 10701 | 8769 | 20670 | 18966 | 739 |
| | 17909 | 2578 | 9830 | 13785 | 17449 | 6339 | 13378 | 17851 | 10673 | 17975 | 18270 | 18869 |
| | 20842 | 16312 | 5144 | 8392 | 13794 | 20142 | 22008 | 4642 | 7811 | 9505 | 7022 | 21431 |
| | 7054 | 13460 | 4715 | 13880 | 15813 | 16187 | 18556 | 12071 | 5168 | 4445 | 8109 | 6238 |
| | 19089 | 10095 | 2361 | 20340 | 16200 | 16747 | 6028 | 22386 | 10599 | 2796 | 3476 | 14418 |
| | 7731 | 5135 | 20971 | 13422 | 21726 | | | | | | | |
| 339: | 2298 | 2436 | 19901 | 14207 | 19971 | 5786 | 15380 | 16523 | 17629 | 1543 | 2607 | 3939 |
| | 13893 | 13623 | 19506 | 1858 | 2400 | 20267 | 18864 | 3159 | 17867 | 6744 | 4520 | 5184 |
| | 1289 | 5953 | 16468 | 8962 | 5695 | 6006 | 21230 | 5243 | 4876 | 2057 | 22012 | 13975 |
| | 18334 | | | | | | | | | | | |
| 340: | 5094 | 13921 | 9689 | 10104 | 19369 | 17978 | 21082 | 26901 | 7645 | 3853 | 21213 | 17435 |
| | 20373 | 10839 | 8089 | 4282 | 11406 | 17050 | 9439 | 11816 | 3709 | 8068 | 13476 | 14133 |
| | 17945 | 20398 | 2090 | 4164 | 2229 | 4799 | 13949 | 13578 | 8589 | 10573 | 17122 | 18689 |
| | 4604 | 7491 | 11399 | 9657 | 1351 | 17934 | 21685 | 9266 | 20395 | 18832 | 4616 | 13018 |
| | 17935 | 782 | 21358 | 4923 | 2048 | 7355 | 19368 | 10540 | 3418 | 15391 | 6352 | 1454 |
| | 584 | 6023 | 7278 | 13416 | 7550 | 12889 | 8632 | 13053 | 6040 | 1583 | 16498 | 7544 |
| | 2590 | 9046 | 601 | 4785 | 7174 | 3594 | 18195 | 11021 | 9022 | 8275 | 1685 | 3624 |
| 341: | 13668 | 15794 | 6342 | 14448 | 9278 | 20512 | 8200 | 16696 | 13521 | 1647 | 7170 | 15662 |
| | 12079 | 14698 | 21329 | 1853 | 5038 | 11976 | 2478 | 11937 | 22112 | 21927 | 3832 | 2707 |
| | 4810 | 16842 | 15999 | 3541 | 7952 | 9937 | 1893 | 9025 | 19963 | 10155 | 18805 | 2652 |
| | 3473 | 21709 | 10794 | 17386 | 16395 | 9463 | 14603 | 17255 | 17919 | 4407 | 21734 | 1453 |
| | 17376 | 5269 | 14505 | 22325 | 7898 | 5201 | 11700 | 7509 | 3737 | 5907 | 11800 | 14887 |
| | 18221 | 3408 | 1391 | 6603 | 945 | 2741 | 11668 | 22559 | 13979 | 16492 | 19717 | 12052 |
| | 13678 | 12316 | 20893 | 10627 | 18110 | 9396 | 17457 | 12447 | 17706 | 4188 | 12736 | 10213 |
| | 5657 | 1361 | 17750 | 2164 | 20757 | 10342 | 5557 | 13427 | 1459 | 5874 | 11035 | 14177 |
| | 18713 | 8770 | 13138 | 12686 | 12216 | 4228 | 12420 | 12044 | 4116 | 20177 | 7717 | 20582 |
| | 6544 | 20287 | 13392 | 5213 | 21383 | 20420 | 12277 | 610 | 7242 | 13209 | 21266 | 15605 |
| | 17695 | 1713 | 6386 | 7399 | 3771 | 15478 | 14510 | 14171 | 22266 | 6037 | 14656 | 20179 |
| | 7964 | 7223 | 20189 | 1994 | 21418 | 7850 | 8756 | 18014 | 14079 | 726 | 12260 | 21444 |
| | 10406 | 2633 | 8511 | 11121 | 10904 | 3092 | 2853 | 17906 | 16524 | 8187 | 17998 | 20778 |
| | 2286 | 20199 | 3729 | 6145 | 21008 | 2565 | 12962 | 1257 | 15354 | 10610 | 7157 | 1796 |
| | 6315 | 17300 | 22423 | 14435 | 16471 | 16628 | 6594 | 21171 | 9956 | 9842 | 18573 | 17327 |
| | 8572 | 9431 | 16077 | 13255 | 10967 | 18428 | 7421 | 19940 | 17552 | 22215 | 6311 | 22128 |
| | 15501 | 21897 | 19865 | 6983 | 7587 | 17139 | 17241 | 18872 | 10791 | 18810 | 8812 | 5978 |
| | 20019 | 19994 | 6664 | 13673 | 2650 | 8721 | 16038 | 14722 | 18896 | 21111 | 2762 | 17606 |
| | 10806 | 18027 | 9130 | 18559 | 12287 | 11513 | 6131 | 3172 | 1990 | 4027 | 5292 | 3287 |
| | 13481 | 11191 | 19301 | 11297 | 10021 | 9171 | 14682 | 17190 | 14540 | 1140 | 8118 | |
| 342: | 2631 | 10657 | 18699 | 2536 | 6440 | 2600 | 16629 | 20719 | 4729 | 7634 | 14681 | 5022 |
| | 8936 | 10883 | 18494 | 6327 | 9575 | 8157 | 8096 | 14112 | 2076 | 9896 | 11151 | 16731 |
| | 2204 | 9035 | | | | | | | | | | |
| 343: | 2755 | 21932 | 4777 | 6313 | 21861 | 12723 | 19508 | 1200 | 15989 | 16994 | 5687 | 6685 |
| | 14644 | 15427 | 18561 | 20955 | 5319 | 10512 | 18861 | 4752 | 4558 | 9237 | 14495 | 2731 |
| | 18748 | 20853 | 21624 | 4158 | 6682 | 15121 | 13328 | 11123 | 17204 | 3588 | 8417 | 12524 |
| | 14426 | 12139 | 5914 | 22397 | 13082 | 3579 | 4217 | 4229 | 10653 | 20451 | 3376 | 17804 |
| | 6004 | 10303 | 2139 | 15227 | 11831 | 18631 | 19845 | 12159 | 11935 | 18000 | 18066 | 13477 |
| | 5998 | 16773 | 6555 | 6113 | 18981 | 769 | 10905 | 22461 | 18369 | 7501 | 12698 | 17209 |
| | 22284 | 15974 | 3000 | 1328 | 15319 | 13157 | 21846 | 21899 | 1244 | 17408 | 7057 | 674 |
| | 11714 | 14760 | 3856 | 22403 | 13952 | 5958 | 18866 | 16803 | 5945 | 7999 | 10446 | 17518 |
| | 21309 | 12969 | 5105 | 10656 | 10777 | 18972 | 14634 | 7566 | 9182 | 10453 | 6623 | 6029 |
| | 3857 | 1041 | 17997 | 10387 | 10643 | 1035 | 3246 | 9229 | 18431 | 9219 | 13687 | 4600 |
| | 14823 | 1650 | 1911 | 1506 | 20935 | 12204 | 6588 | 14467 | 12894 | 12964 | 21745 | 4773 |
| | 4206 | 8608 | 11403 | 21291 | 15104 | 9577 | 22470 | 10395 | 7106 | 18085 | 1045 | 18438 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 20164 | 5627 | 6989 | 3125 | 20664 | 9899 | 17477 | 20384 | 8914 | 13339 | 21568 | 14346 |
| | 15753 | 18139 | 2610 | 22040 | 12680 | 1930 | 10147 | 11672 | 21762 | 14042 | 4281 | 8445 |
| | 18322 | 7765 | 11544 | 8117 | 10562 | 17367 | 2534 | 14153 | 16918 | 7771 | 16968 | 14118 |
| | 14857 | 20095 | 4419 | 15545 | 5134 | 11331 | 9802 | 4911 | 9938 | 3150 | 22321 | 8071 |
| | 13544 | 4128 | 7168 | 8967 | 22547 | 3271 | 5965 | 9073 | 16529 | 16953 | 7176 | 17918 |
| | 1026 | 16418 | 11579 | 13510 | 11163 | 21202 | 11509 | 15037 | 10348 | 12555 | 7467 | 9767 |
| | 15877 | 20472 | 13410 | 15361 | 12759 | 10511 | 8273 | 5946 | 3774 | 8121 | | |
| 344: | 0 | | | | | | | | | | | |
| 345: | 11342 | 13022 | 13189 | 13375 | 19355 | 4603 | 9001 | 693 | 10423 | 19460 | 11989 | 3379 |
| | 20654 | 19018 | 22196 | | | | | | | | | |
| 346: | 4152 | 1714 | 20305 | 10236 | 21335 | 10203 | 4070 | 20587 | 13194 | 15640 | 10242 | 11539 |
| | 16862 | 1124 | 10029 | 12355 | 19807 | 3466 | 21983 | 17696 | 21768 | 12283 | 20617 | 17748 |
| | 17513 | 7821 | 7744 | 10704 | 11320 | 3178 | 16909 | 21864 | 9099 | 11919 | | |
| 347: | 15403 | 7222 | 17930 | 22425 | 8943 | 8767 | 5431 | 9412 | 9840 | 7098 | 10706 | 20039 |
| | 19399 | 18679 | 3063 | 13922 | 12891 | 19177 | 14765 | 8888 | 3766 | 15264 | 15112 | 8346 |
| | 19249 | 9496 | 8467 | 12097 | 7066 | 13354 | 10438 | 19683 | 1867 | 13713 | 11392 | 20463 |
| | 8419 | 9530 | 13590 | 19828 | 17789 | 3181 | 19673 | 20308 | 20048 | | | |
| 348: | 22289 | 699 | 7239 | 11768 | 21811 | 2946 | 15818 | 18586 | 10674 | 14308 | 3720 | 10934 |
| | 14107 | 19528 | 13730 | 3925 | 20977 | 22047 | 4398 | 22391 | 16849 | 20631 | | |
| 349: | 6607 | 11545 | 4182 | 16789 | 10863 | 11170 | 7754 | 13889 | 17668 | 6741 | 14774 | 8116 |
| | 16721 | 683 | 13808 | 10075 | 2147 | 13320 | 7970 | 20540 | 8978 | 11576 | 16025 | 12292 |
| | 10319 | 5002 | 13246 | 7075 | 22235 | 11091 | 9999 | 20403 | 14955 | 7021 | 7400 | 15424 |
| | 1403 | 1576 | 15201 | 1547 | 21389 | 2191 | 20891 | 18977 | 17393 | 11512 | 10958 | 14007 |
| | 6534 | 12539 | 20887 | 4792 | | | | | | | | |
| 350: | 21637 | 9766 | 13473 | 10430 | 2373 | 10229 | 22472 | 2533 | 8573 | 9183 | | |
| 351: | 21639 | 6558 | 15717 | 6583 | 1489 | 21115 | 14590 | 22491 | 22170 | 13729 | 14708 | 11897 |
| | 9169 | 16003 | 16657 | 18303 | 2503 | 7619 | 9667 | 19462 | | | | |
| 352: | 14832 | 4680 | 730 | 8944 | 19323 | 9756 | 8807 | 16549 | 6800 | 8830 | 14997 | 16942 |
| | 1293 | 1086 | 19167 | 624 | 11497 | 15185 | 11336 | 10574 | 6438 | 21022 | 10877 | 3498 |
| | 1533 | 10113 | 8352 | 18565 | 10340 | 12363 | 3314 | 18700 | 8755 | 21000 | 5888 | 14051 |
| | 11660 | 10255 | 20975 | 16898 | 1028 | 4899 | 9807 | 15549 | 1039 | 16373 | 21500 | 3757 |
| | 4390 | 13334 | 5158 | 7861 | 19157 | 5010 | 21692 | 13142 | 13526 | 12155 | 3025 | 15524 |
| | 4634 | 18132 | 20879 | 11836 | 6517 | 5390 | 6944 | 17642 | 10919 | 12777 | 22312 | 12374 |
| | 12089 | 2107 | 8665 | 10063 | 15827 | 10534 | 19377 | 14693 | 4078 | 16983 | 7351 | 21180 |
| 353: | 9803 | 5872 | 20880 | 7736 | 9394 | 19214 | 20066 | 4813 | 3867 | 8129 | 6810 | 8821 |
| | 14360 | 9758 | 10208 | 22542 | 16794 | 8724 | 2461 | 5260 | 11314 | 17374 | 20064 | 22105 |
| | 20232 | 17121 | 17288 | 16874 | 14516 | 1119 | 2781 | 15198 | 20079 | 14792 | 3439 | 22298 |
| | 12105 | 21450 | | | | | | | | | | |
| 354: | 6321 | 5225 | 13406 | 4040 | 4448 | 20067 | 13787 | 8883 | 20377 | 876 | 9126 | 21945 |
| | 4701 | 11644 | | | | | | | | | | |
| 355: | 8510 | 12886 | 3986 | 1767 | 22183 | 9676 | 17318 | 13827 | 6552 | 22440 | 15136 | 22229 |
| | 15255 | 8556 | | | | | | | | | | |
| 356: | 20329 | 7584 | 18151 | 12782 | 19780 | 869 | 1234 | 4543 | 4443 | 6003 | 10879 | 6195 |
| | 14766 | 2261 | 5303 | 18455 | 14900 | 13423 | 4770 | 7064 | 4996 | | | |
| 357: | 1090 | 22239 | 4778 | 3892 | 10096 | 3089 | 20675 | 8225 | 3300 | 3785 | 10016 | 16285 |
| 358: | 7246 | 7633 | 13566 | 4922 | 7189 | 8550 | 21432 | 6659 | 8001 | 9021 | 4169 | 9591 |
| | 18319 | 13478 | 12836 | 12342 | 14209 | 15108 | 19698 | 21556 | 16875 | 20650 | 5851 | 17486 |
| | 6249 | 13780 | 15776 | 11726 | 21200 | 14093 | 18917 | 21915 | 21121 | 8529 | 17053 | 2009 |
| | 2989 | 6906 | 7928 | 14192 | 7577 | 6127 | 6916 | 13803 | 19598 | 11276 | 7336 | 21713 |
| | 21337 | 2445 | 11616 | 17616 | 21069 | 3827 | 12208 | 819 | 16095 | 11103 | 17030 | 6075 |
| | 5459 | 17025 | 20374 | 5057 | 1399 | 3996 | 16384 | 3401 | 8557 | 9470 | 18719 | 18399 |
| | 2158 | 3928 | 19925 | 15780 | 1172 | 19003 | 4754 | 6752 | 7557 | 15694 | 2929 | 15268 |
| | 8286 | 16534 | 8056 | 2719 | 1955 | 18895 | 5457 | 17041 | 22161 | 8512 | 21678 | 7854 |
| | 13647 | 18098 | 15831 | 11038 | 15162 | 8205 | | | | | | |
| 359: | 11518 | 14223 | 17501 | 6542 | 13569 | 4821 | 16169 | 8132 | 15637 | 2270 | 10309 | 5708 |
| | 18374 | 9446 | 7790 | 12784 | 7569 | 14187 | 5525 | 7188 | 21691 | 15258 | 4550 | 7616 |
| | 5261 | 15163 | 14560 | 20144 | 10693 | 12244 | 21413 | 6135 | 7464 | 11142 | 13491 | 17655 |
| | 15676 | 14174 | 18333 | 13472 | 20648 | 6435 | 14763 | 13495 | 12676 | 18906 | 12036 | 16066 |
| | 21593 | 21667 | 14370 | 16048 | 17609 | 19658 | 5604 | 575 | 21518 | 5309 | 13744 | 15880 |
| | 19484 | 6704 | 658 | 8704 | 16710 | 12907 | 19375 | 3306 | 19468 | 11042 | 39841 | 7175 |

TABLE 17-continued

| Seq ID NO: | homolog Seq ID NOs | | | | | | | | | | |
|---|---|---|---|---|---|---|---|---|---|---|---|
| | Sequence IDs for homolog proteins | | | | | | | | | | |
| | 20965 | 1206 | 9155 | 20970 | 6796 | 17057 | 11008 | 18605 | 3353 | 4650 | 9058 | 7988 |
| | 19743 | 8369 | 3654 | 18497 | 11952 | 2866 | 16796 | 8504 | 20034 | 19086 | 4409 | 12452 |
| | 12908 | 7530 | | | | | | | | | | |
| 360: | 13327 | 3981 | 5070 | 16490 | 20204 | 5909 | 15321 | 10310 | 12746 | 5760 | 6045 | 1730 |
| | 1018 | 15233 | 13486 | 17387 | 20991 | 5406 | 13208 | 21716 | 9902 | 21763 | 22315 | 6472 |
| | 824 | 1364 | 18250 | 18767 | 12499 | 21700 | 3665 | 8788 | 19915 | 12114 | 17927 | 19363 |
| 361: | 13771 | 10043 | 10800 | 17501 | 13569 | 6854 | 4637 | 16169 | 8132 | 2667 | 15637 | 2270 |
| | 10309 | 18374 | 5708 | 9446 | 9291 | 12844 | 7790 | 12784 | 10720 | 9725 | 13741 | 5525 |
| | 15920 | 7877 | 7188 | 21691 | 15258 | 6705 | 4550 | 14008 | 15544 | 9706 | 7616 | 14358 |
| | 13182 | 14560 | 16722 | 1472 | 4000 | 1388 | 4261 | 10984 | 9823 | 21413 | 4976 | 9514 |
| | 16806 | 9972 | 9224 | 13061 | 15247 | 17984 | 9925 | 19953 | 10247 | 2676 | 11680 | 9751 |
| | 7643 | 12752 | 14983 | 15727 | 20648 | 3200 | 6435 | 14763 | 13495 | 13003 | 16940 | 7214 |
| | 15976 | 5735 | 6270 | 22352 | 12931 | 14053 | 16048 | 17609 | 575 | 18286 | 21834 | 10842 |
| | 18927 | 21518 | 20097 | 5309 | 13744 | 15880 | 19484 | 658 | 8704 | 16710 | 19375 | 3306 |
| | 6347 | 19468 | 10410 | 10451 | 11618 | 20965 | 12916 | 1206 | 20970 | 11008 | 1237 | 7988 |
| | 19743 | 20088 | 8231 | 4522 | 18497 | 11952 | 2866 | 15466 | 3609 | 2403 | 16796 | 13539 |
| | 14806 | 5364 | 12620 | 20699 | 15426 | 4409 | 12452 | 5296 | 3102 | 20918 | 9156 | 12665 |
| | 629 | 20947 | 3649 | 7530 | | | | | | | | |
| 362: | 1670 | 8427 | 4513 | 13628 | 17835 | 1981 | 20663 | 1254 | 19692 | 11385 | 11148 | 18372 |
| | 18636 | 1663 | 18409 | 21940 | 17744 | 17838 | 14190 | 16086 | 18411 | 682 | | |
| 363: | 2344 | 7205 | 10404 | 18090 | 3530 | 22282 | 2138 | 1522 | 5878 | 7220 | 18971 | 21529 |
| | 18900 | 21077 | 6911 | 22318 | 1047 | 9881 | 13404 | 7614 | 13515 | 13092 | 13300 | 20784 |
| | 3818 | 8910 | 19715 | 892 | 11279 | 3262 | | | | | | |
| 364: | 7108 | 14914 | 4339 | 11633 | 1095 | 18100 | 17413 | 19557 | 4087 | 5710 | 14536 | 8563 |
| 365: | 16767 | 7229 | 7241 | 19193 | 14780 | 8455 | 1669 | 2113 | 16394 | 13341 | 4965 | 20987 |
| | 21669 | 16094 | 13151 | 2242 | 9452 | 6246 | 4432 | 1828 | 6419 | 11839 | 6713 | 3448 |
| | 5129 | 7881 | 21433 | 18954 | 18710 | 15718 | 12146 | 16149 | 12186 | 2849 | 17256 | 2464 |
| | 11803 | 21181 | 15484 | 8463 | | | | | | | | |
| 366: | 6504 | 7524 | 14750 | 15585 | 13755 | 6170 | 12273 | 16565 | 1049 | 12336 | 18307 | 21260 |
| | 18677 | 18863 | 18346 | 15597 | 19755 | 3751 | 19920 | 2278 | 12086 | 1347 | 858 | 13286 |
| | 14325 | 1020 | 15133 | 10620 | 2444 | 3050 | 16139 | 16876 | 1573 | | | |
| 367: | 16254 | 15810 | 10496 | | | | | | | | | |
| 368: | 4014 | 5426 | 1644 | 4368 | 10252 | 8347 | 14623 | 6336 | 3143 | 17492 | 2883 | 8191 |
| | 13701 | 14972 | 3068 | 11055 | 13245 | 907 | 1811 | 17743 | 3222 | 22379 | 5180 | 8300 |
| | 10258 | 19899 | 11656 | 9989 | | | | | | | | |
| 369: | 12917 | 22561 | 8545 | 4583 | 16643 | 6177 | 17097 | 3916 | 4541 | 14252 | 13870 | 6493 |
| | 5606 | 20188 | 10820 | 20279 | 8970 | 21193 | | | | | | |
| 370: | 4823 | 10748 | 15527 | 15435 | 796 | 14678 | 9764 | 10076 | 11244 | 9175 | 7609 | 5115 |
| | 21377 | 11924 | 10595 | 20985 | 18928 | 3164 | 9788 | 11682 | 14840 | 9374 | 7368 | 12999 |
| | 6258 | 1876 | 19771 | 13726 | 657 | 7929 | 12344 | 4713 | 4417 | 19488 | 11641 | 3883 |
| | 6787 | 11345 | 16897 | 10763 | 19559 | 1322 | | | | | | |
| 371: | 7873 | 16841 | 5024 | 667 | 14126 | 19489 | 20718 | 20114 | 6307 | 13749 | 4296 | 12328 |
| | 20713 | 14817 | 9449 | 17512 | 12753 | 3363 | 11373 | 19490 | 20600 | 14723 | 1330 | 10565 |
| | 10981 | 22124 | 10789 | 16941 | 4863 | 19070 | 12635 | 18547 | 1307 | 13095 | 22242 | 5955 |
| | 10082 | 21555 | 19391 | 1056 | 17810 | 15497 | 12220 | 6532 | 15511 | 7786 | 2790 | 6035 |
| | 18667 | 7196 | 17474 | 2121 | 6729 | 19563 | 5810 | 3048 | 746 | 3566 | 16497 | 12050 |
| | 8774 | 22138 | 1519 | 13512 | 22303 | 2143 | 10708 | 12991 | 12651 | 3454 | 16182 | 10091 |
| | 18474 | 18979 | 19291 | 18720 | 9390 | 8536 | 17155 | 6630 | 10710 | 15964 | 7870 | 4033 |
| | 10458 | 1637 | 16790 | 15145 | 11065 | 1445 | 18055 | 8688 | 19251 | 19006 | 13222 | 19365 |
| | 2339 | 7595 | 4454 | 13908 | 19220 | 15364 | 18914 | 10062 | 2726 | 22250 | 16571 | 5841 |
| | 19972 | 14541 | 2092 | 17011 | 19981 | 20191 | 13421 | 15044 | 15913 | 3884 | 17551 | 14501 |
| | 21005 | 6049 | 4670 | 18512 | 20116 | 22469 | 12494 | 12091 | 21526 | 21355 | 8895 | 11631 |
| | 16944 | 11810 | 10807 | 21779 | 906 | 756 | 15963 | 10502 | 12400 | 1579 | 15470 | 8436 |
| | 8930 | 2675 | 20539 | 7266 | 19290 | 13829 | 1855 | 2679 | 8784 | 9380 | 16462 | 6530 |
| | 22546 | 22416 | 17960 | 15631 | 1720 | 21887 | 5290 | 18327 | 18553 | 4590 | 7391 | 7917 |
| | 14645 | 15614 | 13247 | 14642 | 12300 | 11299 | 19418 | 1740 | 14311 | 18764 | 7547 | 14528 |
| | 635 | 9762 | 6404 | 17436 | 12422 | 16799 | 6528 | 15127 | 16603 | 13586 | 8483 | 3332 |
| | 2647 | 22390 | 2094 | 17405 | 13174 | 3330 | 5025 | 17812 | 3810 | 19126 | 12711 | 9225 |
| | 18885 | 11043 | 21479 | 7774 | 21789 | 17915 | 1800 | 13040 | 16606 | 13023 | 2103 | 2956 |
| | 11730 | 6062 | 11525 | 15548 | 21598 | 14233 | 4710 | 17481 | 6481 | 20502 | 21631 | 14591 |
| | 703 | 7865 | 21847 | 18542 | 17238 | 15120 | 19632 | 2874 | 12903 | 20473 | 16809 | 19278 |
| | 15968 | 14351 | 21898 | 19284 | 8790 | 7247 | 6870 | 19794 | 764 | 16079 | 17554 | 10015 |
| | 14157 | 5749 | 18287 | 4764 | 3645 | 13045 | 14959 | 2521 | 18913 | 21473 | 9257 | 12508 |
| | 4304 | 1449 | 12138 | 6240 | 11499 | 7386 | 10591 | 20874 | 4447 | 5379 | 5272 | 10120 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 8267 | 6643 | 6108 | 22137 | 17643 | 4910 | 15972 | 4782 | 15186 | 2068 | 5528 | 12337 |
| | 11658 | 13756 | 3142 | 15763 | 12030 | 13236 | 17079 | 5380 | 18622 | 5896 | 4307 | 3158 |
| | 17067 | 12487 | 14339 | 613 | 6726 | 15106 | 15675 | 11379 | 7371 | 5597 | 12017 | 17274 |
| | 14824 | 18417 | 20721 | 11498 | 16295 | 15954 | 12677 | 9580 | 12641 | 17409 | 19499 | 9907 |
| | 10576 | 21600 | 1559 | 1247 | 18152 | 17273 | 13554 | 16429 | 16780 | 20611 | 10103 | 3507 |
| | 20153 | 6861 | 13556 | 3496 | 16183 | 11289 | 3492 | 3006 | 5273 | 3374 | 9357 | 22451 |
| | 22004 | 19394 | 18283 | 11166 | 15318 | 8768 | 18770 | 9309 | 16332 | 16630 | 17527 | 9479 |
| | 8561 | 16576 | 10695 | 18749 | 17951 | 10930 | 9616 | 3752 | 10469 | 2422 | 4538 | 18515 |
| | 20865 | 7082 | 1739 | 12250 | 6190 | 16535 | 9858 | 7630 | 15712 | 2642 | 22497 | 1808 |
| | 8526 | 18181 | 7296 | 21659 | 16761 | 14816 | 21998 | 13413 | 14852 | 10402 | 11131 | 6668 |
| | 16521 | 11910 | 2019 | 5412 | 11257 | 11346 | 4369 | 17646 | 5667 | 12585 | 1224 | 11092 |
| | 5532 | 10200 | 16673 | 17220 | 17006 | 6359 | 17169 | 14019 | 20289 | 17599 | 5659 | 9944 |
| | 9538 | 3683 | 3521 | 19933 | 16463 | 13655 | 5686 | 21698 | 20758 | 784 | 11603 | 2553 |
| | 8439 | 21559 | 7563 | 14314 | 13522 | 15633 | 1741 | 1518 | 15412 | 5891 | 1375 | 2785 |
| | 14686 | 15611 | 21250 | 11653 | 21545 | 17884 | 18298 | 2764 | 3864 | 12813 | 11218 | 5410 |
| | 16378 | 1570 | 7383 | 9592 | 15460 | 16787 | 1050 | 10032 | 6964 | 19685 | 13788 | 11507 |
| | 3504 | 17418 | 3664 | 20387 | 12935 | 8777 | 20035 | 14635 | 11626 | 3618 | 6519 | 743 |
| | 1923 | 12738 | 13872 | 12436 | 5348 | 10557 | 14330 | 1015 | 17903 | 15405 | 4174 | 2069 |
| | 16438 | 1021 | 19206 | 4166 | 13172 | 10851 | 2780 | 1326 | 13679 | 7285 | 11220 | 4129 |
| | 8228 | 10294 | 19721 | 22543 | 1447 | 5468 | 4193 | 6618 | 3849 | 14474 | 3736 | 3595 |
| | 18582 | | | | | | | | | | | |
| 372: | 1006 | 429 | 14179 | 7479 | 10217 | 535 | 533 | 507 | 306 | 478 | 12575 | 314 |
| | 2254 | 5697 | 5950 | 15642 | 18461 | 5073 | 9804 | 18997 | 8666 | 5240 | 3659 | 6320 |
| | 6367 | 19001 | 6157 | 11916 | 21356 | 2258 | 11071 | 9857 | 2163 | 2584 | 3331 | 526 |
| | 15153 | 20086 | 6423 | 4662 | 3838 | 14933 | 8860 | 19820 | 15915 | 7403 | 13646 | 4850 |
| | 4714 | 9730 | 12137 | 14919 | 12016 | 19643 | 3913 | 17315 | 7812 | 21939 | 13951 | 1478 |
| | 7199 | 10536 | 9491 | 3917 | 18676 | 15376 | 4608 | 16936 | 20333 | 1999 | 7216 | 1589 |
| | 17342 | 21640 | 8527 | 5069 | 16880 | 19870 | 10959 | 4725 | 15069 | 13329 | 20496 | 5944 |
| | 17598 | 6786 | 7612 | 14232 | 18318 | 534 | 531 | 286 | 4110 | 10546 | 16887 | 4811 |
| | 15616 | 10586 | 10067 | 4095 | 692 | 11756 | 20433 | 13391 | 9954 | 10468 | 16270 | 7655 |
| | 21719 | 5755 | 4146 | 2857 | 17664 | 21589 | 11961 | 18800 | 19154 | 879 | 12644 | 16878 |
| | 2030 | 4833 | 21437 | 5428 | 11195 | 20933 | 21506 | 3533 | 8904 | 13072 | 4677 | 18511 |
| | 4730 | 696 | 9569 | 17797 | 18687 | 7097 | 20259 | 15252 | 13221 | 450 | 11335 | 20777 |
| | 12713 | 22502 | 14915 | 21157 | 20371 | 3563 | 12591 | 16308 | 7626 | 4212 | 19798 | 19458 |
| | 5691 | 18292 | 16130 | 21296 | 2832 | 830 | 14553 | 6434 | 18295 | 17956 | 829 | 476 |
| | 12043 | 20779 | 1281 | 17745 | 16586 | 7955 | 12705 | 15449 | 988 | 20859 | 1768 | 11129 |
| | 6547 | 22518 | 5552 | 9854 | 11376 | 6669 | 5359 | 9132 | 10964 | 1879 | 22087 | 13137 |
| | 17298 | 3333 | 13752 | 20301 | 19370 | 2425 | 6946 | 19538 | 14273 | 15340 | 6427 | 17165 |
| | 15603 | 12419 | 10809 | 8003 | 13658 | 4221 | 14064 | 22249 | 7387 | 13284 | 20981 | 2316 |
| | 3116 | 8418 | 3386 | 6508 | 18217 | 3578 | 992 | 13442 | 3471 | 14855 | 19949 | 5277 |
| | 19885 | 2816 | 10917 | 9436 | 18538 | 18659 | 12816 | 12308 | 15943 | 2515 | 20364 | 14701 |
| | 8193 | 17579 | 22076 | 8890 | 2649 | 9329 | 21073 | 8376 | 15177 | 10882 | 859 | 16053 |
| | 5990 | 9814 | 14918 | 5209 | 3144 | 13848 | 22428 | 19076 | 5454 | 17056 | 4088 | 11270 |
| | 5837 | 9604 | 22455 | 19840 | 1656 | 12234 | 1149 | 801 | 953 | 9960 | 21301 | 5581 |
| | 3755 | 12278 | 22119 | 21098 | 1005 | 10264 | 13037 | 11702 | 20954 | 5063 | 1118 | 6454 |
| | 20632 | 1696 | 19474 | 14911 | 9381 | 4111 | 13374 | 2932 | 3071 | 18551 | 22362 | 12923 |
| | 1431 | 6509 | 19229 | 14012 | 5372 | 12362 | 17380 | 20272 | 16391 | 9540 | 13395 | 5132 |
| | 901 | 19228 | 14568 | 17630 | 2371 | 4694 | 12396 | 15369 | 16597 | 3697 | 10741 | 16309 |
| | 4927 | 13396 | 21621 | 8841 | 16662 | 11120 | 14081 | 8692 | 9484 | 15204 | 6565 | 14320 |
| | 2978 | 9294 | 7482 | 9493 | 1277 | 4952 | 7813 | 7306 | 12296 | 12021 | 6645 | 9286 |
| | 22489 | 13745 | 16653 | 19069 | 7780 | 15219 | 16969 | 14762 | 18330 | 10802 | 10479 | 16663 |
| | 3678 | 16713 | 7751 | 13703 | 3630 | 4691 | 9472 | 10709 | 8542 | 7060 | 6112 | 22457 |
| | 21974 | 20476 | 7333 | 6482 | 14526 | 7151 | 2644 | 835 | 10655 | 12264 | 9315 | 2786 |
| | 16253 | 9488 | 5634 | 17372 | 788 | 9280 | 22095 | 18903 | 3706 | 15256 | 18593 | 5764 |
| | 11115 | 12583 | 11568 | 13613 | 2331 | 5136 | 8073 | 15998 | 5630 | 11304 | 19137 | 5817 |
| | 5580 | 18341 | 8588 | 12540 | 2454 | 4970 | 17445 | 2401 | 11869 | 6193 | 21516 | 10889 |
| | 5190 | 13207 | 16465 | 9673 | 9771 | 11716 | 18575 | 9584 | 12794 | 21399 | 20485 | 9218 |
| | 18691 | 14036 | 3350 | 18263 | 4846 | 544 | 19667 | 9933 | 4140 | 1318 | 20418 | 11128 |
| | 20105 | 16734 | 2376 | 15699 | 7061 | 4232 | 15357 | 5339 | 7107 | 19030 | 7165 | 21370 |
| | 12103 | 4848 | 13211 | 22530 | 15360 | 12863 | 9975 | 6398 | 14067 | 16683 | 21170 | 1924 |
| | 890 | 8155 | 15866 | 10131 | 7187 | 4332 | 1235 | 20330 | 12927 | 7088 | 5099 | 2302 |
| | 12424 | 8303 | 17466 | 14322 | 11383 | 2282 | 15956 | 3414 | 12982 | 18548 | 15665 | 10961 |
| | 21084 | 10824 | 18440 | 16819 | 3730 | 13940 | 18821 | 14864 | 1818 | 19607 | 7969 | 6546 |
| | 16771 | 5441 | 8459 | 18266 | 5000 | 15749 | 13014 | 14274 | 8444 | 4707 | 13097 | 15930 |
| | 11872 | 2621 | 7158 | 6942 | 18502 | 5408 | 10837 | 21928 | 13800 | 5188 | 19614 | 16117 |
| | 4719 | 1833 | 13499 | 3107 | 21492 | 12503 | 21929 | 7921 | 1429 | 14398 | 22189 | 6439 |
| | 12993 | 12307 | 19714 | 6650 | 18994 | 747 | 5932 | 18630 | 6683 | 1921 | 15651 | 5594 |
| | 6958 | 13597 | 19763 | 10097 | 19882 | 14124 | 14687 | 1094 | 5780 | 7770 | 7688 | 15110 |
| | 5797 | 7907 | 21169 | 3329 | 12627 | 4065 | 22067 | 19211 | 2061 | 7038 | 8909 | 16914 |
| | 13129 | 19881 | 16317 | 1551 | 13235 | 14888 | 1201 | 20264 | 7800 | 7526 | 2209 | 5887 |
| | 10798 | 15317 | 10223 | 11351 | 10105 | 10661 | 15014 | 2908 | 16412 | 22277 | 19851 | 12003 |
| | 19616 | 11003 | 7768 | 6166 | 4620 | 13850 | 16231 | 7016 | 20541 | 3458 | 1240 | 15787 |
| | 20099 | 9282 | 11480 | 4994 | 6281 | 18662 | 7992 | 9661 | 19875 | 11156 | 3619 | 14086 |
| | 20948 | 16946 | 3456 | 6143 | 786 | 6709 | 5954 | 17926 | 20839 | 22351 | 13277 | 15113 |
| | 6368 | 7704 | 18694 | 3644 | 12154 | 3794 | 21257 | 21638 | 18386 | 18111 | 21498 | 10731 |

TABLE 17-continued

Sequence IDs for homolog proteins

| Seq ID NO: | homolog Seq ID NOs | | | | | | | | | | |
|---|---|---|---|---|---|---|---|---|---|---|---|
| | 13776 | 5539 | 14530 | 20282 | 7762 | 9529 | 17675 | 15191 | 12380 | 14865 | 15825 | 2818 |
| | 16442 | 5901 | 8220 | 18578 | 13297 | 2495 | 21913 | 4526 | 16085 | 10965 | 15558 | 8891 |
| | 13161 | 15189 | 10152 | 3256 | 22258 | 1748 | 21271 | 13226 | 10136 | 22036 | 22190 | 18982 |
| | 10154 | 20726 | 17115 | 12652 | 2984 | 12623 | 1426 | 4475 | 16706 | 17850 | 21904 | 11245 |
| | 427 | 304 | 477 | 545 | 2132 | 20312 | 4655 | 16568 | 21093 | 13882 | 5730 | 7976 |
| | 7079 | 13035 | 14619 | 7273 | 2800 | 12728 | 15228 | 8972 | 19263 | 509 | 305 | 16894 |
| | 12545 | 2037 | 11704 | 9571 | 21379 | 3712 | 7685 | 4483 | 18456 | 22341 | 11197 | 13107 |
| | 22106 | 6203 | 19049 | 10427 | 16006 | 11733 | 8133 | 2264 | 12866 | 13782 | | |
| 373: | 21829 | 10688 | 1896 | 2695 | 15238 | 6923 | 13321 | 678 | 19909 | 6620 | 21886 | 4554 |
| | 4937 | 9312 | 12000 | 1954 | 4679 | 2233 | 18331 | 21411 | | | | |
| 374: | 6020 | 13479 | 5421 | 1087 | 1989 | 14406 | 16303 | 744 | 882 | 12075 | 4026 | 22268 |
| | 4422 | 9416 | 14897 | 9425 | 12945 | 10738 | 8798 | 854 | 13950 | 9451 | 21908 | 8474 |
| | 22358 | 10772 | 3605 | 17605 | 21264 | 20769 | 15607 | 2985 | 11015 | 4905 | 7656 | 19436 |
| | 14257 | 8375 | 8062 | 4389 | 12310 | 14819 | 10371 | 1341 | 10899 | 5014 | 18145 | 16619 |
| | 22100 | 13463 | 2860 | 1177 | 15365 | 14952 | 17870 | 14006 | 9642 | 5832 | 1504 | 11884 |
| | 15546 | 4286 | 20157 | 10385 | 20872 | 9791 | 8771 | 2815 | 22262 | 21484 | 5747 | 8299 |
| | 21256 | 22118 | 17091 | 16759 | 13043 | 22140 | 18776 | 20913 | 940 | 1270 | 18159 | 1798 |
| | 2743 | 20782 | 13248 | 7678 | 22155 | 12200 | 20855 | 14226 | 12099 | 17769 | 164191 | 2580 |
| | 3054 | 20908 | 14508 | 1936 | 4781 | 6302 | 8832 | 7652 | 17179 | 5548 | 11581 | 15473 |
| | 20439 | 4751 | 15772 | 5864 | 2710 | 20430 | 12577 | 14048 | 13591 | 22217 | 16257 | 11511 |
| | 9747 | 18047 | 5923 | 8265 | 7628 | 7942 | 7892 | 18958 | 3784 | 7603 | 8156 | 22139 |
| | 12033 | 735 | | | | | | | | | | |
| 375: | 17388 | 7507 | 6853 | 5756 | 19170 | 605 | 19514 | 774 | 18117 | 6385 | 7365 | 5325 |
| | 15832 | 13388 | 6982 | 805 | 9639 | 15679 | 21883 | | | | | |
| 376: | 6489 | 1778 | 6165 | 13947 | 15105 | 6175 | 12001 | 16671 | 13761 | 6928 | 4769 | 20271 |
| | 21491 | 10938 | 7900 | 12795 | 10505 | 14143 | 12592 | 21354 | 13777 | 3510 | 5052 | 16591 |
| | 12548 | 849 | 3088 | 6774 | 12148 | 9161 | 12039 | 2189 | 17027 | 1969 | 2627 | 11841 |
| | 9768 | 10979 | 13916 | 11981 | 6032 | 1926 | 3963 | 5427 | 18199 | 9453 | 4199 | 2366 |
| | 9495 | 7328 | | | | | | | | | | |
| 377: | 15533 | 9191 | 10043 | 2753 | 19146 | 7790 | 4261 | 10984 | 17984 | 14174 | 13472 | 11804 |
| | 22074 | 3317 | 10460 | 14013 | 11181 | 20629 | 17263 | 5966 | 14272 | 21460 | 17175 | 8369 |
| | 11952 | 21759 | 11479 | 16405 | 2498 | 10527 | | | | | | |
| 378: | 22075 | 3099 | 19424 | 9211 | 2977 | 18514 | 18017 | 15584 | 2234 | 15782 | 4438 | 4584 |
| | 3716 | 9235 | 16307 | 16304 | 1846 | 2682 | 20821 | 956 | 5704 | 7923 | 18167 | 11822 |
| | 6140 | 3047 | 10275 | 21133 | 18224 | 5583 | 15900 | 13725 | 19275 | 17302 | 20181 | 18021 |
| | 3015 | 5962 | 12164 | 9319 | 20992 | 4622 | 8799 | 22151 | 20338 | 14742 | 22201 | 10555 |
| | 17777 | 10102 | 7163 | 15444 | 9363 | 21307 | 8269 | 10110 | 4429 | 6632 | 20691 | 9638 |
| | 14736 | 14020 | 10138 | 20244 | 11555 | 5116 | 14225 | 2312 | 21414 | 10821 | 2249 | 22550 |
| | 13699 | 938 | 20457 | 5430 | 12992 | 13398 | | | | | | |
| 379: | 2406 | 15415 | 587 | 9691 | 5895 | 21357 | 17711 | 19549 | 17251 | 13715 | | |
| 380: | 10085 | 21760 | 4289 | 13995 | 7446 | 9558 | 14863 | 11606 | 20045 | 17971 | 9039 | 18616 |
| | 9373 | 14535 | 4825 | 12951 | 3787 | 17677 | 5214 | 18052 | 6875 | 18135 | 21630 | 5232 |
| | 20890 | 1770 | 10991 | 8146 | 11813 | 4697 | 17003 | 7055 | | | | |
| 381: | 21131 | 21645 | 7243 | 20820 | 5674 | 11731 | 6667 | 10151 | 4817 | 4113 | 1832 | 17312 |
| | 4832 | 4163 | 2924 | 20194 | 9682 | 19740 | 4054 | 16537 | 8531 | 19852 | 9450 | 8277 |
| | 12513 | 18904 | 5869 | 17443 | 18723 | 22349 | 1228 | 589 | 14210 | 7986 | 10598 | 6036 |
| | 822 | 5873 | 20860 | 8502 | 1122 | 16499 | 3922 | 18794 | 17929 | 19216 | 19270 | 21895 |
| | 2758 | 12314 | 2468 | 11214 | 6717 | 21474 | 11827 | 3203 | 6754 | 13557 | 17019 | 1712 |
| | 19477 | 13019 | 5645 | 10923 | 3817 | 6215 | 7503 | 816 | 4760 | 3589 | 12238 | 12773 |
| | 10459 | 10744 | 9856 | 10749 | 18103 | 19048 | 3457 | 21457 | 19189 | 16910 | 16867 | 19415 |
| | 16265 | 3682 | 16610 | 16470 | 16356 | 21013 | 5777 | 8013 | 18006 | | | |
| 382: | 19957 | 3226 | 10525 | 8530 | 7982 | 3708 | 16506 | 20265 | 19422 | 17319 | 17973 | 16769 |
| | 6887 | 12979 | 5654 | 18163 | | | | | | | | |
| 383: | 8694 | 8251 | 3871 | 9924 | 7519 | 16224 | 22555 | 14009 | | | | |
| 384: | 12702 | 17415 | 4664 | 4449 | 4325 | 19760 | 21746 | 3267 | 10368 | 3093 | 11350 | 3531 |
| | 16380 | 21838 | 19608 | 11587 | 8367 | 20351 | 2902 | 19733 | 18161 | 18210 | 22500 | 20226 |
| | 13535 | 5126 | 18613 | 16364 | 11894 | 11183 | 4057 | 11226 | 17119 | 9098 | 3211 | 2185 |
| | 20288 | 20489 | 21647 | 4103 | 11973 | 11885 | 10260 | 12393 | 7832 | 4511 | 20170 | 1928 |
| | 13833 | 21900 | 14890 | 1027 | 7922 | 6811 | 5790 | 14015 | 17065 | 6010 | 13795 | 9245 |
| | 9566 | 11876 | 8337 | 15174 | 2263 | 19217 | 5530 | 9598 | 9388 | 1659 | 10101 | 17925 |
| | 9717 | 14228 | 12740 | 14255 | 18590 | 12269 | 14674 | 17257 | 22064 | 8551 | 1059 | 11112 |
| | 5338 | 15072 | 18204 | 15279 | 6969 | 14944 | 11583 | 18391 | 14690 | 6503 | 2317 | 785 |
| | 6692 | 22080 | 20243 | 22421 | 4743 | 11968 | 5398 | 1750 | 12965 | 11391 | 12878 | 4721 |
| | 9384 | 20075 | 5074 | 2118 | 14173 | 6821 | 5012 | 9798 | 11794 | 9811 | 10818 | 7495 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 4569 | 11830 | 12957 | 2497 | 1617 | 4507 | 10667 | 12465 | 5796 | 18993 | 12481 | 3573 |
| | 13319 | 20523 | 21343 | 19968 | 8041 | 15867 | 18712 | 11232 | 18921 | 4109 | 16995 | 2484 |
| | 14332 | 5833 | 21284 | 1405 | 18264 | 14069 | 17528 | 20295 | 17890 | 20822 | 18580 | 1268 |
| | 2953 | 21324 | 21132 | 13085 | 21661 | 13618 | 87813 | 234 | 5382 | 11592 | 6749 | 16229 |
| | 5848 | 4012 | 12378 | 1929 | 19687 | 9013 | 10182 | 7228 | 2028 | 14882 | 10560 | 6987 |
| | 11978 | 10065 | 16975 | 15791 | 15013 | 5286 | 17958 | 17087 | 8422 | 21303 | 2200 | 3761 |
| | 1089 | 18218 | 15951 | 21747 | 17124 | 2300 | 8857 | 8486 | 8383 | 19233 | 3427 | 1197 |
| | 12998 | 7171 | 8654 | 10108 | 13462 | 17054 | 18871 | 15851 | 8291 | 18960 | 4494 | 15966 |
| | 22488 | 18543 | 7773 | 12235 | 12178 | 22041 | 19129 | 20411 | 2027 | 19172 | 15806 | 6469 |
| | 6370 | 22096 | 4105 | 13426 | 4809 | 19640 | 4659 | 12156 | 13332 | 9311 | 588 | 10476 |
| | 22560 | 15961 | 14413 | 21548 | 7803 | 12072 | 17825 | 16719 | 17270 | 21888 | 3990 | 11256 |
| | 4092 | 19664 | 21590 | 20602 | 20735 | 3685 | 16999 | 11453 | 18129 | 8997 | 1186 | 3952 |
| | 7692 | 11037 | 17899 | 10950 | 13564 | 21682 | 15755 | 6178 | 12242 | 16297 | 14421 | 11436 |
| | 3560 | 21531 | 1486 | 13983 | 14970 | 9231 | 6305 | 2459 | 19412 | 13256 | 16829 | 9649 |
| | 11045 | 1317 | 16681 | 21053 | 19661 | 21038 | 7395 | 6841 | 1114 | 9000 | 14705 | 10494 |
| | 9108 | 17796 | 20404 | 8446 | 10945 | 13307 | 15299 | 1073 | 16289 | 6701 | 11667 | 17949 |
| | 18645 | 17044 | 20488 | 19663 | 20206 | 14400 | 4114 | 15577 | 20198 | 18423 | 6253 | 6078 |
| | 16870 | 15568 | 10782 | 8621 | 17031 | 19360 | 1692 | 11227 | 9123 | 16836 | | |
| 385: | 2321 | 2906 | 21872 | 10635 | 21078 | 7065 | 15156 | 1425 | 16772 | 13825 | 20591 | 13813 |
| | 12899 | 1192 | 19892 | 18999 | 8889 | 11465 | 20504 | 3946 | 12048 | 20666 | 9727 | 18484 |
| | 4435 | 1280 | 12630 | 17995 | 1807 | 1366 | 12411 | 2542 | 17186 | 15294 | 18206 | 15878 |
| | 13956 | 14389 | 4053 | 13057 | 11138 | 9564 | 13365 | 14654 | 2060 | 6116 | 1599 | 22293 |
| | 3117 | 16686 | 18549 | 738 | 1017 | 18097 | 20366 | 10906 | 7412 | 972 | 3303 | 9331 |
| | 22033 | 22401 | 5340 | 18297 | 5439 | 11324 | 19746 | 22005 | 10666 | 2640 | 21017 | 10814 |
| | 15503 | 15916 | 4700 | 10384 | 8762 | 17479 | 12301 | 18760 | 11416 | 17765 | | |
| 386: | 7205 | 16239 | 22108 | 14974 | 15094 | 21071 | 5878 | 17987 | 14219 | 8882 | 17848 | 8491 |
| | 10730 | 10766 | 11279 | 3262 | 17261 | | | | | | | |
| 387: | 11850 | 8199 | 14384 | 16243 | 558 | 13030 | 19215 | 3479 | 17782 | 5827 | 19788 | 4416 |
| | 9270 | 4145 | 3077 | 7366 | 3904 | 3442 | 6662 | 14375 | 15690 | 11650 | 11821 | 1949 |
| | 1649 | 4587 | 11211 | 6236 | 21165 | 7837 | 18707 | 13824 | 13754 | 3121 | 9516 | 1966 |
| | 16645 | 15795 | 15859 | 18232 | 16579 | 16020 | 15502 | 22210 | 11865 | 21270 | 5088 | 2239 |
| | 6314 | 11933 | 1605 | 15281 | 22051 | 13665 | 9116 | 6153 | 21677 | 5334 | 21914 | 20518 |
| | 6808 | 1927 | 14427 | 10241 | 5400 | 1667 | 20796 | 14866 | 19395 | 5422 | 7965 | 11136 |
| | 5440 | 20442 | 14551 | 4855 | 21855 | 2066 | 15805 | 15888 | 3582 | 2334 | 3800 | 4016 |
| | 7072 | 16877 | 16230 | 17326 | 7806 | 2071 | 7990 | 18865 | 641 | 16590 | 21955 | 17280 |
| | 17308 | 2396 | 13681 | 3877 | 6148 | 11519 | | | | | | |
| 388: | 3596 | 7515 | 17959 | 3549 | 15024 | 13576 | 15991 | 5407 | 13215 | 8370 | 14374 | 9790 |
| | 11193 | 17162 | 12026 | 4861 | 2328 | 9153 | 3383 | 2598 | 20929 | 5662 | 2982 | 14262 |
| | 15841 | 5775 | 18375 | | | | | | | | | |
| 389: | 1348 | 15757 | 11966 | 16108 | 15222 | 19104 | 21321 | 4489 | 18184 | 6470 | 8478 | 20190 |
| | 12628 | 857 | 9167 | 18660 | 16328 | 21136 | 12320 | 10268 | 9965 | 9361 | 754 | 20342 |
| | 17110 | 8283 | 11192 | 16702 | 18986 | 16654 | 9350 | 12474 | 2031 | 22089 | 14245 | 18814 |
| | 2961 | 13231 | 21209 | 11352 | 13736 | 3385 | 5559 | 5208 | 19587 | 21576 | 13363 | 21166 |
| | 21877 | 19184 | 16154 | 13751 | 7235 | 18147 | 10895 | 7829 | 1343 | 5632 | 11790 | 12936 |
| | 5995 | 4717 | 22228 | 14767 | 9074 | 21907 | 10830 | 11760 | 8348 | 21924 | 13987 | 8023 |
| | 20096 | 10747 | 11879 | 2097 | 22475 | 2738 | 9421 | 8592 | 11715 | 20682 | 10679 | 9928 |
| 390: | 11664 | 19373 | 14010 | 12174 | 19349 | 11769 | 4498 | 2274 | 21231 | 2630 | 10572 | 10953 |
| | 8931 | 12005 | 7156 | 11098 | 17092 | 4856 | 20031 | 3585 | 18340 | 15441 | 19792 | 8259 |
| | 5870 | 21654 | 18857 | 1161 | 9343 | 17931 | 22246 | 9364 | | | | |
| 391: | 10049 | 13487 | 22261 | 19856 | 31197 | 34221 | 599 | 5351 | 21514 | 16751 | 9423 | 5727 |
| | 5042 | 8667 | 12431 | 7989 | 2965 | 4617 | 5682 | 19205 | 18518 | 12013 | 6053 | 9576 |
| | 5713 | 11119 | 9862 | 16190 | | | | | | | | |
| 392: | 18732 | 10751 | 14514 | 17429 | 18757 | 4995 | 12463 | 17063 | 16460 | 10638 | 21916 | 17344 |
| | 6287 | 10622 | 9084 | 7641 | 13773 | 14486 | 3055 | 1922 | 8058 | 12612 | 3059 | 4605 |
| | 19053 | 5881 | 16145 | 10408 | 6114 | 13634 | 14741 | 604 | 18842 | 18868 | 21777 | 10350 |
| | 10325 | 1510 | 2222 | 7494 | 12825 | 2470 | 17446 | 15874 | 22549 | 13588 | 17843 | 20862 |
| 393: | 14137 | 6491 | 1356 | 15653 | 9544 | 17800 | 4657 | 6563 | 18761 | 19273 | 9502 | 12445 |
| | 4359 | 12437 | 16199 | 18995 | 2176 | 8009 | 10587 | 4063 | 4005 | 20824 | 17620 | 19815 |
| | 19234 | 17093 | 19511 | 10545 | 5626 | 9305 | 16800 | 12265 | 9897 | 6943 | 20358 | 12184 |
| | 3707 | 16211 | 21688 | 10582 | 3368 | 2742 | 2365 | 10339 | 3898 | 8612 | 3028 | 11721 |
| | 15331 | 5828 | 13918 | 3634 | 19884 | 16538 | 1111 | 1554 | 14399 | 14371 | 5104 | 1829 |
| | 8104 | 17482 | 13063 | 16292 | 21720 | 7729 | 11408 | 5629 | 16271 | 21292 | 11860 | 3424 |
| | 9033 | 21268 | 21695 | 15296 | 18354 | 4934 | 13381 | 16156 | 13739 | 13034 | 4472 | 20876 |
| | 17313 | 16924 | 12087 | 18839 | 13963 | 22413 | 3248 | 944 | 6344 | 11007 | 8619 | 11418 |
| | 9828 | 5268 | 14031 | 21703 | 8516 | 10388 | 866 | 2809 | 7449 | 17438 | 17555 | 16805 |
| | 1636 | 15432 | 1152 | 10419 | 17275 | 12821 | 6115 | 15623 | 5603 | 15002 | 12960 | |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| 394: | 3202 | 16855 | 14393 | 16047 | 12109 | 20443 | 2004 | 17625 | 4349 | 19221 | 15436 | 5819 |
| | 17066 | 19649 | 12670 | 1965 | 14910 | 21969 | 9893 | 3600 | 12536 | 3822 | 12850 | 4180 |
| | 6132 | 13648 | 21798 | 18884 | 15981 | 21322 | 10336 | 20424 | 7005 | 13279 | 15017 | 2477 |
| | 13011 | 10124 | 4373 | 14416 | 7377 | 13006 | 8088 | 4485 | 10568 | 6181 | 12408 | 4013 |
| | 2391 | 10416 | 1220 | 14803 | 9678 | 2564 | 13861 | 16954 | 3199 | 4561 | 21312 | 6627 |
| | 14292 | 4410 | 5823 | 16748 | 12403 | 14414 | 8669 | 12884 | 734 | 17278 | 562 | 6518 |
| | 1881 | 4518 | 21380 | 6494 | 15852 | 17368 | 13840 | 12084 | 19239 | 3091 | 7517 | 5984 |
| | 14268 | 4629 | 5191 | 19861 | 16641 | 17406 | 4144 | 18973 | 21415 | 21258 | 6950 | 14555 |
| | 7041 | 13342 | 18344 | 19371 | 17541 | 1834 | 8664 | 16235 | 11478 | 14116 | 6540 | 10401 |
| | 15100 | 22060 | 16196 | 11176 | 13397 | 19092 | 19747 | 10990 | 13435 | 9728 | 7131 | 8313 |
| | 8349 | 9269 | 11964 | 1483 | 16810 | 1500 | 2320 | 14402 | 11184 | 3721 | 1256 | 10000 |
| | 920 | 14238 | 8919 | 5685 | 20117 | 4235 | 9693 | 6412 | 5084 | 10715 | 7364 | 9817 |
| | 5924 | 6015 | 15928 | 18253 | 21113 | 17516 | 623 | 7726 | 7224 | 14801 | 7682 | 8966 |
| | 18692 | 11054 | 14527 | | | | | | | | | |
| 395: | 15084 | 19366 | 8811 | 1190 | 6727 | 4321 | 12649 | 19433 | 12507 | 3995 | 12015 | 20152 |
| | 21429 | 17657 | 22463 | 5534 | 8079 | 16111 | 6899 | 3734 | 13762 | 19928 | 19272 | 17507 |
| | 6452 | 12037 | 16857 | 11523 | 12569 | 6792 | 18238 | 5763 | 14939 | 12699 | 21275 | 3930 |
| | 16987 | 2452 | 2193 | 21219 | 4796 | 14984 | 6885 | 7888 | 6130 | 13135 | 14954 | 1935 |
| | 2387 | 6161 | 8499 | 19730 | 6609 | 2287 | 21882 | 2634 | 15588 | 11487 | 4376 | 17509 |
| | 21610 | 2093 | 18802 | 7506 | 11993 | 4406 | 20544 | 8974 | 1016 | 16510 | 12662 | 20736 |
| | 14836 | 15691 | 17920 | 7734 | 11742 | 21957 | 21727 | 7743 | 12157 | | | |
| 396: | 14699 | 6724 | 12500 | 6101 | | | | | | | | |
| 397: | 4537 | 6708 | 17900 | 6960 | 21012 | 6873 | 21604 | 2141 | 7919 | 10956 | 4205 | 10702 |
| | 6611 | 13911 | 7162 | 10797 | 21569 | 16752 | 6012 | 6869 | | | | |
| 398: | 16076 | 2321 | 4451 | 19562 | 5982 | 1411 | 2156 | 12558 | 8727 | 16772 | 14543 | 9800 |
| | 22191 | 22531 | 13050 | 12479 | 8829 | 9890 | 18225 | 2623 | 2538 | 1627 | 16157 | 3656 |
| | 21344 | 15134 | 15798 | 9715 | 5142 | 2700 | 1902 | 22110 | 11093 | 7017 | 1409 | 20559 |
| | 10443 | 9498 | 11500 | 15719 | | | | | | | | |
| 399: | 5094 | 13921 | 11673 | 21082 | 2690 | 17779 | 21361 | 3853 | 21213 | 10839 | 20373 | 8089 |
| | 10464 | 18576 | 8718 | 15705 | 2229 | 4135 | 17410 | 12062 | 1263 | 10684 | 4844 | 14376 |
| | 13578 | 8589 | 10573 | 17122 | 19674 | 11088 | 5570 | 7753 | 17311 | 3616 | 11735 | 4466 |
| | 20847 | 13877 | 22288 | 22274 | 8170 | 8179 | 8272 | 5234 | 21652 | 20395 | 3764 | 17831 |
| | 14489 | 8729 | 13018 | 2082 | 3516 | 719 | 14264 | 7662 | 13451 | 8424 | 15025 | 6352 |
| | 2590 | 8632 | 13053 | 6040 | 1583 | 16498 | 5182 | 601 | 17476 | 6142 | 7174 | 3594 |
| | 4785 | 18195 | 11021 | 9022 | 3624 | 8275 | 1685 | | | | | |
| 400: | 20186 | 17002 | 688 | 20774 | 5087 | 2884 | 14965 | 22528 | 18781 | 1690 | 4912 | 5577 |
| | 11728 | 16448 | 16807 | 10976 | 1638 | 15429 | 8957 | 580 | 4493 | 5637 | 5091 | 16774 |
| | 7160 | 16922 | 15404 | 15627 | 18041 | 10475 | 11189 | 17861 | 6458 | 12796 | 2292 | 15539 |
| | 10144 | 3302 | 20470 | 15550 | 17536 | 14443 | 18302 | 11535 | 18222 | 3339 | 19330 | 20436 |
| | 12330 | 4213 | 11378 | 13719 | 1446 | 18705 | 18359 | 16604 | 7847 | 4055 | 1915 | 4452 |
| | 7369 | | | | | | | | | | | |
| 401: | 8043 | 17358 | 11675 | 2116 | 16697 | 17985 | 22056 | 14520 | 11577 | 10169 | 8676 | 13033 |
| | 5205 | 2318 | 6687 | 11694 | 2175 | 13809 | 11141 | 20423 | 6267 | 21105 | 10537 | 11944 |
| | 20585 | 17725 | 18065 | 11722 | 4293 | 11413 | 1336 | 17250 | 5565 | 20625 | 13141 | 8797 |
| | 11621 | 2433 | 14925 | 19876 | 20907 | 16241 | 14430 | 8061 | 5447 | 21832 | 6570 | 13938 |
| | 7924 | 2863 | 13858 | 15223 | 21239 | 17416 | 17732 | | | | | |
| 402: | 12881 | 6207 | 13353 | 11751 | 15876 | 1666 | 22177 | 13826 | 8030 | 20136 | 19068 | 10849 |
| | 6185 | 15941 | 3633 | 6034 | 14463 | 19984 | 9404 | 13322 | | | | |
| 403: | 6523 | 1729 | 4595 | 16330 | 20515 | 15902 | 19588 | 3043 | 18919 | 11708 | 20497 | 2327 |
| | 1441 | 669 | 18540 | 19877 | 6224 | 20250 | 22038 | 16853 | 15290 | 17729 | 14201 | 6522 |
| | 6639 | 958 | 6067 | 9352 | 10585 | 13076 | 22253 | 20296 | 15055 | 16741 | 856 | 13376 |
| | 4656 | 741 | 7600 | 3292 | 2041 | 12712 | 9536 | 7469 | 18070 | 17534 | 11560 | 1612 |
| | 12461 | 21026 | 10734 | 16245 | 11563 | 6734 | 14728 | 2065 | 12210 | 7856 | 6660 | 21451 |
| | 19555 | 3908 | 11196 | 7863 | 3537 | 4208 | 19879 | 1538 | 19512 | 18260 | 12688 | 20261 |
| | 4516 | 10861 | 13969 | 17758 | 753 | 6479 | 4375 | 12255 | 14160 | 16212 | 16720 | 16343 |
| | 8787 | 1275 | 20369 | 8862 | 14259 | 6209 | 11213 | 8389 | 15695 | 8160 | 17885 | 1848 |
| | 22162 | 17147 | 13696 | 14312 | 4009 | 8381 | 15581 | 21090 | 8703 | 15075 | 12930 | 5299 |
| | 2236 | 11851 | 22418 | 6073 | 6225 | 7353 | 12257 | 3365 | 8254 | 20943 | 7181 | 15879 |
| | 9322 | 10783 | 967 | 9671 | 5003 | 19304 | 21876 | | | | | |
| 404: | 20121 | 4845 | 16755 | 15934 | 12656 | 20703 | 22316 | 10903 | 1987 | 15141 | 15570 | 565 |
| | 19322 | 15992 | 21094 | 9068 | 15986 | 19707 | 21551 | 8077 | 3154 | 5118 | 3193 | 22498 |
| | 2768 | 10551 | 21158 | 3298 | 8643 | 5107 | 10916 | 16268 | 21127 | 14373 | 13081 | 4348 |
| | 2952 | 5053 | 3842 | 20761 | 1985 | 10588 | 14743 | 18380 | 9448 | 6324 | 8451 | 11229 |
| | 12521 | 5321 | 13117 | 13654 | 3189 | 9466 | 973 | 16177 | 20685 | 18436 | 6742 | 8800 |
| | 8329 | 17207 | 10301 | 16839 | 21523 | 20549 | 8368 | 16906 | 21295 | 16634 | 14165 | 16440 |
| | 18858 | 11979 | 19688 | 11752 | 20704 | 8049 | 5101 | 12140 | 6150 | 18457 | 17776 | 10823 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 1055 | 10714 | 2685 | 17863 | 16832 | 18771 | 9387 | 18448 | 11154 | 16274 | 12172 | 16594 |
| | 19936 | 10508 | 11531 | 11286 | 3525 | 16791 | 20273 | 17444 | 20714 | 13542 | 11356 | 22016 |
| | 9568 | 15624 | 2045 | 8938 | 12700 | 17001 | | | | | | |
| 405: | 15903 | 14278 | 19149 | 8514 | 3419 | 8145 | 3547 | 17612 | 11032 | 20571 | 12663 | |
| 406: | 17617 | 22319 | 7205 | 6865 | 16239 | 9494 | 6282 | 3807 | 1614 | 20370 | 12460 | 4224 |
| | 10012 | 14713 | 14403 | 11097 | 4784 | 11736 | 5165 | 8086 | 18191 | 18915 | 19519 | 8491 |
| | 10730 | 11279 | 3262 | | | | | | | | | |
| 407: | 2891 | 3958 | 11588 | 15385 | 3069 | 2735 | 20029 | 11448 | 11546 | | | |
| 408: | 9532 | 10331 | 19503 | 14129 | 5699 | 15147 | 7047 | 5185 | 7604 | 2151 | 19670 | 9143 |
| | 1141 | 10189 | 18230 | 4233 | 9176 | 19023 | 18942 | 18099 | 5356 | 3212 | 10361 | 20873 |
| | 12438 | 9248 | 1233 | 17267 | 19131 | 21068 | 13009 | 6829 | 20236 | 14326 | 6208 | 21773 |
| | 15785 | 1052 | 14929 | 4869 | 4397 | 13900 | 6409 | 3254 | 21501 | 12516 | 1974 | 20560 |
| | 11275 | 2659 | 5053 | 9051 | 18988 | 22150 | 21521 | 17242 | 12835 | 5328 | 12151 | 12808 |
| | 14165 | 1755 | 10215 | 22220 | 22247 | 7254 | 20380 | 5061 | 2845 | 654 | 5018 | 7274 |
| | 9568 | 11235 | 6804 | 8938 | 3173 | 12045 | 19302 | 4028 | 11190 | 14318 | | |
| 409: | 17878 | 16387 | 12478 | 9552 | 20335 | 20588 | 14328 | 20566 | 9985 | 11470 | 9847 | 3078 |
| | 10774 | 13004 | 16036 | 17980 | 12297 | 19736 | 12682 | 20732 | 15994 | 18840 | 14761 | 7615 |
| | 3382 | 13301 | 14704 | 1253 | 8175 | 1203 | 14879 | 16511 | 18949 | 17910 | 4951 | 12305 |
| | 12551 | 984 | 5460 | 6545 | 17611 | 15062 | 3611 | 21636 | 4337 | 22142 | 17887 | 5729 |
| | 13561 | 7326 | 7817 | 4775 | 12683 | 18165 | 11442 | | | | | |
| 410: | 19444 | 20278 | 7007 | 15467 | 10031 | 19083 | 20001 | 8653 | 7474 | 9943 | 2052 | 11515 |
| | 1185 | 15759 | 16848 | 7867 | 18893 | 18562 | 4415 | 7309 | 16700 | 646 | 22398 | 21783 |
| | 11681 | 20677 | 13180 | 18105 | 19115 | 9525 | 21934 | 4239 | 9535 | 3136 | 7961 | 4042 |
| | 17090 | 13917 | 13550 | 6807 | 15815 | 5083 | 14397 | 15406 | 5715 | 18413 | 1545 | 1181 |
| | 18323 | 18109 | 4215 | 21611 | 15464 | 20382 | 18532 | 10295 | 3243 | 557 | 7871 | 21405 |
| | 21910 | 742 | 17206 | 11102 | 8305 | 8131 | 8342 | 13021 | 21027 | 6288 | 21249 | 8657 |
| | 3604 | 2514 | 17634 | 15990 | 20228 | 10314 | 8380 | 7680 | 4394 | 11472 | 9447 | 8886 |
| | 14484 | 732 | 21164 | 5885 | 1582 | 18950 | 4256 | 13943 | 10878 | 4921 | 18817 | 9457 |
| | 13643 | 5491 | 10600 | 6106 | 7932 | 12303 | 8523 | 7259 | 15802 | 15381 | 10690 | 5244 |
| | 2547 | 9595 | 13530 | 3278 | 7558 | 787 | 14423 | 1602 | 7317 | 8244 | 875 | 22340 |
| | 2864 | 14957 | 7393 | 18265 | 8733 | 9103 | 19853 | 11368 | 18367 | 16756 | 15487 | 19985 |
| | 15688 | 15114 | 9775 | 5561 | 11959 | 3943 | 9409 | 7846 | 14829 | 11027 | 10403 | 18628 |
| | 18693 | 10737 | 1258 | 16202 | 22195 | 7356 | 22522 | 660 | 14611 | 1131 | 8690 | 1624 |
| | 19314 | 19584 | 2161 | 13946 | 12833 | 2228 | 22353 | 20610 | 5071 | 22372 | 14247 | 6017 |
| | 7666 | 12648 | 14029 | 21735 | 14114 | 20694 | 13015 | 18234 | 681 | 10081 | 11147 | 18808 |
| | 19321 | 6914 | 2616 | 12379 | 10311 | 15491 | 18766 | 3328 | 17588 | 18807 | 17753 | 12618 |
| | 11319 | 20579 | 10231 | 2975 | 15216 | 2793 | 16097 | 1795 | 18974 | 14473 | 20268 | 21825 |
| | 19495 | 18545 | 14979 | 5483 | 4788 | 9820 | 13325 | 2386 | 8747 | 14646 | 4173 | 8861 |
| | 11690 | 17653 | 8169 | 5892 | 19300 | 15684 | 9216 | 665 | 16990 | 4535 | 11520 | 8301 |
| | 5772 | 10373 | 13686 | 13843 | 9665 | 19610 | 10235 | 17272 | 17334 | 22154 | 18621 | 865 |
| | 3789 | 1076 | 18122 | 12966 | 12081 | 14558 | 1943 | 10356 | 2299 | 11243 | 18708 | 10234 |
| | 14621 | 11538 | 20401 | 7508 | 14752 | 11476 | 8779 | 13046 | 15566 | 2029 | 5433 | 2096 |
| | 1102 | 12085 | 13461 | 16044 | 8180 | | | | | | | |
| 411: | 9901 | 16263 | | | | | | | | | | |
| 412: | 2162 | 18233 | 20049 | 12022 | 11201 | 15202 | 8052 | 7238 | 12584 | 4327 | 7460 | 9562 |
| | 19525 | 21286 | 14793 | 5936 | 10320 | 1414 | 6411 | 4718 | 9260 | 8095 | 16930 | 16698 |
| | 18606 | 2323 | 7175 | 13143 | 20113 | 14775 | 19888 | 9560 | 2539 | 9038 | 9327 | 18125 |
| | 11362 | 1014 | 9813 | 17983 | 8842 | 7807 | 2893 | 11880 | 14342 | 9378 | 3540 | 3096 |
| | 19574 | 14434 | 16029 | 13644 | 4168 | 6269 | 3249 | 12029 | 19054 | 8470 | 14290 | 17635 |
| | 13553 | 18138 | 15398 | 9069 | 18935 | 2699 | 5624 | 1368 | 7752 | 20623 | 8011 | 16598 |
| | 2959 | 7392 | 16359 | 2033 | 13502 | 14870 | 6425 | 15173 | 5707 | 18089 | 13368 | 20148 |
| | 5202 | 12293 | 7625 | 10367 | 22375 | 9160 | 16642 | 1146 | 8644 | 18822 | 6890 | 4761 |
| | 16943 | 2968 | 15397 | 10530 | 4187 | 21770 | 6917 | 9741 | 21455 | 11557 | 12319 | 13100 |
| | 16735 | 11024 | 6580 | 16704 | 17268 | 12608 | 10727 | 17252 | 2824 | 12882 | 11405 | 20525 |
| | 6174 | 16284 | 14249 | 11514 | 4780 | 19770 | 4323 | 7269 | 18976 | 6189 | 4008 | 10736 |
| | 14087 | 19567 | 22011 | 14971 | 14023 | 17424 | 2305 | 22078 | 3592 | 16956 | 7560 | 1738 |
| | 12942 | 21285 | 20899 | 11460 | 19580 | 21557 | 17786 | 17161 | 3227 | 5470 | 5918 | 1584 |
| | 6167 | 21290 | 18980 | 5133 | 22328 | 17322 | 3423 | 15190 | 20764 | 18753 | 17010 | 16011 |
| | 3336 | 4391 | 7094 | 15896 | 7833 | 16618 | 16299 | 7848 | 21863 | 6217 | 20647 | 1230 |
| | 22513 | 18373 | 7471 | 12642 | 20594 | 15221 | 18254 | 7661 | 18439 | 4382 | 21156 | 10463 |
| | 3841 | 9623 | 18957 | 1044 | 10437 | 20165 | 17833 | 1374 | 15273 | 7844 | 19571 | 16820 |
| | 11643 | 1575 | 1920 | 1695 | 11209 | 7958 | 10668 | 13971 | 5416 | 7100 | 13690 | 4695 |
| | 12664 | 13185 | 8604 | 18811 | 916 | 3631 | 20925 | 6998 | 12127 | 1325 | 18046 | 17290 |
| | 2206 | 18785 | 10243 | 13121 | 8060 | 8498 | 7423 | 7638 | 19073 | 2589 | 3866 | 17454 |
| | 20816 | 16178 | 20033 | 1467 | 16026 | 8181 | 1941 | 8720 | 17669 | 4852 | 1609 | 20526 |
| | 4534 | 20245 | 18223 | 21627 | 17568 | 18939 | 13054 | 14168 | 5856 | 18898 | 11014 | 19510 |
| | 9810 | 12845 | 4047 | 20300 | 8236 | 15824 | 1098 | 16088 | 13424 | 14404 | 7164 | 14512 |
| | 21944 | 14356 | 18936 | 12143 | 10894 | 5086 | 16950 | 18427 | 2265 | 12701 | 10676 | 14700 |

TABLE 17-continued

Sequence IDs for homolog proteins

| Seq ID NO: | homolog Seq ID NOs | | | | | | | | | | |
|---|---|---|---|---|---|---|---|---|---|---|---|
| | 636 | 7556 | 1255 | 21562 | 20004 | 4018 | 14365 | 7792 | 21836 | 22515 | 4626 | 7954 |
| | 2981 | 3277 | 20156 | 14224 | 17076 | 11402 | 8579 | 1038 | 19802 | 8390 | 4147 | 20742 |
| | 19929 | 17647 | 3352 | 12885 | 17628 | 22490 | 3315 | 8629 | 6094 | 6966 | 14651 | 5256 |
| | 8279 | 11688 | 6703 | 11108 | 1457 | 14601 | 9351 | 8986 | 2075 | 8490 | 2577 | 15644 |
| | 14025 | 2586 | 2646 | 3999 | 9581 | 14960 | 19190 | 15504 | 18393 | 7405 | 2505 | 7583 |
| | 10066 | 9356 | 8520 | 21298 | 7640 | 20817 | 21774 | 15316 | 7810 | 6357 | 19520 | 17972 |
| | 21917 | 15777 | 13859 | 21642 | 3703 | 5853 | 1354 | 21366 | 12726 | 4471 | 1978 | 4480 |
| | 2810 | 5335 | 21970 | 14779 | 22384 | 3393 | 5141 | 2928 | 5815 | 5890 | 8839 | 5761 |
| | 19941 | 2036 | 7211 | 760 | 9097 | 1184 | 5514 | 15671 | 4895 | 2808 | 12236 | 11124 |
| | 11100 | 16580 | 8441 | 6767 | 10567 | 19813 | 7882 | 20630 | 8524 | 3825 | 22209 | 13732 |
| | 18168 | 5582 | 4896 | 6403 | 15710 | 3400 | 12466 | 7217 | 21299 | 649 | 918 | 4342 |
| | 3021 | 10027 | 21150 | 13145 | 6798 | 20339 | 2003 | 8395 | 18183 | 5409 | 11431 | 19105 |
| | 15632 | 1529 | 11293 | 12867 | 2841 | 12448 | 8092 | 20698 | 17823 | 17746 | 9681 | 10359 |
| | 16092 | 22422 | | | | | | | | | | |
| 413: | 22034 | 8322 | 12008 | 13273 | 812 | 11765 | 21273 | 20302 | 7255 | 570 | 20174 | 13723 |
| | 6666 | 22086 | 18541 | 9801 | 12646 | 17511 | 3238 | 4002 | 10019 | 21775 | 19200 | 1284 |
| | 18777 | 16126 | 10941 | 18730 | 16545 | 2655 | 10677 | 1823 | 3378 | 22507 | 22487 | 2105 |
| | 21401 | 16277 | 16134 | 17411 | 11463 | 10282 | 1387 | 17316 | 814 | 12211 | 10675 | 5919 |
| | 2531 | 8234 | 15950 | 13303 | 20240 | 15142 | 6343 | 17332 | 698 | 8256 | 18799 | 16961 |
| | 7465 | 15483 | 15126 | 11265 | 1248 | 13144 | 4991 | 910 | 12748 | 14534 | 20200 | 1113 |
| | 9537 | 549 | 10854 | 14460 | 6577 | 14432 | 1556 | 6735 | 19416 | 16300 | 21874 | 14903 |
| | 5716 | 1511 | 13958 | 10119 | 16522 | 6561 | 5477 | 12441 | 6266 | 14367 | 2568 | 7559 |
| | 19472 | 19810 | 11611 | 12517 | 13165 | 12364 | 21402 | 12768 | 9589 | 5941 | 15456 | 1565 |
| | 5435 | 14242 | 21793 | 4776 | 7231 | 1961 | 19032 | 1380 | 19110 | 4711 | 18525 | 20467 |
| | 16120 | 1422 | 22131 | 18435 | 17158 | 21488 | 4267 | 21287 | 8136 | 21470 | 13657 | 7855 |
| | 7462 | 20952 | 6100 | 21395 | 1091 | 7935 | 12221 | 4220 | 4275 | 22272 | 11605 | 1109 |
| | 6087 | 13735 | 21333 | 11724 | 18084 | 1628 | 1346 | 8072 | 15856 | 19515 | 2451 | 14016 |
| | 9102 | 7499 | 20103 | 6129 | 8681 | 14265 | 22363 | 10518 | 18395 | 20658 | 15572 | 20900 |
| | 17981 | 16009 | 11950 | 11074 | 707 | 8846 | 9190 | 18652 | 12428 | 10283 | 19835 | 9740 |
| | 19502 | | | | | | | | | | | |
| 414: | 6834 | 6684 | 1593 | 14718 | 639 | 18288 | 5930 | 12385 | 11749 | 15764 | 10482 | 14872 |
| | 20500 | 17253 | 17922 | 10034 | 9808 | 1699 | 3559 | 8697 | 16121 | 8791 | 12687 | 718 |
| | 18476 | 13223 | 1062 | 17385 | 11440 | | | | | | | |
| 415: | 13988 | 14945 | 6635 | 15700 | 20023 | 11536 | 17004 | 12834 | 5317 | 19374 | 10116 | 7960 |
| | 5032 | 17692 | 21336 | 1492 | 19786 | 6860 | 14502 | 20681 | 5259 | 9724 | 20051 | 567 |
| | 3863 | 6677 | 19709 | 7411 | 16573 | | | | | | | |
| 416: | 5198 | 4396 | 18094 | 11888 | 17143 | 5694 | 21019 | 8021 | 21392 | 3175 | 21815 | 18035 |
| | 12729 | 6083 | 4640 | 17336 | 18325 | 1938 | 5227 | 15019 | 16822 | 2110 | 2441 | 1780 |
| | 11073 | 2067 | | | | | | | | | | |
| 417: | 4094 | 4249 | 6447 | 4266 | 21799 | 11386 | 7114 | 19998 | 8507 | 4118 | 4930 | 21755 |
| | 7422 | 470 | 10048 | 18342 | 16272 | | | | | | | |
| 418: | 12195 | 18355 | 21055 | 18016 | 20402 | 12963 | 12102 | 17702 | 3106 | 18678 | 18424 | 22227 |
| | 19413 | 1979 | 17990 | 22510 | 17357 | 1360 | 17490 | 9376 | 2639 | 8398 | 14303 | 1563 |
| | 9512 | 20310 | 20534 | 2405 | 3798 | 12350 | 16708 | 19648 | 22564 | 959 | 8091 | 13262 |
| | 18778 | | | | | | | | | | | |
| 419: | 8007 | 9185 | 12493 | 17152 | 21173 | 10594 | 13523 | 16563 | 10079 | 2431 | 10753 | 19487 |
| | 20147 | 9647 | 14147 | 9929 | 1830 | 1654 | 17021 | 19317 | 3147 | 1112 | 10779 | 8538 |
| | 3237 | 6408 | 13120 | 3049 | 22221 | 899 | 15039 | 8907 | 16324 | 4879 | 3957 | 783 |
| | 19624 | 12762 | 8261 | 15668 | 12832 | 19114 | 10457 | 3297 | 5741 | 17704 | 16175 | 15159 |
| | 6999 | 11766 | 8413 | 11239 | 8954 | 8566 | 11458 | 11367 | 8923 | 11782 | 3384 | 18544 |
| | 8298 | 18012 | 21849 | 14689 | 1883 | 11942 | 728 | 1701 | 15090 | 13910 | 20183 | 12952 |
| | 1872 | 3776 | 5981 | 21830 | 14524 | 4742 | 9043 | 15217 | 19665 | 12092 | 13500 | 7051 |
| | 5615 | 9310 | 10058 | 672 | 11082 | 16588 | 21831 | | | | | |
| 420: | 11518 | 6542 | 21976 | 16169 | 2667 | 11216 | 15637 | 2270 | 12844 | 12784 | 7569 | 16948 |
| | 13741 | 15920 | 7877 | 4550 | 7616 | 14358 | 13182 | 14560 | 4000 | 4261 | 10693 | 20144 |
| | 8084 | 21413 | 5610 | 16074 | 7572 | 9778 | 1745 | 15641 | 21565 | 16376 | 10773 | 18848 |
| | 1071 | 17984 | 9925 | 22043 | 15210 | 10247 | 20648 | 3200 | 983 | 20360 | 6435 | 14763 |
| | 13495 | 12676 | 12528 | 8206 | 20705 | 3157 | 4565 | 9878 | 16048 | 17609 | 21518 | 13885 |
| | 7244 | 5309 | 13744 | 15880 | 19484 | 658 | 8704 | 16710 | 12907 | 7984 | 6137 | 22370 |
| | 19468 | 10410 | 9826 | 17175 | 20965 | 6796 | 9139 | 11329 | 17057 | 3353 | 18605 | 9058 |
| | 8231 | 2866 | 8504 | 16796 | 20034 | 12940 | 6134 | 15426 | 4409 | 917 | 9156 | 12665 |
| | 629 | 12908 | 7530 | | | | | | | | | |
| 421: | 15638 | 19372 | 18500 | 2446 | 1148 | 7739 | 10757 | 13616 | 14797 | 4533 | 4130 | 21278 |
| | 9633 | 2203 | 20379 | 16812 | 11738 | 4453 | 78751 | 79891 | 1775 | 6848 | 21289 | 15564 |
| | 17637 | 18961 | 2109 | 17883 | 5751 | 4470 | 13318 | 19225 | 8496 | 999 | 19409 | 7694 |
| | 4874 | 3523 | 21721 | 18661 | 5643 | 6235 | 15475 | 4993 | 8534 | 2734 | 16838 | 841 |
| | 8087 | 7343 | 11926 | 5112 | 4748 | 2697 | 17805 | 22050 | 13444 | 20480 | 12313 | 19959 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 1236 | 14235 | 21517 | 18071 | 19134 | 12869 | 2268 | 16339 | 6198 | 11473 | 8372 | 13642 |
| | 19849 | 19983 | 19150 | 7473 | 17895 | 14624 | 12838 | 18434 | 8867 | 10445 | 17390 | 4706 |
| | 4050 | 4847 | 16631 | 13356 | 6505 | 18534 | 1687 | 1794 | | | | |
| 422: | 5236 | 21619 | 6397 | 2990 | 20047 | 22291 | 6084 | 2760 | 5267 | 5082 | 12765 | 16136 |
| | 9918 | 13383 | 21449 | 6268 | 20961 | 21232 | 5855 | 7138 | 1995 | 14576 | 1013 | 12134 |
| | 10069 | 15073 | 6212 | 15451 | 8899 | 18412 | 4849 | 4386 | 4988 | 16988 | 4076 | 12237 |
| | 5275 | 16208 | 20027 | 947 | 6757 | 10538 | 21003 | 4705 | 12576 | 20998 | 19553 | 17590 |
| | 14359 | 11013 | 19927 | 6707 | 17088 | 18975 | 18429 | 14985 | 13721 | 17584 | 21718 | 20322 |
| | 1390 | 19701 | 8055 | 6576 | 18610 | 20621 | 22331 | 12128 | 6286 | 7906 | 19843 | 18623 |
| | 20065 | 11146 | 18095 | 21935 | 18101 | 573 | 11564 | 9180 | 14490 | 7031 | 11030 | 15407 |
| | 20068 | 22044 | 7315 | 18849 | 17381 | 20667 | 5814 | 8717 | 2914 | 14041 | 6827 | 11083 |
| | 22344 | 21424 | 1648 | 14123 | 11982 | 18740 | 20583 | 4741 | 19612 | 1957 | 6206 | 19071 |
| | 15555 | 14347 | 15150 | 22534 | 1958 | 16979 | 5465 | 17615 | 13167 | 9714 | 3221 | 17417 |
| | 1787 | 20324 | 4795 | 20150 | 11040 | 19333 | 5877 | 2311 | 2374 | 14089 | 20555 | 1581 |
| | 853 | 11842 | 5451 | 3675 | 12229 | 8405 | | | | | | |
| 423: | 7073 | 8473 | 19204 | 13490 | 15419 | 10302 | 3067 | 4727 | 8682 | 22082 | 19922 | 8178 |
| | 18347 | 11384 | 16646 | 9838 | | | | | | | | |
| 424: | 21999 | 10083 | 17047 | 19988 | 17430 | 10414 | 4089 | 1514 | 16232 | 9556 | 12818 | 19256 |
| | 18022 | 1716 | 9583 | 12552 | 17581 | 13890 | 9464 | 2246 | 15706 | 18577 | 15783 | 9368 |
| 425: | 8789 | 9460 | 12638 | 14787 | 661 | 13830 | 20570 | 19781 | 2510 | 17126 | 17660 | 1608 |
| | 2111 | 19080 | 6968 | 16599 | 5238 | 20160 | 4150 | 9643 | 16795 | 2152 | 20203 | 17640 |
| | 20673 | 20994 | 13131 | 12812 | 8991 | 987 | 22355 | 19043 | 18108 | 15045 | 14625 | 18638 |
| | 2854 | 600 | 13108 | 14921 | 11424 | 11994 | 19459 | 3294 | 9066 | 11477 | 13026 | 15931 |
| | 6981 | 9953 | 20837 | 1046 | 8701 | 4413 | 3741 | 4408 | | | | |
| 426: | 6366 | 17652 | 5554 | 20635 | 17360 | 4793 | 14236 | 21110 | 8866 | 5732 | 11691 | 19410 |
| 427: | 1006 | 14786 | 20756 | 8495 | 10217 | 5541 | 16973 | 535 | 3260 | 11264 | 12854 | 314 |
| | 18315 | 18461 | 5544 | 18823 | 5240 | 2104 | 12358 | 16966 | 17291 | 6367 | 19001 | 15260 |
| | 3597 | 5549 | 20568 | 10778 | 12440 | 1988 | 13743 | 11485 | 1783 | 18629 | 526 | 17425 |
| | 9565 | 20151 | 9300 | 11185 | 5246 | 15752 | 2084 | 18185 | 2918 | 8400 | 3763 | 3837 |
| | 5746 | 20378 | 7812 | 13638 | 17369 | 4080 | 10663 | 17802 | 2070 | 4989 | 7198 | 21781 |
| | 14194 | 4437 | 8103 | 12106 | 16298 | 13285 | 19237 | 5066 | 19712 | 16970 | 17382 | 14671 |
| | 9686 | 5137 | 13854 | 11867 | 2123 | 3011 | 15148 | 11900 | 22193 | 17908 | 9773 | 16561 |
| | 14739 | 22164 | 2058 | 837 | 20811 | 16636 | 19327 | 18664 | 13237 | 18684 | 19318 | 3797 |
| | 6139 | 2857 | 17664 | 21589 | 11961 | 19154 | 21437 | 16338 | 11195 | 20933 | 21506 | 3533 |
| | 9255 | 4677 | 18511 | 4730 | 696 | 9569 | 17797 | 18687 | 7097 | 20259 | 4425 | 3003 |
| | 22502 | 14915 | 21157 | 1139 | 2541 | 4460 | 16130 | 21296 | 2832 | 830 | 14553 | 6434 |
| | 18295 | 17956 | 829 | 476 | 12043 | 3677 | 7659 | 5486 | 9761 | 5540 | 8443 | 15590 |
| | 15367 | 14935 | 4602 | 18472 | 9627 | 7490 | 20779 | 1281 | 14568 | 17630 | 2371 | 4694 |
| | 12396 | 15369 | 16597 | 3697 | 10741 | 16309 | 4927 | 13396 | 2277 | 21198 | 5308 | 21621 |
| | 8841 | 16662 | 11120 | 14081 | 7321 | 10424 | 15204 | 6565 | 14320 | 2978 | 9294 | 7482 |
| | 9493 | 1277 | 4952 | 7813 | 7306 | 12296 | 12021 | 6645 | 9286 | 22489 | 15165 | 9809 |
| | 16089 | 15681 | 13745 | 16653 | 19069 | 7780 | 12587 | 19236 | 8110 | 4594 | 14762 | 10802 |
| | 10479 | 16663 | 3678 | 16713 | 7751 | 13703 | 3630 | 4691 | 9472 | 10709 | 8542 | 7060 |
| | 6112 | 22457 | 21974 | 20476 | 7333 | 6482 | 14526 | 7151 | 2644 | 835 | 10655 | 12264 |
| | 9315 | 2786 | 16253 | 9488 | 5634 | 17372 | 10399 | 10547 | 16039 | 14345 | 5365 | 10379 |
| | 14566 | 788 | 5943 | 10889 | 5190 | 13207 | 16465 | 10488 | 17136 | 6257 | 8306 | 2432 |
| | 11948 | 16340 | 15326 | 5415 | 9673 | 15586 | 20108 | 20541 | 3458 | 1240 | 15787 | 20099 |
| | 9282 | 11480 | 4994 | 9189 | 12928 | 10743 | 7111 | 16707 | 19389 | 2889 | 19161 | 9422 |
| | 21510 | 10965 | 22018 | 15558 | 4315 | 21926 | 12010 | 3187 | 21634 | 19556 | 2333 | 13869 |
| | 18982 | 20495 | 2984 | 2763 | 5448 | 20219 | 12749 | 2389 | 7476 | 15067 | 3515 | 5375 |
| | 1465 | 12770 | 18281 | 1243 | 13198 | 9265 | 1763 | 1615 | 5056 | 11143 | 12570 | 11245 |
| | 2293 | 2132 | 20312 | 4655 | 16568 | 21093 | 13882 | 5730 | 7976 | 7079 | 13035 | 16007 |
| | 2800 | 3186 | 7053 | 15790 | 7591 | 22480 | 20744 | 22093 | 6055 | 15875 | 305 | 12545 |
| | 2037 | 11704 | 9571 | 21379 | 3712 | 7685 | 4483 | 18456 | 22341 | 10909 | 11197 | 13107 |
| | 16635 | 16006 | 372 | 18722 | 18324 | | | | | | | |
| 428: | 14507 | 15421 | 14477 | 17494 | 566 | 7991 | 15716 | 19769 | 6346 | 11158 | 2783 | 18037 |
| | 18920 | 14200 | 1991 | 21228 | 2025 | 16965 | 22007 | 22121 | 19530 | 17216 | 16560 | 11719 |
| | 9318 | 17738 | 1299 | 21214 | 12334 | 12769 | 13914 | 10771 | 21809 | 10996 | 18789 | 3482 |
| | 8428 | 15625 | 18025 | 21461 | 4486 | 4864 | 18259 | 1869 | 18894 | 5076 | 10621 | 8796 |
| | 15953 | 1037 | 18120 | 21047 | 8656 | 2967 | 13154 | 6569 | 12338 | 19732 | 3033 | 10633 |
| | 15359 | 15028 | 16103 | 12423 | 19646 | 3561 | 2797 | 6835 | 16222 | 3266 | 19426 | 6571 |
| | 21319 | 4126 | 22537 | 6888 | 17781 | 1697 | 10045 | 1251 | 7003 | 7276 | 19243 | 14694 |
| | 15687 | 11467 | 11444 | 12814 | 7126 | 7580 | 4960 | 7248 | 3598 | 14355 | 7140 | 17847 |
| | 8316 | 17583 | 16488 | 4421 | 19550 | 8999 | 1180 | 18026 | 20573 | 8479 | 18820 | 21056 |
| | 7036 | 15143 | 13926 | 18737 | 18581 | 16569 | 13403 | 1142 | 3253 | 7394 | 4463 | 11832 |
| | 14382 | 7339 | 16547 | 15305 | 10604 | 4338 | 16236 | 16768 | 4138 | 18754 | 442 | 18246 |
| | 10039 | 12847 | 6541 | 21176 | 20831 | 13811 | 12065 | 10287 | 11127 | 9635 | 20511 | 19012 |
| | 13060 | 12724 | 898 | 4347 | 8702 | 12055 | 21425 | 20545 | 19336 | 8006 | 14571 | 5579 |
| | 15743 | 3704 | 19675 | 16542 | 16559 | 21229 | 11524 | 9274 | 11075 | 8804 | 4132 | 17224 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 3133 | 3607 | 12684 | 13418 | 10123 | 13007 | 14891 | 18308 | 10517 | 2973 | 11620 | 15395 |
| | 10374 | 3168 | 3051 | 15872 | 11732 | 9301 | 740 | 19109 | 1359 | 17419 | 10051 | 6843 |
| | 1680 | 5509 | 10865 | 11707 | 16067 | 22296 | 1000 | 3406 | 18908 | 8719 | 9844 | 20469 |
| | 12031 | 11698 | 9632 | 4041 | 4022 | 2595 | 20688 | 6395 | 9511 | 16615 | 4623 | 22346 |
| | 2369 | 17333 | 14975 | 19292 | 12095 | 14281 | 11866 | 5395 | 16733 | 3840 | 17783 | 15322 |
| | 17305 | 10611 | 1428 | 7631 | 15733 | 5563 | 18432 | 3777 | 1959 | 18192 | 1274 | 9859 |
| | 16608 | 6676 | 5894 | 4159 | 21902 | 6323 | 6814 | 7759 | 17670 | 10954 | 17330 | 3090 |
| | 8154 | 15122 | 14026 | 9078 | 475 | 20224 | 15939 | 13183 | 2171 | 20320 | 12959 | 18620 |
| | 6196 | 16678 | 13224 | 21618 | 9870 | 17904 | 435 | 11481 | 4738 | 13205 | 11111 | 6886 |
| | 4385 | 10224 | 21396 | 16032 | 22294 | 3286 | 13158 | 7249 | 8239 | 1725 | 17508 | 13407 |
| | 19123 | 1165 | 2912 | 20759 | 22152 | 18157 | 16447 | 2772 | 12222 | 10847 | 14538 | 17604 |
| | 14596 | 20901 | 4797 | 3679 | 21087 | 19143 | 7452 | 9348 | 17993 | 21440 | 14394 | 16530 |
| | 16659 | 10434 | 15793 | 9088 | 17239 | 4831 | 6340 | 2684 | 689 | 15731 | 9528 | 16620 |
| | 17353 | 14180 | 11651 | 17070 | 2073 | 1585 | 8281 | 12298 | 22147 | 10166 | 22431 | 15463 |
| | 6601 | 8700 | 16540 | 2993 | 4260 | 9664 | 10652 | 15975 | 13842 | 14457 | 15948 | 11412 |
| | 5572 | 7389 | 11862 | 1897 | 19136 | 11526 | 10222 | 1819 | 9220 | 12697 | 22065 | 20558 |
| | 17946 | 2983 | 18633 | 13258 | 13996 | 5429 | 20450 | 10529 | 15553 | 3208 | 12002 | 14696 |
| | 12270 | 16162 | 9071 | 7594 | 17146 | 7667 | 11793 | 2416 | 11610 | 19062 | 19931 | 6868 |
| | 7221 | 5047 | 7968 | 10376 | 5672 | 2355 | 11711 | 4084 | 8726 | 14756 | 9731 | 18769 |
| | 5680 | 10960 | 10209 | 17713 | 4926 | 14217 | 6624 | 9314 | 3151 | 6850 | 4560 | 18134 |
| | 17898 | 12386 | 5636 | 3480 | 10028 | 2838 | 20595 | 1292 | 20275 | 12254 | 17594 | 4853 |
| | 20642 | 8186 | 16379 | 10383 | 4591 | 11759 | 11502 | 8591 | 4288 | 11992 | 17721 | 15333 |
| | 9201 | 12553 | 14724 | 3846 | 22481 | 1723 | 15765 | 17537 | 17720 | 5294 | 9934 | 3608 |
| | 16724 | 3395 | 2370 | 22184 | 6889 | 3455 | 7902 | 13093 | 4038 | 2297 | 7376 | 1916 |
| | 7144 | 16736 | 15894 | 19202 | 4614 | 10304 | 12063 | 3319 | 11943 | 21007 | 5703 | 6099 |
| | 3369 | 4162 | 18750 | 20614 | 3762 | 6621 | 7015 | 7304 | 4298 | 9147 | 11434 | 11341 |
| | 10440 | 4734 | 13768 | 14607 | 7695 | 13737 | 10493 | 7039 | 16005 | 5151 | 2008 | 20772 |
| | 4271 | 19954 | 7608 | 5609 | 5027 | 11303 | 8198 | 15488 | 16991 | 16228 | 17894 | 18306 |
| | 2556 | 6626 | 20616 | 16083 | 12968 | 22378 | 16437 | 7624 | 19737 | 2476 | 20184 | 8948 |
| | 13230 | 16495 | 6039 | 10274 | 10978 | 13806 | 5631 | 6912 | 22114 | 2955 | 21137 | 13954 |
| | 22400 | 1905 | 19874 | 16430 | 12918 | 16985 | 8847 | 4942 | 18505 | 6234 | 9524 | 15225 |
| | 3274 | 6369 | 1408 | 7297 | 20802 | 5035 | 20321 | 12454 | 13377 | 9019 | 4029 | 11248 |
| | 3758 | 16017 | 6780 | 2467 | 8343 | 727 | 18768 | 2737 | 1889 | 15457 | 2791 | 8559 |
| | 7622 | 17058 | 4393 | 1128 | 13953 | 2462 | 12634 | 4887 | 5138 | 7962 | 11126 | 15081 |
| | 22027 | 8042 | 16352 | 21033 | 8437 | 1952 | 10420 | 21247 | 20139 | 11118 | 19561 | 15955 |
| | 3808 | 17939 | 13239 | 4794 | 21353 | 13160 | 11932 | 16466 | 19950 | 18656 | 9789 | 3900 |
| | 11330 | 1626 | 21761 | 16275 | 839 | 16058 | 1199 | 5355 | 10804 | 10251 | 19141 | 19986 |
| | 19797 | 13358 | 5206 | 9701 | 1661 | 11677 | 2289 | 10875 | 9733 | 12426 | 10942 | 7723 |
| | 15784 | 12064 | 14341 | 5120 | 6223 | 5983 | 18048 | 8171 | 11041 | 10670 | 17196 | 16314 |
| | 20434 | 21075 | 20432 | 1709 | 8716 | 4904 | 18464 | 630 | 8403 | 6184 | 18819 | 13412 |
| | 17228 | 16302 | 10762 | 4918 | 9392 | 16256 | 4056 | 5523 | 9202 | 16022 | 17350 | 304 |
| | 477 | 437 | 537 | 12703 | 15237 | 17792 | 11159 | 4597 | 7291 | 15512 | 1072 | 6812 |
| | 15476 | 15612 | 4183 | 5466 | 17341 | 12261 | 10729 | 21044 | 4892 | 1108 | 1406 | 1630 |
| | 5617 | 11923 | 17859 | 18198 | 6967 | 1264 | 20318 | 12469 | 22123 | 10452 | 5701 | 13091 |
| | 15516 | 2225 | 1997 | 712 | 14602 | 8047 | 16361 | 6109 | 14712 | 22157 | 7745 | 16695 |
| | 22271 | 11050 | 6934 | 6231 | 7635 | 1574 | 21574 | 18516 | 4245 | | | |
| 429: | 4085 | 2527 | 1065 | 15525 | 14455 | 18955 | 8686 | 14616 | 12315 | 16572 | 15135 | 18501 |
| | 11081 | 5251 | 21737 | 20520 | 691 | 6761 | 19795 | 13031 | 3691 | 6753 | 3599 | 17478 |
| | 19773 | 21114 | 6014 | 3843 | 12406 | 18706 | 4803 | 19871 | 5593 | 19334 | 19269 | 16267 |
| | 7830 | 3347 | 21925 | 18962 | 16676 | 22334 | 12165 | 16013 | 9753 | 7457 | 5446 | 17495 |
| | 20783 | 3532 | 19992 | 4641 | 17715 | 4676 | 10300 | 11655 | 22264 | 21804 | 2482 | 3288 |
| | 11375 | 10949 | 13571 | 5392 | 22506 | 4117 | 12147 | 9177 | 12485 | 12082 | 14102 | 16550 |
| | 8227 | 7887 | 9151 | 10009 | 2194 | 8035 | 3263 | 2456 | 10489 | 4324 | 17182 | 18539 |
| | 10448 | 18491 | 18289 | 3508 | 9164 | 17132 | 9114 | 3276 | 7050 | 5077 | 679 | 14103 |
| | 7303 | 20808 | 18812 | 5767 | 9247 | 20679 | 11242 | 19578 | 10187 | 6168 | 13518 | 22465 |
| | 10647 | 6086 | 8411 | 19641 | 21890 | 15074 | 12875 | 17324 | 6537 | 5971 | 5621 | 4007 |
| | 3671 | 5808 | 7390 | 2901 | 10617 | 17896 | 3947 | 21371 | 18983 | 19065 | 5064 | 8637 |
| | 18056 | 8308 | 7938 | 11745 | 19805 | 2000 | 1635 | 14446 | 18226 | 8264 | 6511 | 6429 |
| | 20857 | 18717 | 10669 | 18388 | 21752 | 2576 | 14131 | 18309 | 6243 | 2219 | 5023 | 15274 |
| | 22359 | 8379 | 1196 | 17230 | 21410 | 4530 | 10035 | 18136 | 20678 | 8008 | 3975 | 22206 |
| | 7027 | 14101 | 9482 | 8164 | 18390 | 11397 | 4582 | 20372 | 17760 | 16433 | 21946 | 13871 |
| | 7967 | 9095 | 17117 | 9950 | 6587 | 14695 | 5445 | 3749 | 17681 | 19020 | 11758 | 8793 |
| | 9612 | 10927 | 2881 | 20172 | 17530 | 3965 | 10328 | 18563 | 5640 | 17022 | 14773 | 3998 |
| | 19518 | 6413 | 13513 | 21860 | 10059 | 4735 | 8090 | 17595 | 22329 | 18064 | 11254 | 4553 |
| | 5196 | 7698 | 6952 | 13389 | 11495 | 4755 | 6529 | 14647 | 755 | 3688 | 17603 | 11692 |
| | 15799 | 7721 | 11607 | 1907 | 5972 | 12763 | 20832 | 5479 | 6622 | 14733 | 843 | 8870 |
| | 17397 | 3483 | 11493 | 19618 | 5858 | 18527 | 4566 | 20709 | 6716 | 19382 | 5368 | 13548 |
| | 7884 | 20519 | 2015 | 18102 | 11949 | 19869 | 7193 | 21204 | 8094 | 22071 | 1179 | 8989 |
| | 687 | 3082 | 1061 | 9091 | 4149 | 3083 | 19222 | 3949 | 20094 | 5822 | 13984 | 6059 |
| | 18698 | 5004 | 9193 | 7842 | 2013 | 15901 | 10055 | 17023 | 9839 | 17902 | 6839 | 14943 |
| | 21717 | 9782 | 8458 | 1749 | 6940 | 4589 | 14640 | 12339 | 16830 | 2964 | 18200 | 9685 |
| | 7385 | 3184 | 18909 | 12110 | 11069 | 17845 | 2560 | 4950 | 3891 | 6893 | 12525 | 5770 |
| | 4468 | 20897 | 13934 | 19823 | 2551 | 11904 | 3681 | 22519 | 2294 | 4619 | 581 | 12706 |
| | 20766 | 3718 | 18030 | 8652 | 13568 | 7092 | 5748 | 13595 | 21125 | 11323 | 6294 | 7245 |
| | 16341 | 18013 | 21906 | 7756 | 20468 | 12807 | 8952 | 4854 | 12892 | 20932 | 17233 | 15059 |

TABLE 17-continued

Sequence IDs for homolog proteins

| Seq ID NO: | homolog Seq ID NOs | | | | | | | | | | |
|---|---|---|---|---|---|---|---|---|---|---|---|---|
| | 14597 | 10337 | 3390 | 2083 | 16457 | 2550 | 6863 | 18213 | 15149 | 18389 | 13296 | 2910 |
| | 16845 | 800 | 9561 | 7305 | 5114 | 20251 | 14853 | 21958 | 20953 | 13079 | 4928 | 12827 |
| | 18923 | 12922 | 12166 | 4134 | 8385 | 16411 | 6965 | 15063 | 11981 | 6204 | 2303 | 10341 |
| | 9006 | 17038 | 3101 | 4223 | 12243 | 5951 | 19417 | 14082 | 8354 | 18716 | 5876 | 1912 |
| | 10613 | 2494 | 17074 | 6579 | 21936 | 20024 | 9076 | 15771 | 8144 | 18836 | 21381 | 752 |
| | 15962 | 2074 | 7618 | 7564 | 6180 | 14316 | 20422 | 20988 | 5743 | 1333 | 16210 | 5635 |
| | 6971 | 21853 | 13791 | 11654 | 848 | 13920 | 16054 | 21997 | 16890 | 8874 | 3252 | 14854 |
| | 18045 | 15844 | 1948 | 2167 | 19790 | 7872 | 15068 | 14737 | 9874 | 19597 | 19839 | 10412 |
| | 18454 | 3700 | 11597 | 3064 | 19734 | 6549 | 14176 | 16329 | 18535 | 22267 | 1097 | 4574 |
| | 8296 | 12640 | 20748 | 9752 | 18291 | 15724 | 1817 | 20274 | 2199 | 11298 | 12660 | 14557 |
| | 21233 | 19952 | 16014 | 18187 | 20646 | 4479 | 15036 | 19259 | 10006 | 11951 | 14208 | 807 |
| | 17472 | 22405 | 14906 | 11172 | 3156 | 4287 | 8159 | 7673 | 17535 | 1537 | 14931 | 1539 |
| | 22567 | 5737 | 13603 | 19699 | 9407 | 1651 | 6379 | 10581 | 19260 | 3165 | 14667 | 7864 |
| | 9195 | 1596 | 13152 | 16816 | 7742 | 6806 | 1616 | 17544 | 17707 | 20454 | 6937 | 3411 |
| | 18482 | 20603 | 12839 | 21210 | 2018 | 11104 | 7947 | 15160 | 8893 | 5218 | 15123 | 19207 |
| | 2443 | 10521 | 17888 | 19288 | 11689 | 13671 | 1060 | 7139 | 4723 | 16589 | 12750 | 20823 |
| | 21620 | 13574 | 8321 | 3982 | 8782 | 19710 | 7192 | 18007 | 8616 | 10833 | 19376 | 1910 |
| | 15804 | 21373 | 14004 | 10937 | 1232 | 14661 | 15988 | 3876 | 11632 | 4668 | 17814 | 12594 |
| | 19491 | 10832 | 9955 | 715 | 15438 | 10841 | 3640 | 9007 | 971 | 6389 | 21095 | 16446 |
| | 17276 | 14461 | 2963 | 15035 | 11615 | 3420 | 8456 | 9895 | 20407 | 21560 | 16473 | 17496 |
| | 7402 | 5937 | 16861 | 18408 | 18177 | 14755 | 15184 | 9227 | 12946 | 18987 | 11729 | 4477 |
| | 14072 | 12541 | 20612 | 4203 | 11063 | 18943 | 22467 | 12279 | 17726 | 13181 | 1130 | 19124 |
| | 12801 | 22244 | 16404 | 4962 | 17046 | 2469 | 2626 | 10801 | 569 | 7725 | 2704 | 8430 |
| | 18169 | 17621 | 14239 | 22342 | 20154 | 12018 | 6110 | 3490 | 20465 | 12047 | 553 | 5605 |
| | 2628 | 16250 | 2059 | 9087 | 3888 | 731 | 1827 | 21528 | 6858 | 5758 | 9971 | 9055 |
| | 19121 | 12596 | 9582 | 4484 | 11624 | 14798 | 6138 | 15283 | 7826 | 6756 | 11874 | 17055 |
| | 9759 | 17852 | 4798 | 22395 | 20864 | 12972 | 13464 | 710 | 16153 | 11807 | 13928 | 12179 |
| | 4667 | 18624 | 20452 | 2395 | 16837 | 8335 | 12798 | 16367 | 2473 | 10503 | 15101 | 11372 |
| | 17828 | 16195 | 20015 | 2994 | 16716 | 1892 | 19350 | 3636 | 17068 | 17570 | 11645 | 1327 |
| | 7475 | 20149 | 10068 | 20414 | 14198 | 6292 | 22295 | 12872 | 21980 | 3940 | 12542 | 18299 |
| | 9655 | 2119 | 18038 | 8871 | 8658 | 17301 | 11886 | 2039 | 3626 | 2453 | 8245 | 11903 |
| | 20419 | 2748 | 18668 | 6038 | 20076 | 11931 | 18793 | 3924 | 4613 | 6432 | 14061 | 11825 |
| | 10785 | 4319 | 20931 | 20293 | 12868 | 20904 | 13240 | 9080 | 5315 | 18550 | 5568 | 3790 |
| | 19960 | 18123 | 4607 | 21807 | 11927 | 7809 | 10838 | 3410 | 7219 | 3828 | 9117 | 4802 |
| | 17766 | 7596 | 18685 | 14850 | 2868 | 2410 | 17525 | 18227 | 5587 | 748 | 9922 | 6817 |
| | 13414 | 4122 | 14886 | 6795 | 20797 | 1302 | 13981 | 13919 | 12280 | 20227 | 13694 | 3432 |
| | 3581 | 17689 | 19868 | 22144 | 2368 | 4292 | 15152 | 803 | 7632 | 8409 | 12829 | 22148 |
| | 18235 | 17947 | 2085 | 4436 | 22035 | 19521 | 12094 | 1279 | 20990 | 7209 | 22178 | 9906 |
| | 5312 | 962 | 12098 | 7610 | 20672 | 14380 | 1096 | 4197 | 11149 | 11974 | 5660 | 10939 |
| | 21240 | 21535 | 6515 | 17591 | 13604 | 20996 | 6136 | 21870 | 19319 | 4234 | 6030 | 1908 |
| | 3858 | 15291 | 7352 | 15060 | 2897 | 10563 | 1195 | 7862 | 18600 | 13786 | 13041 | 4898 |
| | 2026 | 19040 | 19171 | 16313 | 14963 | 5034 | 1080 | 22252 | 3765 | 15468 | 11773 | 5638 |
| | 12937 | 5393 | 13796 | 9419 | 21859 | 15071 | 8173 | 759 | 8785 | 10233 | 12251 | 10936 |
| | 13190 | 19896 | 6977 | 14271 | 14981 | 14593 | 7058 | 1904 | 16109 | 1104 | 9497 | 9142 |
| | 17439 | 2429 | 3251 | 1743 | 15595 | 776 | 11599 | 957 | 18835 | 15453 | 11273 | 11954 |
| | 11554 | 9554 | 14263 | 13171 | 11110 | 17426 | 11221 | 20644 | 11573 | 20653 | 13888 | 8606 |
| | 21124 | 21083 | 881 | 7084 | 6656 | 7589 | 1372 | 21363 | 12603 | 1875 | 14364 | 12080 |
| | 923 | 17921 | 6852 | 4045 | 16278 | 13047 | 5535 | 17042 | 3118 | 9872 | 3494 | 11980 |
| | 20390 | 19044 | 13195 | 11777 | 10230 | 14014 | 9456 | 5040 | 5358 | 12359 | 10174 | 7896 |
| | 15061 | 19132 | 17294 | 9949 | 7651 | 19331 | 16609 | 5096 | 11833 | 5926 | 12692 | 793 |
| | 7709 | 17994 | 10740 | 21923 | 4044 | 18803 | 7948 | 12708 | 4621 | 7049 | 15789 | 3183 |
| | 19757 | 20773 | 18237 | 13118 | 11870 | 7824 | 12271 | 20914 | 19595 | 2904 | 7799 | 5575 |
| | 11905 | 17160 | 7767 | 15836 | 1947 | 9981 | 9284 | 16661 | 19158 | 10592 | 7940 | 12764 |
| | 14604 | 1540 | 8753 | 2822 | 16765 | 15532 | 1631 | 9675 | 17723 | 5039 | 9590 | 12994 |
| | 21045 | | | | | | | | | | | |
| 430: | 10036 | 20702 | 8519 | 2198 | 16727 | 19676 | 5461 | 9855 | 22269 | 16042 | 7071 | 17892 |
| | 17842 | 9521 | 21420 | 10703 | 799 | 9651 | 7127 | 11809 | 20361 | 1641 | 6056 | 19650 |
| | 2134 | 9375 | 17502 | 21016 | 902 | 22224 | 8402 | 19626 | 7011 | 22503 | 19144 | 15490 |
| | 2388 | 16766 | 6922 | 16601 | 9905 | | | | | | | |
| 431: | 10556 | 12984 | 17708 | 9241 | 19697 | 1495 | 14030 | 9734 | 14027 | 5836 | 7290 | 3964 |
| | 13438 | 20803 | 17948 | 4643 | 8743 | 19246 | 8822 | 22019 | 15937 | 17296 | 18828 | 14438 |
| | 21756 | 1588 | 19060 | 15098 | 4646 | 10462 | | | | | | |
| 432: | 9532 | 10331 | 15934 | 2046 | 6293 | 19503 | 15147 | 5699 | 7047 | 14129 | 17105 | 9079 |
| | 5185 | 13130 | 2151 | 9143 | 1141 | 10189 | 18230 | 19023 | 8431 | 18942 | 18099 | 5356 |
| | 3212 | 10361 | 22388 | 21551 | 20873 | 5482 | 17963 | 7910 | 21068 | 13009 | 6829 | 14326 |
| | 20236 | 6208 | 21773 | 15785 | 14929 | 1052 | 4869 | 16502 | 3926 | 4567 | 14892 | 13401 |
| | 6433 | 9709 | 18261 | 6409 | 22223 | 21368 | 11301 | 6931 | 15940 | 17666 | 21501 | 12516 |
| | 3358 | 6554 | 1974 | 4835 | 20560 | 11275 | 2659 | 5053 | 16358 | 7498 | 14297 | 15569 |
| | 19582 | 20331 | 6857 | 8522 | 22493 | 2638 | 19738 | 13482 | 13654 | 7414 | 12151 | 12808 |
| | 14165 | 1755 | 10215 | 8018 | 22220 | 22247 | 7254 | 20380 | 2845 | 654 | 7274 | 5061 |
| | 5018 | 9568 | 9818 | 1494 | 3725 | 11235 | 10859 | 8938 | 12700 | 17001 | 19302 | 11190 |
| | 4028 | 12045 | 3173 | 14318 | | | | | | | | |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| 433: | 540 | 20745 | 4392 | 9539 | 7190 | 4968 | 12434 | 2894 | 9916 | 18824 | 15969 | 2549 |
| | 13484 | 14142 | 5455 | 8922 | 14475 | 9503 | 12306 | 9461 | 18965 | 943 | 1591 | 20055 |
| | 3802 | 8501 | 6629 | 7934 | 6828 | 21142 | | | | | | |
| 434: | 18584 | 20810 | 16027 | 15628 | 21406 | 7354 | 15327 | 14802 | 20743 | 2149 | 9585 | 6022 |
| | 1273 | 9506 | 9718 | 22409 | 3023 | | | | | | | |
| 435: | 20813 | 11290 | 7991 | 15677 | 22007 | 11719 | 11530 | 9318 | 1246 | 18259 | 1869 | 18894 |
| | 5076 | 8796 | 1194 | 21241 | 4280 | 6152 | 3266 | 19426 | 6888 | 17781 | 10045 | 1251 |
| | 15687 | 11467 | 7270 | 18820 | 4999 | 20923 | 20417 | 3253 | 11348 | 11482 | 14368 | 12055 |
| | 19675 | 16542 | 16559 | 11524 | 9274 | 4132 | 12684 | 10517 | 11459 | 11732 | 9301 | 1359 |
| | 17419 | 6843 | 11707 | 16067 | 9844 | 20469 | 16615 | 1849 | 2369 | 12095 | 14281 | 7631 |
| | 725 | 21902 | 14026 | 3032 | 7802 | 1337 | 3062 | 21087 | 17626 | 17682 | 15601 | 15731 |
| | 689 | 16620 | 17353 | 12317 | 12298 | 15292 | 10166 | 14717 | 13048 | 9220 | 15209 | 1054 |
| | 10376 | 2355 | 11711 | 10028 | 2838 | 4853 | 11759 | 11502 | 9201 | 22481 | 15765 | 5294 |
| | 9934 | 19837 | 18485 | 1903 | 16398 | 7376 | 3319 | 11943 | 7304 | 11341 | 13768 | 5151 |
| | 2008 | 20772 | 16083 | 22378 | 12968 | 19737 | 8948 | 3528 | 5985 | 21137 | 7297 | 17939 |
| | 4794 | 21353 | 18048 | 8171 | 10670 | 8716 | 12196 | 630 | 6184 | 9202 | 16022 | 537 |
| | 15237 | 12703 | 1072 | 5466 | 12261 | 21044 | 4892 | 1108 | 11923 | 17859 | 5617 | 712 |
| | 6109 | 7745 | 16695 | 11050 | | | | | | | | |
| 436: | 16500 | 8982 | 2601 | 9214 | 5987 | 9273 | 2383 | 3132 | 16871 | 4889 | 1471 | |
| 437: | 14507 | 14477 | 15421 | 18062 | 17494 | 2654 | 566 | 7991 | 19769 | 6346 | 18037 | 2783 |
| | 11158 | 1991 | 2025 | 16965 | 22007 | 22121 | 19530 | 17738 | 1299 | 10771 | 4864 | 1869 |
| | 18259 | 5076 | 18894 | 10621 | 8796 | 1194 | 21241 | 4280 | 16103 | 3266 | 19426 | 6888 |
| | 1697 | 10045 | 1251 | 7276 | 7003 | 19243 | 7580 | 12814 | 7126 | 16291 | 7248 | 3598 |
| | 18820 | 18737 | 12671 | 18581 | 16569 | 13403 | 4999 | 20923 | 1142 | 14188 | 5501 | 20417 |
| | 21625 | 3253 | 10604 | 7339 | 7394 | 4463 | 10287 | 9635 | 12724 | 898 | 4347 | 12691 |
| | 8702 | 12055 | 20545 | 15743 | 3704 | 10510 | 16542 | 16559 | 21229 | 11524 | 9274 | 11075 |
| | 8804 | 17224 | 3133 | 3607 | 10123 | 13418 | 15872 | 11732 | 740 | 19109 | 1359 | 17419 |
| | 10051 | 6843 | 5509 | 1680 | 11707 | 10865 | 22296 | 16067 | 1000 | 18908 | 3406 | 9844 |
| | 20469 | 8719 | 4041 | 6395 | 20688 | 22346 | 4623 | 17333 | 14975 | 11866 | 3840 | 16733 |
| | 5395 | 17783 | 17305 | 10611 | 7631 | 1274 | 3777 | 16608 | 21902 | 3032 | 10224 | 13407 |
| | 20759 | 22152 | 18157 | 1337 | 16447 | 12222 | 2772 | 10847 | 17604 | 4797 | 20901 | 21087 |
| | 19143 | 7452 | 8263 | 17993 | 16659 | 22147 | 10166 | 2993 | 14457 | 11862 | 9220 | 12697 |
| | 16162 | 17146 | 7667 | 9071 | 7594 | 19062 | 11610 | 5047 | 11793 | 10376 | 5672 | 2355 |
| | 3480 | 10028 | 20595 | 20275 | 1292 | 17594 | 12254 | 20642 | 4853 | 8186 | 16379 | 11759 |
| | 11502 | 8591 | 4288 | 15333 | 9201 | 12553 | 3846 | 15765 | 17537 | 5294 | 9934 | 16724 |
| | 3395 | 2370 | 4038 | 2297 | 1916 | 7144 | 12063 | 3319 | 11943 | 4162 | 7304 | 4298 |
| | 9147 | 11434 | 11341 | 10440 | 4734 | 13768 | 5151 | 2008 | 20772 | 4271 | 19954 | 22378 |
| | 12968 | 22114 | 2955 | 21137 | 20802 | 5035 | 10180 | 17939 | 4794 | 16466 | 19950 | 18656 |
| | 13358 | 19797 | 9733 | 18048 | 8171 | 11041 | 10670 | 17196 | 16314 | 21075 | 20434 | 20432 |
| | 4222 | 8716 | 4904 | 18464 | 630 | 8403 | 6184 | 18819 | 5523 | 6647 | 14751 | 16022 |
| | 17350 | 12703 | 4597 | 17792 | 11159 | 7291 | 15512 | 1072 | 15476 | 6812 | 15612 | 4183 |
| | 17341 | 12261 | 10729 | 21044 | 9980 | 1108 | 4892 | 1406 | 22046 | 17859 | 11923 | 5617 |
| | 18198 | 6967 | 5043 | 1264 | 22123 | 20318 | 12469 | 10452 | 12218 | 13091 | 15516 | 5701 |
| | 8047 | 16361 | 6109 | 14712 | 21918 | 22157 | 7745 | 16695 | 22271 | 11050 | 6934 | 7635 |
| | 6231 | | | | | | | | | | | |
| 438: | 3768 | 9465 | 20939 | 10052 | 11543 | 2583 | 2455 | 10554 | 14401 | 2398 | 18197 | 15151 |
| | 12975 | 22406 | 10665 | 9509 | 15663 | 5927 | 13360 | 6164 | 16012 | 7099 | 21660 | 8046 |
| | 5207 | 4255 | 5194 | 15420 | 1613 | 12275 | 14710 | 16908 | 3629 | 20166 | 7194 | 4457 |
| | 5992 | 7677 | 13929 | 12101 | 15458 | 11274 | 20283 | 7521 | 14721 | | | |
| 439: | 14966 | 4405 | 7118 | 6146 | 8600 | 7777 | 22037 | 13873 | 8489 | 21468 | 8655 | 19547 |
| | 10433 | 17970 | 9362 | 20687 | 16031 | 887 | 7010 | 20077 | 4253 | 21851 | 14561 | 6562 |
| | 15040 | 11590 | 1611 | 13370 | 21623 | 10658 | 13700 | 6147 | 16428 | 6376 | 14491 | 7527 |
| | 12266 | 22380 | 14286 | 8408 | 4247 | 10369 | 7295 | 19540 | 12488 | 11421 | 18418 | 20410 |
| | 4446 | 3422 | 5527 | 5306 | 1906 | 20728 | 7396 | 20941 | 2529 | 6606 | 4873 | 7218 |
| | 19654 | 13098 | 12189 | 18969 | 15325 | 4309 | 13598 | 20706 | 9719 | 8328 | 20122 | 16518 |
| | 4685 | 8609 | 21086 | 1946 | 9979 | 2746 | 15560 | 7370 | 17671 | 15455 | 6005 | 3018 |
| | 4686 | 4101 | 22066 | 4236 | 21839 | 3651 | 4990 | 11914 | 15738 | 6771 | 3325 | 20546 |
| | 14826 | 19572 | 9615 | 13650 | 13899 | 13584 | 8742 | 3543 | 17869 | 19591 | 17545 | 22430 |
| | 2960 | 4200 | 2077 | 8177 | 7719 | 2622 | 6263 | 9849 | 1470 | 5989 | 1311 | 21426 |
| | 17824 | 7804 | 768 | 15927 | 14310 | 9131 | 19750 | 19247 | 21469 | 14334 | 14266 | 14771 |
| | 6820 | 17114 | 15394 | 15812 | 13253 | 2599 | 12929 | 5170 | 19859 | 15229 | 15346 | 19250 |
| | 1984 | 14570 | 11409 | 5996 | 20660 | 21736 | 20018 | 22326 | 19741 | 21896 | 19744 | 14409 |
| | 13692 | 3399 | 3194 | 17618 | 14100 | 18368 | 2518 | 690 | 20346 | 14843 | 6521 | 4745 |
| | 19127 | 22103 | 15018 | 18736 | 20115 | 1684 | 21656 | 3590 | 20651 | 2319 | 16368 | 7672 |
| | 3740 | 21690 | 1173 | 6846 | 5212 | 19894 | 8599 | 13173 | 8940 | 12978 | 16135 | 15091 |
| | 18853 | 20615 | 1491 | 18437 | 15682 | 13879 | 16777 | 19476 | 17619 | 1577 | 7748 | 13631 |
| | 13915 | 10365 | 12457 | 15298 | 8901 | 8625 | 5241 | 7358 | 14305 | 18568 | 18524 | 14410 |
| | 11871 | 21891 | 15823 | 20498 | 6200 | 9264 | 16240 | 19297 | 18458 | 2821 | 14785 | 3126 |
| | 14169 | 5798 | 9737 | 21776 | 19585 | 3198 | 14858 | 22300 | 7338 | 8554 | 11016 | 18990 |
| | 9617 | 18528 | 8024 | 16993 | 22122 | 4137 | 8570 | 22146 | 12226 | 9200 | 11674 | 21612 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 14895 | 9476 | 16664 | 3321 | 16193 | 18447 | 16049 | 5313 | 18953 | 8533 | 11938 | 13683 |
| | 5508 | 2740 | 18932 | 19696 | 7262 | 8603 | 9275 | 18376 | 10691 | 20818 | 7714 | 1458 |
| | 12356 | 7720 | 7819 | 17020 | 17844 | 13115 | 5156 | 10998 | 6550 | 16814 | 12176 | 777 |
| | 14663 | 18952 | 3941 | 6256 | 10163 | 1231 | 14652 | 12351 | 20934 | 5346 | 3674 | 3417 |
| | 3413 | 20689 | 13348 | 3105 | 5424 | 8660 | 8772 | 19183 | 22278 | 21459 | 16873 | 20072 |
| | 17128 | 16743 | 19690 | 4218 | 3991 | 11096 | 10955 | 5602 | 886 | 19026 | 21015 | 19125 |
| | 13706 | 10726 | 19356 | 12958 | 17574 | 18510 | 16516 | 22357 | 8610 | 3240 | 7095 | 3522 |
| | 21988 | 5616 | 7937 | 3174 | 1747 | 3775 | 10024 | 6702 | 4908 | 6372 | 2579 | 18940 |
| | 21345 | 5519 | 15356 | 13540 | 14244 | 5795 | 14821 | 14518 | 20309 | 12120 | 2485 | 17587 |
| | 14150 | 15819 | 9978 | 12910 | 11595 | 16932 | 1960 | 694 | 14412 | 11488 | 18681 | 8778 |
| | 12679 | 17521 | 8810 | 5092 | 21175 | 2974 | 13020 | 10931 | 21585 | 2789 | 4153 | 18786 |
| | 18329 | 1083 | 19178 | 2493 | 21206 | 9256 | 15592 | 13324 | 16856 | 12883 | 15416 | 22022 |
| | 685 | 13962 | 7186 | 2183 | 1824 | 7815 | 9340 | 13838 | 4490 | 22377 | 18686 | 9359 |
| | 16226 | 1355 | 9864 | 4384 | 15337 | 14450 | 4671 | 8942 | 10589 | 3962 | 9323 | 19836 |
| | 12509 | 15215 | 5193 | 8404 | 6144 | 21817 | 7541 | 10871 | 1525 | 21274 | 13622 | 9110 |
| | 8628 | 2177 | 7874 | 14877 | 8824 | 18554 | 3163 | 18907 | 15713 | 2835 | 16426 | 3153 |
| | 20949 | 2770 | 7004 | 14833 | 12848 | 4690 | 18093 | 18783 | 15352 | 8130 | 7593 | 18583 |
| | 3501 | 4178 | 14120 | 14899 | 3694 | 21340 | 1642 | 6921 | 16503 | 11048 | 5058 | 2817 |
| | 9969 | 13347 | 19955 | 11925 | 20475 | 21679 | 16040 | 21148 | 2936 | 11490 | 9879 | 3668 |
| | 15510 | 9259 | 5266 | 11317 | 15129 | 15828 | 17404 | 18074 | 18271 | 12632 | 22568 | 6154 |
| | 19613 | 4529 | 14306 | 9441 | 17517 | 20968 | 2859 | 19635 | 2252 | 15293 | 3989 | 7716 |
| | 16280 | 13326 | 11344 | 11586 | 14234 | 9625 | 5215 | 13361 | 1156 | 16246 | 444 | 20628 |
| | 5316 | 13449 | 3080 | 16715 | 10685 | 19801 | 5171 | 1815 | 3509 | 16084 | 17427 | 995 |
| | 9018 | 10526 | 18574 | 10099 | 13402 | 17849 | 6159 | 17431 | 3824 | 555 | 9659 | 14148 |
| | 9887 | 22551 | 16739 | 20950 | 2267 | 11455 | 5169 | 15137 | 17589 | 4048 | 18400 | 8026 |
| | 1816 | 14675 | 4107 | 22512 | 7319 | 16725 | 20176 | 1188 | 3250 | 10266 | 3394 | 15649 |
| | 6275 | 16233 | 11157 | 7931 | 10836 | 20212 | 6842 | 21580 | 18201 | 18602 | 7675 | 17976 |
| | 14515 | 12856 | 12375 | 20806 | 1835 | 10204 | 928 | 877 | 18843 | 14059 | 6197 | 22517 |
| | 12239 | 14250 | 21061 | 548 | 2492 | 19311 | 18449 | 5757 | 16595 | 21416 | 19162 | 10349 |
| | 18182 | 5204 | 19779 | 22446 | 2313 | 11619 | 20729 | 18442 | 6595 | 12083 | 6350 | |
| 440: | 13290 | 13287 | 12491 | 9089 | 17221 | 9777 | 9141 | 4749 | 6525 | 10696 | 2418 | |
| 441: | 5159 | 5787 | 3587 | 20298 | 1786 | 13310 | 1389 | 10380 | 15437 | 20220 | 15554 | 14498 |
| | 1082 | 9121 | 21871 | 18718 | 1610 | 17142 | 16098 | 20306 | 17432 | 20695 | 8310 | 15692 |
| | 2042 | 20770 | 15746 | 11972 | 20448 | 7362 | 5959 | 17865 | 8865 | 4630 | 3037 | 6655 |
| | 4037 | 16478 | 11125 | 6160 | 10003 | 14982 | 9652 | 7150 | 5560 | 21884 | 7298 | 3602 |
| | 9622 | 20738 | 13828 | 4091 | 21632 | 1885 | 10098 | 5784 | 19579 | 11915 | 1619 | 4973 |
| | 4953 | 15722 | 18588 | 9009 | 3874 | 3245 | 15203 | 22499 | 1147 | 19826 | 15124 | 8880 |
| | 21552 | 2999 | 14657 | 21323 | 6418 | 1393 | 5831 | 1681 | 17953 | 9370 | 9708 | 13283 |
| | 7660 | 9230 | 20542 | 6634 | 21649 | 6803 | 7555 | 12376 | 14548 | 16219 | 9559 | 21885 |
| | 10474 | 5522 | 13930 | 9391 | 12268 | 15620 | 22031 | 14151 | 12757 | 13437 | 1509 | 3933 |
| | 21317 | 8728 | 11995 | 13090 | 16778 | 17402 | 11699 | 16105 | 1278 | 2276 | 10571 | 834 |
| | 14094 | 1564 | 4767 | 5915 | 1665 | 19312 | 9166 | 2756 | 14136 | 20976 | 11340 | 16028 |
| | 13738 | 1229 | | | | | | | | | | |
| 442: | 12225 | 16626 | 7991 | 19769 | 20707 | 21228 | 18920 | 15677 | 22007 | 1246 | 1299 | 4864 |
| | 1869 | 18259 | 5076 | 18894 | 8796 | 1194 | 21241 | 3266 | 19426 | 6888 | 17781 | 10045 |
| | 1251 | 11444 | 7126 | 7580 | 7248 | 17460 | 18820 | 16569 | 4999 | 20923 | 5501 | 20417 |
| | 12724 | 12691 | 8702 | 12055 | 8006 | 14571 | 19675 | 16542 | 11524 | 14891 | 11459 | 15395 |
| | 15872 | 9301 | 740 | 19109 | 15861 | 1359 | 17419 | 10051 | 6843 | 5509 | 16067 | 22296 |
| | 18908 | 12031 | 4041 | 3840 | 17305 | 10611 | 1428 | 10769 | 7631 | 21902 | 14896 | 20759 |
| | 22152 | 18157 | 1337 | 10847 | 14596 | 3679 | 21087 | 17626 | 10092 | 3743 | 21220 | 22333 |
| | 4831 | 12317 | 17353 | 2073 | 22147 | 9664 | 11526 | 9220 | 2983 | 5429 | 13258 | 10529 |
| | 12270 | 3138 | 6868 | 10376 | 2355 | 11711 | 9314 | 6624 | 17713 | 17898 | 12386 | 10028 |
| | 20595 | 10383 | 4591 | 11502 | 11759 | 11992 | 15333 | 9201 | 12553 | 15765 | 5294 | 4038 |
| | 7144 | 1916 | 10304 | 3319 | 11943 | 7304 | 9147 | 4298 | 11434 | 11341 | 9677 | 12289 |
| | 5151 | 20772 | 19954 | 22175 | 19748 | 3020 | 16083 | 19737 | 21137 | 3274 | 6780 | 14060 |
| | 10848 | 7124 | 17939 | 21761 | 1661 | 9701 | 6223 | 5983 | 18048 | 10670 | 1709 | 8716 |
| | 12196 | 630 | 8582 | 9202 | 16022 | 17350 | 7291 | 21223 | 15476 | 12261 | 21044 | 1108 |
| | 4892 | 1406 | 22046 | 11923 | 18198 | 6967 | 22123 | 20318 | 12469 | 10452 | 8047 | 6109 |
| | 14712 | 7745 | 11374 | | | | | | | | | |
| 443: | 620 | 12442 | 20304 | 1418 | 14021 | 9656 | 19898 | 1753 | 11261 | 6048 | 9339 | 20785 |
| | 14195 | 2548 | 20087 | 4601 | 12996 | 2180 | 21054 | 8933 | 8763 | 20471 | 14140 | 10491 |
| | 10186 | 6478 | 12177 | 17437 | 1521 | 8613 | 20482 | 15739 | 2169 | 12190 | 15573 | 15908 |
| | 1717 | 6770 | 16901 | 15379 | 7349 | 10141 | 17028 | 12150 | 9400 | 11457 | 15837 | 15021 |
| | 17531 | 12650 | 16974 | 10219 | 14993 | | | | | | | |
| 444: | 7118 | 14966 | 4405 | 6146 | 8600 | 7777 | 13873 | 22037 | 8489 | 21468 | 8655 | 10433 |
| | 19547 | 9362 | 20687 | 16031 | 20077 | 4253 | 21851 | 14561 | 6562 | 15040 | 11590 | 1611 |
| | 13370 | 21623 | 10658 | 6147 | 16428 | 19540 | 10369 | 13700 | 14491 | 7527 | 4247 | 14286 |
| | 12266 | 12488 | 6376 | 22380 | 18418 | 8408 | 11421 | 7295 | 20410 | 4446 | 3422 | 5527 |
| | 5306 | 1906 | 20728 | 7396 | 2529 | 20941 | 4873 | 7218 | 19654 | 13098 | 12189 | 18969 |
| | 15325 | 4309 | 13598 | 20706 | 8328 | 9719 | 20122 | 2746 | 15560 | 1946 | 9979 | 21086 |
| | 17671 | 6005 | 7370 | 15455 | 3018 | 4101 | 4686 | 22066 | 4236 | 21839 | 3651 | 4990 |

TABLE 17-continued

| Sequence IDs for homolog proteins | | | | | | | | | | | | |
|---|---|---|---|---|---|---|---|---|---|---|---|---|
| Seq ID NO: | homolog Seq ID NOs | | | | | | | | | | | |
| | 11914 | 15738 | 3325 | 6771 | 20546 | 14826 | 19572 | 13650 | 9615 | 13899 | 13584 | 3543 |
| | 17869 | 19591 | 17545 | 22430 | 2960 | 2077 | 4200 | 8177 | 7719 | 2622 | 6263 | 9849 |
| | 1470 | 5989 | 1311 | 17824 | 21426 | 7804 | 768 | 15927 | 14310 | 9131 | 19750 | 19247 |
| | 21469 | 14771 | 14334 | 14266 | 15812 | 15394 | 17114 | 6820 | 2599 | 19859 | 12929 | 5170 |
| | 15229 | 15346 | 19250 | 1984 | 14570 | 11409 | 5996 | 21736 | 20018 | 22326 | 20660 | 19741 |
| | 21896 | 19744 | 14409 | 13692 | 3194 | 17618 | 3399 | 17236 | 14100 | 18368 | 2518 | 690 |
| | 20346 | 14843 | 15018 | 1684 | 18736 | 20115 | 21656 | 3590 | 20651 | 1173 | 5212 | 6846 |
| | 8599 | 19894 | 13173 | 12978 | 8940 | 16135 | 15091 | 18853 | 20615 | 1491 | 15682 | 13879 |
| | 16777 | 19476 | 17619 | 1577 | 7748 | 13631 | 13915 | 10365 | 15298 | 12457 | 8901 | 8625 |
| | 14305 | 18568 | 18524 | 14410 | 11871 | 21891 | 6326 | 13311 | 6747 | 13835 | 5310 | 2038 |
| | 11820 | 1116 | 18682 | 439 | 21539 | 20042 | 6396 | 15465 | 17351 | 4069 | 12600 | 18504 |
| | 4527 | 20683 | 15823 | 12851 | 18338 | 6200 | 20498 | 9264 | 16240 | 12538 | 14814 | 15115 |
| | 18458 | 19297 | 9737 | 21776 | 14169 | 5798 | 3126 | 14785 | 19585 | 3198 | 14858 | 22300 |
| | 21664 | 7338 | 8554 | 18990 | 21738 | 9617 | 20013 | 11016 | 8024 | 16993 | 22122 | 4137 |
| | 8570 | 22146 | 12226 | 9200 | 11674 | 21612 | 9476 | 3321 | 16049 | 16193 | 18447 | 11938 |
| | 8533 | 5508 | 13683 | 2740 | 18932 | 19696 | 7262 | 8603 | 10691 | 18376 | 20818 | 7714 |
| | 1970 | 8639 | 12180 | 20962 | 1458 | 12356 | 17844 | 7720 | 17020 | 7819 | 13115 | 5156 |
| | 10998 | 6550 | 16814 | 12176 | 14663 | 777 | 18952 | 6256 | 3941 | 3417 | 3413 | 3105 |
| | 5424 | 8660 | 20689 | 13348 | 8772 | 19183 | 11096 | 16873 | 22278 | 886 | 21459 | 3991 |
| | 19690 | 4218 | 5602 | 3174 | 1747 | 6702 | 4908 | 10024 | 2579 | 6372 | 18940 | 5795 |
| | 3775 | 14821 | 5519 | 15356 | 13540 | 14518 | 21345 | 14244 | 20309 | 12120 | 2485 | 9978 |
| | 17587 | 11595 | 12910 | 15819 | 14150 | 694 | 16932 | 8778 | 1960 | 5092 | 17521 | 2770 |
| | 2183 | 685 | 22022 | 12883 | 15416 | 13962 | 6144 | 1824 | 7815 | 19836 | 4384 | 4671 |
| | 16226 | 8942 | 1355 | 9864 | 10589 | 14450 | 7186 | 13838 | 9359 | 9340 | 18686 | 9323 |
| | 3962 | 4490 | 22377 | 15337 | 15215 | 7874 | 5193 | 8404 | 21817 | 7541 | 12509 | 3501 |
| | 10871 | 1525 | 9110 | 13622 | 8628 | 14833 | 3163 | 18554 | 15713 | 21274 | 8824 | 16426 |
| | 20949 | 2177 | 14877 | 7004 | 3153 | 18907 | 12848 | 18783 | 14120 | 4690 | 11925 | 18093 |
| | 14899 | 15352 | 6921 | 18583 | 19635 | 16503 | 3694 | 21340 | 9969 | 7593 | 11048 | 11344 |
| | 11586 | 14234 | 13449 | 3080 | 16715 | 19801 | 3509 | 17427 | 16084 | 10099 | 17849 | 13402 |
| | 6159 | 17431 | 14148 | 3824 | 555 | 9659 | 22551 | 9887 | 2267 | 16739 | 20950 | 11455 |
| | 5169 | 15137 | 16725 | 1188 | 20176 | 3250 | 10266 | 3394 | 15649 | 6275 | 16233 | 11157 |
| | 7931 | 10836 | 20212 | 6842 | 17976 | 21580 | 18201 | 7675 | 18602 | 14515 | 12856 | 12375 |
| | 20806 | 1835 | 928 | 877 | 14059 | 18843 | 6197 | 22517 | 12239 | 14250 | 21061 | 548 |
| | 2492 | 19311 | 18449 | 5757 | 16595 | 10349 | 18182 | 5204 | 19779 | 22446 | 2313 | 11619 |
| | 20729 | 18442 | 6595 | 12083 | 6350 | | | | | | | |
| 445: | 21014 | 8217 | 3568 | 15315 | 16602 | 22197 | 20633 | 10719 | 22273 | 7927 | 12557 | 3214 |
| | 5391 | 17035 | 16717 | 18176 | 3239 | 21949 | 541 | 17286 | 20722 | 21074 | 17292 | 19789 |
| | 4688 | 6904 | 4467 | 1219 | 19816 | 19041 | 17181 | 21332 | 18859 | 22211 | 8218 | 2257 |
| | 6585 | 7606 | 16882 | 11061 | 6736 | 15760 | 18569 | 22238 | 10997 | 3586 | 4444 | 11325 |
| | 16288 | 5712 | 12397 | 13355 | 14617 | 8607 | 12841 | 4510 | 17747 | 8828 | 10495 | 7078 |
| | 11921 | 20794 | 5507 | 14664 | 17923 | 2708 | 13572 | 15775 | 2513 | 11167 | 14105 | 3111 |
| | 11389 | 3370 | 20781 | 7301 | 10605 | 20844 | 14047 | 14130 | 22186 | 16977 | 10134 | 11180 |
| | 19900 | 10713 | 1464 | 7899 | 2349 | 6473 | 6149 | 17373 | 2862 | 15797 | 14327 | 10299 |
| | 17623 | 20126 | 6074 | 2179 | 9070 | 18653 | 19230 | 14764 | 18671 | 15774 | 11854 | 9254 |
| | 7597 | 9029 | 4935 | 1891 | 7776 | 14288 | 7040 | 20201 | 10153 | 16227 | 4268 | 19425 |
| | 11328 | 17458 | 2842 | 14940 | 6228 | 15942 | 6091 | 22429 | 723 | 13304 | 7975 | 9105 |
| | 16127 | 19403 | 11783 | 823 | 6252 | 21376 | 13980 | 4302 | 22514 | 6008 | 19617 | 15008 |
| | 5641 | 9634 | 543 | 14573 | 2873 | 11280 | 18674 | 12111 | 5653 | 8223 | 7146 | 12775 |
| | 12377 | 16801 | 7816 | 4017 | 16666 | 19793 | 7002 | | | | | |
| 446: | 10867 | 18970 | 4967 | 22194 | 5235 | 18316 | 19541 | 18967 | 16679 | 12435 | 17897 | 14632 |
| | 9836 | 7200 | 3244 | 4931 | 6155 | 724 | 767 | 11956 | 2291 | 15034 | 1158 | 4627 |
| | 22468 | 2941 | 13822 | 6431 | 20840 | 3978 | 3058 | 2820 | 4352 | 17463 | 13357 | 17354 |
| | 2351 | 1025 | 3451 | 8214 | 2208 | | | | | | | |
| 447: | 3349 | 11861 | 16061 | 20185 | 18887 | 5336 | 6597 | 12949 | 13433 | 7265 | 3983 | 19704 |
| | 21765 | 4512 | 9383 | 17441 | 11806 | 19145 | 7957 | 1660 | 16578 | 8361 | 12877 | 12285 |
| | 6745 | 14055 | 16201 | 22143 | 8158 | 1754 | 1561 | 9710 | 18005 | 11717 | 18079 | 2243 |
| | 21572 | 10276 | 6672 | 1451 | 5576 | 13128 | 10885 | 6027 | 6068 | 15496 | 10454 | 833 |
| | 15308 | 2899 | 11018 | 20697 | 14627 | 3974 | 7859 | 15270 | 16400 | 15938 | 15725 | 15423 |
| | 5811 | 19619 | 2698 | 19513 | 5502 | 3862 | 14005 | 6242 | 14353 | 16413 | 5739 | 5131 |
| | 1844 | 15747 | 8386 | 4651 | 22360 | 19139 | 7085 | 13831 | 22094 | 8195 | 21288 | 3065 |
| | 16776 | 4822 | 18118 | 19091 | 5553 | 12572 | 14834 | 21349 | 16815 | 8955 | 13075 | 12733 |
| | 4648 | 21653 | 22049 | 5403 | 1029 | 1877 | 1485 | 22486 | 14277 | 19152 | 7372 | 4606 |
| | 21858 | 17690 | 9703 | 12831 | 6467 | 10808 | 13527 | 19173 | 11175 | 11657 | 2942 | 16325 |
| | 1265 | 17141 | 11133 | 17532 | 18407 | 20507 | 14912 | 8705 | 18889 | 792 | 12024 | 4746 |
| | 6954 | 5377 | 14106 | 3811 | 9106 | 7669 | 17506 | 18207 | 11911 | 10409 | 20449 | 9181 |
| | 18488 | 21792 | 22305 | 9003 | 12668 | 7458 | 11471 | 11697 | 19342 | 10966 | 5324 | 17192 |
| | 9173 | 21172 | 21538 | 9379 | 8949 | 22434 | 3555 | 19594 | 13734 | 5195 | 4504 | 5963 |
| | 14256 | 6939 | 6345 | 1162 | 18406 | 2357 | 17784 | 1442 | 4331 | 6935 | 5879 | 18326 |
| | 2240 | 20428 | 19414 | 11272 | 3444 | 14731 | 8631 | 1809 | 21833 | 14869 | 9442 | 3632 |
| | 12121 | 8845 | 20490 | 19745 | 13155 | 12792 | 12563 | 14861 | 14746 | 14813 | 4528 | 17811 |
| | 1567 | 2911 | 10316 | 11855 | 21730 | 13905 | 22042 | 3872 | 20386 | 9570 | 6304 | 9122 |
| | 6011 | 10819 | 2612 | 733 | 11892 | 20852 | 15230 | 16137 | 13985 | 13024 | 11612 | 8752 |
| | 1512 | 3948 | 22301 | 14196 | 1070 | 2951 | 8433 | 842 | 12944 | 19948 | 22053 | 9341 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 9353 | 1718 | 16198 | 8546 | 15048 | 9919 | 20674 | 21812 | 3909 | 10843 | 16432 | 15654 |
| | 4043 | 6714 | 14847 | 8707 | 9886 | 20997 | 22088 | 13038 | 8037 | 9178 | 2878 | 21388 |
| | 5352 | 3851 | 6484 | 13259 | 20733 | 16180 | 20444 | 5834 | 17651 | 21480 | 13792 | 22149 |
| | 13049 | 13689 | 6933 | 5650 | 21822 | 22010 | 13935 | 7093 | 15175 | 21104 | 21571 | 13059 |
| | 14166 | 1320 | 14676 | 19388 | 12387 | 10615 | 2572 | 18647 | 16738 | 21225 | 7210 | 15278 |
| | 11859 | 4902 | 21097 | 13308 | 18378 | 12809 | 17277 | 1707 | 10671 | 4638 | 13485 | 7397 |
| | 2352 | 5048 | 7941 | 13275 | 5252 | 11316 | 3053 | 9127 | 6631 | 5081 | 2879 | 17029 |
| | 14783 | 12504 | 3446 | 5574 | 11878 | 2839 | 3228 | 16798 | 6179 | 1088 | 1402 | 19752 |
| | 22525 | 21445 | 16859 | 10813 | 2895 | 8708 | 2051 | 20050 | 10689 | 13359 | 6382 | 9920 |
| | 16804 | 3557 | 13937 | 22048 | 15372 | 19186 | 2356 | 21850 | 10645 | 17724 | 7740 | 18043 |
| | 18443 | 14254 | 8080 | 7679 | 18267 | 13583 | 7611 | 8668 | 2471 | 7128 | 21146 | 15408 |
| | 1163 | 8078 | 5556 | 13897 | 17262 | 5961 | 22314 | 15730 | 18968 | 650 | 8513 | 11528 |
| | 7068 | 3085 | 14046 | 13243 | 11222 | 15011 | 3976 | 1105 | 15891 | 1507 | 6229 | 10269 |
| | 17937 | 9774 | 5505 | 5939 | 7480 | 1497 | 3041 | 15132 | 9987 | 18054 | 12199 | 21835 |
| | 22529 | 20727 | 7448 | 2979 | 5186 | 13110 | 17553 | 15284 | 15066 | 21091 | 12304 | 13927 |
| | 2253 | 22173 | 14128 | 9863 | 4969 | 20557 | 7177 | 21588 | 7134 | 20606 | 17839 | 15095 |
| | 4399 | 2214 | 21594 | 19310 | 3008 | 2570 | 8102 | 16155 | 4099 | 18252 | 20237 | 9891 |
| | 20458 | 14831 | 9119 | 9194 | 7573 | 11856 | 2558 | 21715 | 10855 | 5766 | 15158 | 3389 |
| | 1154 | 11165 | 21797 | 3985 | 15097 | 8881 | 12231 | 16104 | 647 | 19765 | 22387 | 4155 |
| | 2561 | 4615 | 21305 | 15139 | 4964 | 16030 | 20281 | 8285 | 15689 | 12785 | 2196 | 1531 |
| | 12335 | 20138 | 9927 | 1132 | 4098 | 6925 | 14275 | 10776 | 22136 | 15697 | 16176 | 15977 |
| | 2664 | 9816 | 17562 | 11028 | 11930 | 10157 | 8670 | 12353 | 12574 | 2954 | 21428 | 12735 |
| | 2392 | 5226 | 8680 | 17177 | 8835 | 7167 | 15667 | 18591 | 21341 | 2172 | 3869 | 15589 |
| | 20343 | 19825 | 5210 | 7091 | 22444 | 3844 | 717 | 18902 | 14808 | 11659 | 1785 | 13405 |
| | 22226 | 8233 | 21693 | 10456 | 13156 | 14660 | 12659 | 6461 | 10253 | 7132 | 5280 | 16881 |
| | 15728 | 12322 | 846 | 14049 | 12744 | 8140 | 20493 | 15683 | 11033 | 12989 | 5866 | 18113 |
| | 1964 | 14109 | 15020 | 20584 | 17016 | 18813 | 5845 | 7915 | 21617 | 20412 | 1643 | 20533 |
| | 8020 | 9158 | 19107 | 2930 | 21064 | 15660 | 21586 | 18572 | 10523 | 4610 | 13545 | 7585 |
| | 1761 | 2480 | 16383 | 16486 | 1541 | 8462 | 2592 | 3201 | 11077 | 14726 | 20135 | 9411 |
| | 9402 | 12669 | 15995 | 15348 | 7755 | 8168 | 551 | 8916 | 3112 | 13876 | 21933 | 12219 |
| | 14513 | 6877 | 8898 | 8597 | 18116 | 8268 | 9085 | 9769 | 11890 | 21961 | 11709 | 10758 |
| | 12800 | 8640 | 1212 | 10509 | 21023 | 21751 | 11267 | 1557 | 18735 | 18051 | 21254 | 15200 |
| | 5771 | 17912 | 3381 | 18702 | 19564 | 12819 | 15172 | 17593 | 8712 | 8128 | 1909 | 6496 |
| | 14338 | 16091 | 948 | 17565 | 16614 | 18595 | 11540 | 18075 | 9306 | 10608 | 12167 | 9268 |
| | 17453 | 12880 | 21522 | 13525 | 10162 | 5843 | 7885 | 18002 | 13496 | 9474 | 11489 | 13260 |
| | 14139 | 10989 | 5078 | 5480 | 16165 | 3428 | 2826 | 5882 | 20175 | 15811 | 16116 | 7879 |
| | 5318 | 8325 | 1069 | 22306 | 21302 | 6156 | 22394 | 14294 | 5702 | 4766 | 568 | 15271 |
| | 1077 | 16409 | 17778 | 9726 | 14452 | 21497 | 5648 | 10532 | 3647 | 15330 | 8350 | 18444 |
| | 19227 | 19834 | 3890 | 21780 | 12302 | 13191 | 21151 | 13104 | 12185 | 20101 | 10857 | 11960 |
| | 7382 | 18469 | 4948 | 11036 | 12852 | 11208 | 9994 | 14197 | 5906 | 16060 | 20197 | 3576 |
| | 1115 | 6471 | 4258 | 14545 | 21796 | 17471 | 17991 | 14998 | 3215 | 307 | 10382 | 6929 |
| | 2580 | 6731 | 8289 | 9480 | 9118 | 11333 | 12900 | 8452 | 12605 | 11475 | 19577 | 6041 |
| | 2991 | 13102 | 15010 | 21059 | 21365 | 6894 | 11757 | 21208 | | | | |
| 448: | 17617 | 22319 | 7205 | 5436 | 22282 | 1508 | 1614 | 12460 | 8290 | 21670 | 8595 | 18790 |
| | 19872 | 21481 | 5282 | 5245 | 2363 | 9283 | 17848 | 10766 | 892 | 11279 | 3262 | |
| 449: | 13633 | 5900 | 8539 | 14672 | 20311 | 964 | 12233 | 10478 | 5805 | 8760 | 4906 | 10137 |
| | 3902 | 1838 | 13999 | 21067 | 4596 | 12781 | 4010 | 10761 | 8601 | 11786 | 6187 | 19637 |
| | 20291 | 12933 | 1404 | 16680 | 16262 | 4172 | 11107 | 2757 | 4381 | 11802 | 14386 | 6750 |
| | 3881 | 20169 | 3124 | 11582 | 4779 | 14837 | 16691 | 21558 | 16323 | 14350 | 7275 | 16234 |
| | 10634 | 8984 | 12657 | 3036 | 20253 | 12586 | 15643 | 8362 | 20529 | 4086 | 15778 | 15634 |
| | 10975 | 7311 | 15107 | 8618 | 8213 | 4431 | 2716 | 12985 | 488 | 2869 | 18696 | 12025 |
| | 7468 | 6477 | 4900 | 14759 | 645 | 8641 | 3783 | 17104 | 16899 | 21903 | 9293 | 2872 |
| | 7277 | 12282 | 7350 | 15064 | 2602 | 14650 | 13112 | 15517 | 7433 | 889 | 15267 | 21911 |
| | 19806 | 10064 | 15339 | 1645 | 20835 | 16525 | 12947 | 16705 | 22317 | 19397 | 18277 | 11661 |
| | 16082 | 8992 | 9337 | 17911 | 12718 | 11845 | 12581 | 12948 | 1001 | 4151 | 15609 | 5506 |
| | 19445 | 5163 | 11501 | 20741 | 15240 | 10944 | 3217 | 5255 | 11017 | 20435 | 15575 | 13834 |
| | 12427 | 2375 | 8287 | 6080 | 20581 | 16884 | 20690 | 12613 | 4380 | 15312 | 5145 | 10145 |
| | 1126 | 13494 | 15530 | 15431 | 22255 | 22276 | 19919 | 8963 | 4880 | 20168 | 20601 | 7009 |
| | 15363 | 10724 | 8126 | 7044 | 2098 | 13898 | 22554 | 17967 | | | | |
| 450: | 1006 | 429 | 10217 | 535 | 507 | 533 | 306 | 478 | 314 | 12870 | 18461 | 5240 |
| | 6367 | 19001 | 17394 | 8913 | 526 | 17484 | 7812 | 286 | 534 | 531 | 300 | 21030 |
| | 2857 | 17664 | 21589 | 11961 | 19154 | 21437 | 11195 | 20933 | 21506 | 3533 | 4677 | 18511 |
| | 4730 | 696 | 9569 | 17797 | 18687 | 7097 | 20259 | 15252 | 13221 | 22502 | 14915 | 21157 |
| | 22126 | 18059 | 20371 | 3563 | 12591 | 16308 | 7626 | 4212 | 20262 | 19798 | 19458 | 5691 |
| | 18292 | 11428 | 18877 | 16130 | 21296 | 2832 | 830 | 14553 | 6434 | 18295 | 17956 | 829 |
| | 476 | 12043 | 9077 | 20779 | 1281 | 17745 | 16586 | 7955 | 12705 | 15449 | 988 | 20859 |
| | 1768 | 11129 | 6547 | 22518 | 5552 | 9854 | 11376 | 6669 | 5359 | 9132 | 10964 | 1879 |
| | 22087 | 13137 | 17298 | 3333 | 13752 | 20301 | 19370 | 2425 | 6946 | 19538 | 14273 | 15340 |
| | 6427 | 17165 | 15603 | 12419 | 10809 | 8003 | 13658 | 18296 | 14064 | 4221 | 14568 | 17630 |
| | 2371 | 4694 | 12396 | 15369 | 16597 | 3697 | 10741 | 16309 | 4927 | 13396 | 9785 | 21621 |
| | 8841 | 16662 | 11120 | 14081 | 15204 | 6565 | 14320 | 2978 | 9294 | 7482 | 9493 | 1277 |
| | 4952 | 7813 | 7306 | 12296 | 12021 | 6645 | 9286 | 22489 | 13745 | 16653 | 19069 | 7780 |
| | 15219 | 16969 | 14762 | 18330 | 10802 | 10479 | 16663 | 3678 | 16713 | 7751 | 13703 | 3630 |

TABLE 17-continued

Sequence IDs for homolog proteins

| Seq ID NO: | homolog Seq ID NOs | | | | | | | | | | |
|---|---|---|---|---|---|---|---|---|---|---|---|
| | 4691 | 9472 | 10709 | 8542 | 7060 | 6112 | 22457 | 21974 | 20476 | 7333 | 6482 | 14526 |
| | 7151 | 2644 | 835 | 10655 | 12264 | 9315 | 2786 | 16253 | 9488 | 5634 | 17372 | 16548 |
| | 13727 | 19096 | 10973 | 788 | 10889 | 5190 | 13207 | 16465 | 13178 | 9673 | 5374 | 9771 |
| | 11716 | 10164 | 20541 | 3458 | 1240 | 15787 | 20099 | 9282 | 11480 | 4994 | 4865 | 1120 |
| | 6281 | 18662 | 7992 | 9661 | 19875 | 11156 | 3619 | 14086 | 20948 | 16946 | 3456 | 6143 |
| | 786 | 6709 | 5954 | 17926 | 20839 | 22351 | 13277 | 10965 | 15558 | 18982 | 2984 | 11245 |
| | 2132 | 20312 | 4655 | 16568 | 21093 | 13882 | 5730 | 7976 | 7079 | 13035 | 2800 | 305 |
| | 307 | 509 | 12545 | 2037 | 11704 | 9571 | 21379 | 3712 | 7685 | 4483 | 18456 | 22341 |
| | 3094 | 11197 | 13107 | 16006 | 532 | | | | | | | |
| 451: | 3345 | 751 | 19630 | 15890 | 21334 | 2502 | 16406 | 10364 | 15556 | 10330 | 10995 | 14378 |
| | 13458 | 16021 | 7590 | 20173 | 3502 | 572 | 19897 | 3673 | 12693 | 3848 | 6462 | 21994 |
| | 20804 | 17582 | 4276 | 16244 | 8615 | 17497 | 11060 | 9796 | 2390 | 21178 | 7166 | 2759 |
| | 19905 | 12817 | 14186 | 14243 | 5490 | 6784 | 5792 | 13470 | 1101 | 12561 | 6617 | 11241 |
| | 6402 | 9027 | 20751 | 1813 | 16709 | 11278 | 10008 | 3046 | 7793 | 13443 | 5592 | 8736 |
| | 3403 | 14205 | 19027 | 2511 | 14794 | 10004 | 16347 | 3927 | 13109 | 8732 | 21235 | 10480 |
| | 19155 | 2047 | 21601 | 2804 | 11826 | 19016 | 20937 | 21978 | 13295 | 3255 | 17452 | 6272 |
| | 19822 | 8274 | 14395 | 20792 | 19448 | 1967 | 4644 | 19536 | 3230 | 8051 | 21408 | 16552 |
| | 17526 | 4434 | 6675 | 10332 | 16527 | 11695 | 11834 | 4106 | 21315 | 20826 | 18978 | 17269 |
| | 22168 | 21255 | 19151 | 14377 | 2774 | 19782 | 12983 | 9784 | 9962 | 16564 | 850 | 18492 |
| | 20740 | 21582 | 7445 | 1779 | 10977 | 17687 | 11634 | 18743 | 18450 | 11001 | 19140 | 11439 |
| | 11743 | 13008 | 6064 | 17602 | 13592 | 13552 | 15418 | 11134 | 16033 | 20106 | 17363 | 12458 |
| | 12874 | 6513 | 15906 | 16223 | 1784 | 874 | 1125 | 9165 | 17183 | 4284 | 8998 | 583 |
| | 17287 | 963 | 5591 | 19466 | 4320 | 9188 | 20258 | 21605 | 17648 | 19691 | 3335 | 6816 |
| | 19609 | 22222 | 3733 | 6330 | 8114 | 19196 | 6605 | 22558 | 3373 | 5980 | 4992 | 10542 |
| | 21937 | 2186 | 4838 | 2923 | 20053 | 20960 | 4335 | 13352 | 2747 | 5898 | 8059 | 18499 |
| | 19914 | 7292 | 2255 | 21251 | 19565 | 10896 | 14138 | 1474 | 1803 | 22420 | 2054 | 18604 |
| | 4980 | 12543 | 19544 | 7953 | 17754 | 18426 | 21889 | 21464 | 7125 | 21785 | 14725 | 10578 |
| | 7357 | 2460 | 2281 | 4747 | 13666 | 6881 | 21446 | 19660 | 14216 | 1004 | 17442 | 21195 |
| | 9433 | 21820 | 7213 | 8549 | 21471 | 8344 | 17607 | 6026 | 13716 | 12371 | 18944 | 19208 |
| | 20867 | 13887 | 15334 | 8749 | 16682 | 14433 | 12986 | 7761 | 12475 | 15833 | 15505 | 8725 |
| | 627 | 20270 | 7644 | 15253 | 15959 | 13593 | 13483 | 12343 | 18196 | 3966 | 1640 | 20730 |
| | 3351 | 10803 | 1315 | 1603 | 19482 | 6421 | 12053 | 1137 | 8850 | 12068 | 12197 | 8734 |
| | 19465 | 2535 | 2409 | 22297 | 7627 | 19726 | 1553 | 13474 | 15450 | 3620 | 5719 | 11963 |
| | 3815 | 19768 | 758 | 13039 | 16269 | 11639 | 7621 | 5670 | 7361 | 8209 | 17309 | 14298 |
| | 22309 | 19799 | 6584 | 3893 | 10041 | 3814 | 2858 | 7122 | 20012 | 8232 | 12230 | 820 |
| | 11268 | 7920 | 3024 | 942 | 16980 | 14141 | 2812 | 19328 | 19907 | 16962 | 16151 | 12559 |
| | 3658 | 994 | 16669 | 2146 | 14691 | 14451 | 2080 | 3146 | 18837 | 7883 | 935 | 4402 |
| | 21465 | 15552 | 7472 | 6823 | 18275 | 16984 | 17026 | 7620 | 5223 | 8813 | 21417 | 1708 |
| | 22055 | 15118 | 13508 | 19764 | 22214 | 16335 | 1874 | 6227 | 19122 | 5567 | 20812 | 16276 |
| | 19961 | 11837 | 11145 | 14544 | 15166 | 9889 | 16056 | 20845 | 14946 | 6840 | 72213 | 349 |
| | 14215 | 14913 | 12175 | 2181 | 19628 | 13753 | 5595 | 13445 | 8711 | | | |
| 452: | 21725 | 4108 | 17790 | 10816 | 10072 | 11215 | 7845 | 21938 | 14000 | 12290 | 9072 | 2188 |
| | 13197 | | | | | | | | | | | |
| 453: | 17069 | 19235 | 13531 | 17697 | 11206 | 10541 | 21126 | 13101 | 21378 | 21802 | 1329 | 11808 |
| | 2880 | 22230 | 1218 | 9626 | 19047 | 3040 | 17741 | 3001 | 15767 | 17052 | 3724 | 7152 |
| | 16952 | 20547 | 5794 | 17379 | 9932 | 18642 | 18433 | 2347 | 8182 | 3667 | 10010 | 9258 |
| | 4330 | 16872 | 13931 | 10125 | 15345 | 15750 | 14295 | 6095 | 14904 | 11788 | 22535 | 2662 |
| | 5270 | 2833 | 2917 | 19197 | 11031 | 8241 | 18241 | 12357 | 932 | 9546 | 3545 | 5011 |
| | 5922 | 15762 | 21458 | 11169 | 19093 | 2950 | 4496 | 8786 | 17325 | 12345 | 8819 | 14838 |
| | 11101 | 7574 | 21973 | 11052 | 5177 | 10577 | 9162 | 18537 | 19268 | 11571 | 9690 | 8586 |
| | 17826 | 10897 | 21454 | 12803 | 2767 | 20158 | 11415 | 6066 | 16018 | 13857 | 10790 | 8706 |
| | 12567 | 13232 | 21790 | 2221 | 16327 | 22364 | 9930 | 11940 | 14381 | 12027 | 5625 | 20421 |
| | 6213 | 18883 | 15885 | 991 | 14231 | 1117 | 8576 | 18603 | 5865 | 1558 | 1668 | 7347 |
| | 20793 | 5291 | 16647 | 5611 | | | | | | | | |
| 454: | 10637 | 22601 | 3315 | 5883 | 11574 | 14796 | 9991 | 4552 | 7533 | 6653 | 8525 | 1420 |
| | 15386 | 21880 | 6261 | 12607 | 8500 | 22030 | 1956 | | | | | |
| 455: | 7653 | 1606 | 10840 | 3715 | 10418 | 14035 | 4843 | 2101 | 19615 | 10922 | 3554 | 1735 |
| | 3155 | 13503 | 6907 | 7784 | 20054 | 21733 | 1169 | 1452 | 5818 | 22385 | | |
| 456: | 0 | | | | | | | | | | | |
| 457: | 3034 | 22132 | 9120 | 13729 | 6791 | 11897 | 5149 | 22382 | 7782 | 1951 | | |
| 458: | 21696 | 15323 | 6711 | 794 | 10202 | 21441 | 6649 | 17320 | 15012 | 6988 | 16064 | 7702 |
| | 2108 | 7337 | 13972 | 18351 | 2384 | 18596 | 11446 | 5769 | 20712 | 818 | 9873 | 11398 |
| | 20352 | 19777 | 18363 | 16843 | 5030 | 6560 | 11056 | 12761 | 9908 | 4279 | 12906 | 8596 |
| | 16833 | 6392 | 2335 | 20071 | 16868 | 4580 | 21828 | 17448 | 14949 | 21452 | 5673 | 10050 |
| | 5093 | 22411 | 1705 | 11285 | 10329 | 5612 | | | | | | |

TABLE 17-continued

Sequence IDs for homolog proteins

| Seq ID NO: | homolog Seq ID NOs | | | | | | | | | | |
|---|---|---|---|---|---|---|---|---|---|---|---|
| 459: | 655 | 11975 | 8069 | 20491 | 17684 | 1394 | 19340 | 17701 | 5908 | 684 | 14348 | 21852 |
| | 5434 | 14730 | 2715 | 13227 | 21854 | 8282 | 16106 | 10308 | 21982 | 7567 | 4049 | 15967 |
| | 16174 | 14809 | 13372 | 20868 | 798 | 20016 | 19024 | 1342 | 3575 | 14227 | | |
| 460: | 19142 | 17102 | 15893 | 22335 | 12299 | 15442 | 11496 | 10074 | 5733 | 14018 | 4497 | 12860 |
| | 17771 | 17375 | 8161 | 11868 | 317 | 11262 | 6451 | 9249 | 12173 | 13520 | 2381 | 4681 |
| | 6996 | 6490 | 9579 | 1276 | 5404 | 8032 | 6363 | 10026 | 7316 | 14084 | 8908 | 17837 |
| | 8863 | 19169 | 750 | 18053 | 13467 | 9093 | 12920 | 8746 | 301 | 4625 | 12849 | 8975 |
| | 1460 | 8614 | 20285 | 11049 | 15351 | 15199 | 22494 | 14045 | 10173 | 6414 | 13682 | 21841 |
| | 1623 | 17211 | 18365 | 4519 | 21203 | 2011 | 22000 | 10060 | 950 | 10516 | 18657 | 11078 |
| | 6908 | 20626 | 18762 | 9992 | 11321 | 16068 | 13071 | 20575 | 9335 | 10629 | 4241 | 17420 |
| | 13570 | 10156 | 14609 | 12058 | 7665 | 21534 | 18040 | 5706 | 574 | 11168 | 21837 | 3354 |
| | 20317 | 6124 | 1526 | 12392 | 16093 | 22474 | 21550 | 2099 | 15300 | 14848 | 1309 | 13170 |
| | 19435 | 2632 | 6374 | 14407 | 14649 | 12249 | 8309 | 550 | 7797 | 3769 | 17901 | 16142 |
| | 2063 | 6092 | 19535 | 13070 | 9812 | 1776 | 3443 | 17767 | 15918 | 12414 | 2144 | 9885 |
| | 3591 | 9545 | 21263 | 14344 | 19754 | 19431 | 11670 | 6760 | 19223 | 12846 | 21920 | 21081 |
| | 22381 | 17475 | 18403 | 21905 | 12709 | 15904 | 5736 | 14499 | 13058 | 11572 | 10692 | 7183 |
| | 16133 | 15670 | 12332 | 1756 | 16939 | 22104 | 4806 | 15031 | 18332 | 20634 | 7994 | 12919 |
| | 9064 | 5045 | 14968 | 9551 | 2414 | 1646 | 4753 | 1805 | 18175 | 18991 | 9750 | 1618 |
| | 17712 | 22081 | 22029 | 14969 | 2458 | 1011 | 14504 | 3779 | 21507 | 6619 | 4824 | 5015 |
| | 20098 | 2353 | 13906 | 16938 | 1847 | 13819 | 11957 | 12498 | 17391 | 1983 | 2927 | 13991 |
| | 20531 | 20599 | 1625 | 606 | 8646 | 7497 | 11561 | 11796 | 8562 | 3676 | 16567 | 11565 |
| | 15599 | 13705 | 12415 | 13948 | 1711 | 2922 | 7520 | 21985 | 563 | 3562 | 1939 | 5754 |
| | 19800 | 6341 | 9042 | 15748 | 16577 | 12974 | 4827 | 4371 | 1092 | 14881 | 16895 | 20528 |
| | 1513 | 6790 | 19711 | 13821 | 5656 | 6520 | 2463 | 9526 | 17821 | 1888 | 18587 | 10549 |
| | 18855 | 4858 | 7028 | 14908 | 22205 | 5964 | 4933 | 4340 | 5271 | 927 | 8374 | 3316 |
| | 20014 | 21527 | 5008 | 9914 | 10822 | 13989 | 15266 | 13163 | 17347 | 7197 | 21212 | 6338 |
| | 1401 | 3445 | 561 | 14444 | 20426 | 12281 | 9349 | 20565 | 7453 | 19524 | 4093 | 17235 |
| | 8735 | 14800 | 9217 | 16762 | 10080 | 19195 | 11057 | 11977 | 8958 | 21372 | 19693 | 20196 |
| | 6610 | 14503 | 22133 | 19181 | | | | | | | | |
| 461: | 21226 | 10722 | 9090 | 9917 | 17608 | 3307 | 17248 | 19659 | 12888 | 16315 | 15869 | 13541 |
| | 11628 | 14989 | 5547 | 13844 | 21236 | 9910 | 11202 | 10862 | 3786 | 7783 | 20043 | 16159 |
| | 21123 | 21149 | 1353 | 5976 | 20875 | 12245 | 2040 | 1496 | 18804 | 8260 | 2945 | 3653 |
| | 21684 | 4427 | 20639 | 22232 | 20700 | 626 | 868 | 17999 | 20858 | 2479 | 14206 | 10988 |
| | 22292 | 12471 | 7299 | 12462 | 21503 | 15092 | 2732 | 4462 | 16160 | 13957 | 17698 | 19014 |
| 462: | 10915 | 15022 | 4450 | 11366 | 20814 | 8548 | 7447 | 2554 | 10246 | 14947 | 16967 | 18188 |
| | 8578 | 3396 | 12439 | 21412 | 21085 | 10559 | 15980 | 13299 | 6199 | 5121 | 3610 | 8985 |
| | 5265 | 4663 | 6420 | 19456 | 9646 | 7090 | 9324 | 14666 | 21020 | 13611 | 3580 | 3309 |
| | 3503 | 10431 | 15493 | 1658 | 4414 | 10484 | 19347 | 18475 | 3196 | 10873 | 7062 | 5347 |
| | 14932 | 697 | 8959 | 9970 | 13746 | 17123 | 19066 | 3791 | 6974 | 21237 | 4075 | 21728 |
| | 13369 | 5804 | 15214 | 3905 | 7104 | 15534 | 15425 | 15645 | 14841 | 13863 | 17523 | 14583 |
| | 13266 | 16008 | 19678 | 809 | 17661 | | | | | | | |
| 463: | 15610 | 19505 | 3188 | 13558 | 22207 | 789 | 18180 | 4508 | 22145 | 6608 | 12144 | 14753 |
| | 3301 | 17632 | 6183 | 18032 | 8172 | 21197 | 9377 | 13065 | 15119 | 10305 | 14673 | 12954 |
| | 12468 | 8469 | | | | | | | | | | |
| 464: | 7246 | 2525 | 8937 | 1249 | 20791 | 2442 | 13757 | 2102 | 8484 | 20391 | 22436 | 8284 |
| | 6769 | 10971 | 8004 | 22023 | 4837 | 6659 | 8039 | 542 | 11456 | 2562 | 13478 | 12526 |
| | 20405 | 19784 | 19698 | 17561 | 14237 | 21200 | 20356 | 7320 | 10248 | 1737 | 18419 | 11847 |
| | 10624 | 18917 | 21915 | 21121 | 18416 | 17053 | 8529 | 2009 | 1335 | 2989 | 17827 | 5789 |
| | 7577 | 14095 | 21524 | 13803 | 19598 | 11276 | 12421 | 21337 | 2916 | 21144 | 20276 | 15766 |
| | 10716 | 15947 | 19883 | 13961 | 9267 | 13637 | 16960 | 15005 | 18795 | 2343 | 10609 | 15000 |
| | 4509 | 3285 | 1871 | 22443 | 9056 | 14293 | 11451 | 17137 | 11684 | 5432 | 21943 | 5119 |
| | 17025 | 20216 | 6625 | 22445 | 4609 | 21217 | 19722 | 18262 | 17059 | 19393 | 8393 | 18989 |
| | 14155 | 18379 | 19003 | 4754 | 6752 | 7557 | 21304 | 14324 | 2929 | 15268 | 11094 | 6025 |
| | 8713 | 14222 | 2187 | 1975 | 2856 | 8286 | 16534 | 8056 | 9369 | 15871 | 22373 | 5414 |
| | 5457 | 8512 | 14839 | 13626 | 13511 | 18521 | 18560 | 2002 | 4104 | 11038 | 15162 | 19653 |
| | 9129 | | | | | | | | | | | |
| 465: | 6459 | 6394 | 20221 | 2332 | 21782 | 13055 | 10580 | 2279 | 21367 | 19818 | 15567 | 13294 |
| | 11815 | 16237 | 17819 | 16570 | 1622 | 15858 | 19159 | 18654 | 9082 | 10360 | 8884 | |
| 466: | 17835 | 13628 | 20663 | | | | | | | | | |
| 467: | 20037 | 7346 | 1314 | 12511 | 16115 | 17491 | 18854 | 2329 | | | | |
| 468: | 17297 | 12034 | 9186 | 19531 | 5960 | 3320 | 6107 | 989 | 17365 | 1448 | 5740 | 10535 |
| | 13789 | 18153 | 3130 | 2668 | 16090 | 6274 | 11423 | 19113 | 19718 | | | |
| 469: | 8693 | 16592 | 5005 | 19306 | 6604 | 16732 | 9754 | 13116 | 8230 | 21139 | 4079 | 5166 |
| | 18517 | 6465 | 2795 | 16685 | 16688 | 21959 | 6043 | 13767 | 6173 | 22310 | 3259 | 13685 |
| | 20252 | 7455 | 5044 | 3534 | 9389 | 10900 | 11649 | 8773 | 10993 | 11006 | 9330 | 11087 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 5753 | 19387 | 21478 | 15236 | 21689 | 1435 | 21991 | 913 | 7484 | 14285 | 18519 | 20798 |
| | 16122 | 2721 | 770 | 15723 | 20967 | 12158 | 21702 | 18984 | 12751 | 12455 | 5999 | 11116 |
| | 11824 | 9843 | 12418 | 7936 | 7869 | 5363 | 4568 | 3972 | 16205 | 22566 | 18031 | 20763 |
| | 17285 | 18882 | 7781 | 5471 | 19353 | 4312 | 4716 | 18663 | 9603 | 15043 | 11217 | 14246 |
| | 16326 | 9289 | 1155 | 13216 | 13122 | 13400 | 3648 | 8238 | 13201 | 897 | 19164 | 9520 |
| | 12035 | 8212 | 12560 | 22169 | 3281 | 12562 | 11339 | 17667 | 12309 | 8806 | 22280 | 18666 |
| | 22125 | 9307 | 6640 | 20092 | 2145 | 19241 | 15914 | 1213 | 13453 | 5332 | 6133 | 21968 |
| | 9060 | 20524 | 10171 | 20916 | 20091 | 19282 | 10648 | 21566 | 4242 | 19533 | 11739 | 14917 |
| | 21058 | 17627 | 7451 | 13855 | 20246 | 872 | 19965 | 10868 | 11173 | 2843 | 8856 | 6802 |
| | 6353 | 5160 | 6251 | 13175 | 12961 | 12248 | 21646 | 18733 | 1820 | 15077 | 6061 | 2722 |
| | 19163 | 13367 | 10128 | 22117 | 17264 | 16640 | 22485 | 19560 | 8034 | 1100 | 17788 | 13010 |
| | 7758 | 19682 | 1515 | 12783 | 21145 | 7575 | 3152 | 16168 | 2508 | 13380 | 8293 | 1473 |
| | 9684 | 17719 | 8565 | 4032 | 17866 | 18951 | 14592 | 14121 | 19857 | 5090 | 19600 | 22439 |
| | 21996 | 16150 | 952 | 14805 | 7722 | 18382 | 14204 | 12365 | 18343 | 18356 | 17329 | 19831 |
| | 6021 | 4198 | 17799 | 3839 | 721 | 9477 | 11433 | 18772 | 8387 | 1287 | 8906 | 17051 |
| | 17649 | 19824 | 20739 | 20085 | 3542 | 5975 | 20850 | 9850 | 9401 | 8873 | 15065 | 7512 |
| | 19446 | 6993 | 10543 | 8853 | 18552 | 12124 | 18137 | 16070 | 1895 | 21102 | 9226 | 7191 |
| | 4365 | 12533 | 4665 | 5929 | 15384 | 20652 | 15768 | 3859 | | | | |
| 470: | 4094 | 4249 | 6447 | 417 | 9699 | 4266 | 21799 | 19998 | 8507 | 4118 | 4930 | 21755 |
| | 7422 | 16272 | | | | | | | | | | |
| 471: | 5778 | 13042 | 20693 | 6337 | 16080 | 1704 | 20548 | 2346 | 20737 | 5152 | 6633 | 17650 |
| | 2524 | 19716 | 3465 | 3548 | 16517 | 9459 | 12501 | 10090 | 1759 | 3273 | 12472 | 21412 |
| | 14456 | 8135 | 18797 | 3137 | 17061 | 3402 | 9770 | 1269 | 2404 | 4759 | 7648 | 8568 |
| | 8662 | 21076 | 11318 | 18004 | 13312 | 14804 | 6000 | 10393 | 14666 | 21987 | 3309 | 18931 |
| | 14379 | 6524 | 14185 | 6945 | 8382 | 7629 | 16509 | 1933 | 4728 | 21025 | 17218 | 17638 |
| | 1752 | 16078 | 3430 | 16885 | 19841 | 13228 | 577 | 3035 | 15647 | 12625 | 14586 | 21237 |
| | 4075 | 7439 | 13720 | 15834 | 12529 | 21705 | 3905 | 17339 | 10133 | 5868 | 20567 | 18269 |
| | 22275 | 13814 | 5994 | 10239 | 18618 | 20112 | 19325 | 13266 | 2962 | 2905 | 3571 | |
| 472: | 1296 | 2585 | 13077 | 15698 | 8567 | 10322 | 16480 | 13708 | 15389 | 17974 | 17451 | 15792 |
| | 19280 | 10142 | 3469 | 11718 | 8642 | 15847 | 3638 | 2801 | 9326 | 3742 | 10221 | 13816 |
| | 4884 | 3280 | 9923 | 15873 | 20214 | 10492 | 13528 | 8475 | 3713 | 15933 | 21666 | 11740 |
| | 1633 | 11990 | 9134 | 17965 | 1788 | 6764 | 20492 | 17131 | 19212 | 13533 | 16793 | 11371 |
| | 8594 | 20347 | 3728 | 17461 | 13823 | 8134 | 22260 | 7419 | 19185 | 22026 | 3272 | 1884 |
| | 8730 | 8990 | 19977 | 1859 | 10999 | 4586 | 16348 | 19281 | 19991 | 11567 | 1008 | 20028 |
| | 7658 | 20830 | 19756 | 20878 | 3207 | 20070 | 2980 | 18632 | 2087 | 6612 | 5122 | 7489 |
| | 19025 | 20408 | 5867 | 8896 | 19056 | 19348 | 18818 | 3699 | 779 | 22456 | 11541 | 15161 |
| | 11135 | 20058 | 2201 | 6739 | 16612 | 14992 | 19392 | 15341 | 8872 | 4204 | 21922 | 22540 |
| | 19457 | 14075 | 4186 | 15353 | 17073 | 5661 | 13025 | 14487 | 6849 | 20671 | 6103 | 10343 |
| | 4142 | 17366 | 14159 | 18164 | 2380 | 8153 | 15839 | 19958 | 6670 | 2506 | 8947 | 15249 |
| | 9712 | 1377 | 18798 | 8620 | 19625 | 10515 | 9429 | 5493 | 7939 | 18930 | 8714 | 19761 |
| | 3572 | 20073 | 19642 | 9602 | 11161 | 7180 | 10987 | 2971 | 8438 | 4675 | 8709 | 2938 |
| | 4636 | 3485 | 9435 | 18162 | 15411 | 20078 | 14563 | 15262 | 14349 | 19829 | 9555 | 8928 |
| | 16342 | 19361 | 1362 | 12060 | 11259 | 1940 | 18358 | 7454 | 21475 | 16972 | 20517 | 14458 |
| | 5311 | 4246 | 3026 | 9206 | 21394 | 17932 | 5647 | 18756 | 632 | 3100 | 13204 | 18856 |
| | 14390 | 13351 | 12707 | 15711 | 10265 | 18751 | 14958 | 5221 | 17138 | 17198 | 808 | 10940 |
| | 11642 | 19473 | 3009 | 13298 | 15678 | 3551 | 14990 | 9133 | 19864 | 6205 | 1024 | 9670 |
| | 22172 | 21447 | 19672 | 2996 | 6377 | 6123 | 21676 | 2672 | 19700 | 21984 | 15674 | 9974 |
| | 14920 | 2725 | 11780 | 7537 | 15508 | 9998 | 18115 | 3670 | 16824 | 20178 | 4972 | 18635 |
| | 8472 | 13466 | 21265 | 2831 | 8951 | 14511 | 7701 | 18486 | 7554 | 17622 | 11381 | 6309 |
| | 22198 | 20143 | 15854 | 21658 | 12398 | 12681 | 11609 | 16625 | 12161 | 6162 | 3022 | 5109 |
| | 7314 | 14439 | 8366 | 13945 | 12198 | 11746 | 13801 | 5301 | 15197 | 3210 | 11365 | 15206 |
| | 17546 | 19669 | 2720 | 10926 | 1742 | 6963 | 11828 | 6972 | 1267 | 14550 | 8450 | 11591 |
| | 19644 | 11212 | 14447 | 15125 | 18385 | 14497 | 17159 | 5903 | 832 | 17245 | 7432 | 3663 |
| | 3061 | 9406 | 7511 | 4860 | 10188 | 13056 | 4196 | 11132 | 3684 | 3623 | 8675 | 8119 |
| | 10193 | 16296 | 17100 | 11852 | 16004 | 17566 | 10552 | | | | | |
| 473: | 2421 | 20836 | 18507 | 17807 | 18922 | 14668 | 9172 | 2056 | 648 | 16255 | 7978 | 2322 |
| | 11200 | | | | | | | | | | | |
| 474: | 17916 | 15231 | 15741 | 4645 | 21977 | 15829 | 10291 | 21573 | 1806 | 2663 | 8036 | 9618 |
| | 16693 | 3960 | 15864 | 14578 | 17125 | 15924 | 21826 | 13440 | 17249 | 8650 | 20159 | 15742 |
| | 1986 | 19706 | 22092 | 8766 | 6813 | 17830 | 10853 | 21281 | 13394 | 5285 | 8139 | 21004 |
| | 14220 | 17563 | 2086 | 2488 | 1597 | 4698 | 13233 | 4654 | 1250 | 15737 | 2907 | 1469 |
| | 9957 | 13288 | 6516 | 22526 | 16496 | 14873 | 10471 | 18290 | 3086 | 11953 | 18592 | 3185 |
| | 9418 | 17135 | 8081 | 9593 | 19180 | 4673 | 7979 | 1300 | 13933 | 16544 | 16782 | 15551 |
| | 8460 | 15960 | 13997 | 3405 | 1566 | 21046 | 8636 | 17134 | 6596 | 6512 | 13346 | 15639 |
| | 21591 | 15042 | 12093 | 14396 | 9252 | 18637 | 22523 | 6953 | 16784 | 6262 | 16933 | 22448 |
| | 4612 | 19863 | 6076 | 19303 | 12192 | 16828 | 17089 | 4133 | 19601 | 6118 | 3344 | 15088 |
| | 14986 | 21070 | 2153 | 771 | 3291 | 10644 | 20638 | 4377 | 21183 | 9519 | 21234 | 11970 |
| | 21215 | 18173 | 18301 | 17764 | 13810 | 10948 | 3781 | 21029 | 11162 | 16613 | 18091 | 22003 |
| | 3801 | 21866 | 22213 | 6526 | 5846 | 20765 | 21771 | 14860 | 5007 | 861 | 6743 | 5529 |
| | 14267 | 14880 | 21391 | 10210 | 5693 | 5970 | 3793 | 15855 | 1007 | 13001 | 6878 | 9875 |
| | 16912 | 19329 | 13614 | 10333 | 13714 | 8204 | 21112 | 6903 | 1133 | 21262 | 21547 | 15703 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 21338 | 6248 | 15242 | 13567 | 16788 | 11020 | 18655 | 19496 | 10528 | 22414 | 8142 | 17440 |
| | 20388 | 7760 | 17480 | 18357 | 14595 | 12914 | 2829 | 16249 | 2569 | 7096 | 6689 | 12534 |
| | 6105 | 16041 | 9145 | 9242 | 1552 | 1379 | 10313 | 9596 | 10872 | 11771 | 3268 | 15445 |
| | 593 | 5820 | 18410 | 6984 | 14744 | 9713 | 10053 | 1383 | 8837 | 676 | 4305 | 10421 |
| | 2944 | 20363 | 19120 | 7463 | 16753 | 20969 | 18430 | 10227 | 12905 | 11066 | 6057 | 13677 |
| | 18640 | 4083 | 1527 | 285 | 19285 | 5385 | 17557 | 20851 | 15693 | 17304 | 1683 | 14391 |
| | 15965 | 19854 | 8425 | 14916 | | | | | | | | |
| 475: | 17494 | 14507 | 18062 | 7991 | 15677 | 2025 | 16965 | 15154 | 22007 | 1299 | 4864 | 1869 |
| | 18259 | 5076 | 18894 | 10621 | 1194 | 21241 | 4280 | 3561 | 13154 | 8656 | 12338 | 18120 |
| | 3266 | 19426 | 6888 | 17781 | 1697 | 1251 | 15687 | 7276 | 7126 | 4960 | 7248 | 3598 |
| | 8316 | 21056 | 7036 | 15143 | 13926 | 18581 | 16569 | 4999 | 20923 | 5501 | 4338 | 10604 |
| | 10287 | 9635 | 11127 | 8702 | 12055 | 20545 | 19675 | 16542 | 11075 | 17224 | 15872 | 11732 |
| | 6843 | 1680 | 5509 | 10865 | 16067 | 3406 | 18908 | 8719 | 4022 | 6395 | 4623 | 22346 |
| | 12095 | 17333 | 5395 | 17305 | 10611 | 7631 | 18432 | 21902 | 7759 | 3032 | 10224 | 17508 |
| | 1337 | 3062 | 10847 | 4797 | 20901 | 3679 | 21087 | 9348 | 17993 | 3743 | 10092 | 14394 |
| | 9088 | 16620 | 9528 | 17353 | 12317 | 17070 | 22147 | 22431 | 10652 | 9220 | 12697 | 20558 |
| | 11610 | 11793 | 17146 | 2355 | 4084 | 3480 | 10028 | 2838 | 20595 | 20642 | 8186 | 16379 |
| | 10383 | 4591 | 4288 | 8591 | 15333 | 9201 | 15765 | 5294 | 3608 | 4038 | 2297 | 7144 |
| | 1916 | 16736 | 3319 | 11341 | 10440 | 4734 | 20772 | 4271 | 19954 | 7624 | 2955 | 17939 |
| | 21353 | 11932 | 19797 | 2289 | 9733 | 10875 | 12426 | 18048 | 20434 | 18464 | 630 | 8403 |
| | 6184 | 18819 | 5523 | 17228 | 16302 | 10762 | 9202 | 16022 | 17350 | 11159 | 4597 | 17792 |
| | 15612 | 4183 | 5466 | 17341 | 10729 | 21044 | 9980 | 4892 | 1108 | 1406 | 18198 | 1264 |
| | 712 | 13091 | 8047 | 14712 | 22157 | 7745 | 6934 | 7635 | | | | |
| 476: | 3284 | 22524 | 15910 | 13589 | 1006 | 11575 | 20349 | 10911 | 18523 | 22545 | 13067 | 2372 |
| | 10217 | 9609 | 535 | 306 | 507 | 533 | 5233 | 478 | 4966 | 9015 | 21390 | 314 |
| | 1764 | 12941 | 18461 | 9866 | 21665 | 7323 | 5049 | 9997 | 7294 | 5240 | 7571 | 6367 |
| | 19001 | 13429 | 2814 | 21443 | 20459 | 1880 | 1396 | 3615 | 13867 | 7787 | 22538 | 13411 |
| | 13344 | 8482 | 1205 | 18398 | 13083 | 12473 | 14941 | 17485 | 1550 | 757 | 11281 | 11029 |
| | 21967 | 827 | 1873 | 21174 | 14091 | 5281 | 885 | 7332 | 8229 | 10933 | 12672 | 21103 |
| | 4400 | 1012 | 15883 | 7812 | 7121 | 22179 | 16424 | 1339 | 1866 | 3474 | 11617 | 19918 |
| | 16996 | 14296 | 1352 | 17699 | 9135 | 12367 | 19265 | 15111 | 3388 | 20896 | 20167 | 6697 |
| | 6564 | 10047 | 19989 | 9358 | 22350 | 21749 | 15375 | 4618 | 531 | 16283 | 300 | 534 |
| | 286 | 6575 | 7081 | 11468 | 2641 | 13543 | 15224 | 3097 | 15540 | 19380 | 19031 | 14287 |
| | 6260 | 5051 | 12104 | 13901 | 11086 | 12459 | 12824 | 919 | 13271 | 15196 | 6303 | 4194 |
| | 14638 | 1182 | 15803 | 1842 | 19299 | 7287 | 2857 | 17664 | 21589 | 11961 | 19154 | 12506 |
| | 21814 | 4986 | 5343 | 21106 | 6334 | 21437 | 20936 | 11195 | 21506 | 2582 | 22069 | 5476 |
| | 3533 | 7949 | 19583 | 22113 | 4677 | 18511 | 4730 | 696 | 9569 | 17797 | 18687 | 7097 |
| | 20259 | 15252 | 13221 | 13305 | 450 | 22502 | 14915 | 21157 | 19855 | 11089 | 1744 | 10324 |
| | 19917 | 6730 | 2195 | 20371 | 3563 | 12591 | 16308 | 7626 | 4212 | 19798 | 19458 | 5691 |
| | 18292 | 8005 | 20912 | 21422 | 6721 | 10358 | 13601 | 6637 | 1272 | 17775 | 16130 | 21296 |
| | 2832 | 830 | 14553 | 6434 | 18295 | 17956 | 829 | 12043 | 2457 | 5731 | 4395 | 10908 |
| | 3209 | 13959 | 12384 | 5220 | 21843 | 19341 | 16539 | 19751 | 20779 | 1281 | 13763 | 17745 |
| | 16586 | 7955 | 12705 | 15449 | 988 | 20859 | 1768 | 11129 | 6547 | 22518 | 5552 | 9854 |
| | 11376 | 6669 | 5359 | 9132 | 10964 | 14922 | 1879 | 22087 | 13137 | 17298 | 3333 | 13752 |
| | 20301 | 19370 | 2425 | 14659 | 6946 | 19538 | 14273 | 15340 | 6427 | 17165 | 15603 | 7257 |
| | 12419 | 10809 | 8003 | 13658 | 14064 | 4221 | 7387 | 13284 | 20981 | 2316 | 3116 | 8418 |
| | 3386 | 6508 | 18217 | 3578 | 22249 | 992 | 13442 | 3471 | 14855 | 19949 | 5277 | 19885 |
| | 2816 | 10917 | 9436 | 18538 | 18659 | 12816 | 12308 | 15943 | 2515 | 20364 | 14701 | 8193 |
| | 17579 | 22076 | 8890 | 2649 | 9329 | 21073 | 8376 | 15177 | 10882 | 859 | 5990 | 9814 |
| | 16053 | 5209 | 7718 | 3144 | 13848 | 22428 | 19076 | 5454 | 17056 | 14918 | 4088 | 11270 |
| | 5837 | 9604 | 22455 | 19840 | 12234 | 1149 | 801 | 953 | 9960 | 21301 | 1656 | 3755 |
| | 12278 | 22119 | 13793 | 21098 | 1005 | 10264 | 13037 | 11702 | 20954 | 5581 | 5063 | 1118 |
| | 6454 | 20632 | 1696 | 6301 | 9792 | 5396 | 19474 | 14911 | 20315 | 9381 | 4111 | 11600 |
| | 7691 | 13374 | 2932 | 3071 | 18551 | 22362 | 1431 | 8710 | 12923 | 6509 | 19229 | 14012 |
| | 5372 | 12362 | 17380 | 14108 | 20272 | 16391 | 19694 | 13395 | 5132 | 901 | 14568 | 17630 |
| | 2371 | 4694 | 12396 | 15369 | 13051 | 16597 | 3697 | 10741 | 16309 | 4927 | 13396 | 21621 |
| | 8841 | 16662 | 11120 | 14081 | 21259 | 19449 | 8692 | 9484 | 15204 | 6565 | 18317 | 14304 |
| | 2769 | 14320 | 2978 | 9294 | 7482 | 9493 | 1277 | 4952 | 7813 | 7306 | 12296 | 21386 |
| | 12021 | 6645 | 16505 | 9286 | 22489 | 3622 | 13745 | 16653 | 19069 | 7780 | 15219 | 16969 |
| | 14762 | 10802 | 10479 | 16663 | 3678 | 16713 | 7751 | 13703 | 3630 | 4691 | 9472 | 10709 |
| | 8542 | 7060 | 6112 | 22457 | 21974 | 20476 | 7333 | 6482 | 14526 | 7151 | 2644 | 835 |
| | 10655 | 12264 | 9315 | 2786 | 16253 | 9488 | 5634 | 17372 | 3836 | 18362 | 11559 | 7637 |
| | 4946 | 18143 | 12059 | 6995 | 17942 | 3772 | 3625 | 788 | 20809 | 16318 | 18862 | 7143 |
| | 13134 | 9280 | 22095 | 18903 | 3706 | 15256 | 18593 | 5764 | 11115 | 12583 | 11568 | 13613 |
| | 2331 | 5136 | 8073 | 15998 | 5630 | 11304 | 19137 | 5817 | 5580 | 18341 | 8588 | 12540 |
| | 2454 | 4970 | 17445 | 2401 | 11869 | 6193 | 2434 | 3951 | 10889 | 5190 | 13207 | 16465 |
| | 5825 | 17346 | 3323 | 13177 | 5354 | 2210 | 9333 | 13864 | 21502 | 19147 | 15973 | 9673 |
| | 11863 | 9771 | 9608 | 11716 | 16811 | 18575 | 9584 | 12794 | 21399 | 20485 | 9218 | 18691 |
| | 3350 | 18263 | 4846 | 544 | 19667 | 9933 | 4140 | 1318 | 20418 | 11128 | 20105 | 16734 |
| | 2376 | 15699 | 7061 | 4232 | 15357 | 14036 | 5339 | 7107 | 19030 | 7165 | 21370 | 12103 |
| | 4848 | 13211 | 22530 | 15360 | 12863 | 9975 | 6398 | 14067 | 16683 | 21170 | 1924 | 890 |
| | 8155 | 15866 | 10131 | 7187 | 4332 | 1235 | 20330 | 12927 | 7088 | 5099 | 2302 | 12424 |
| | 8303 | 17466 | 14322 | 11383 | 2282 | 15956 | 3414 | 12982 | 18548 | 15665 | 10961 | 21084 |
| | 10824 | 18440 | 16819 | 3730 | 13940 | 18821 | 14864 | 1818 | 19607 | 7969 | 6546 | 16771 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 5441 | 8459 | 18266 | 5000 | 15749 | 13014 | 14274 | 8444 | 4707 | 13097 | 15930 | 11872 |
| | 2621 | 7158 | 6942 | 18502 | 5408 | 10837 | 21928 | 13800 | 5188 | 19614 | 16117 | 4719 |
| | 1833 | 13499 | 3107 | 21492 | 12503 | 21929 | 7921 | 1429 | 14398 | 22189 | 6439 | 12993 |
| | 12307 | 19714 | 6650 | 21398 | 18994 | 747 | 5932 | 18630 | 6683 | 1921 | 15651 | 5594 |
| | 6958 | 13597 | 19763 | 10097 | 14124 | 14687 | 1094 | 5780 | 7770 | 7688 | 15110 | 5797 |
| | 7907 | 21169 | 3329 | 12627 | 4065 | 19882 | 22067 | 19211 | 2061 | 7038 | 8909 | 16914 |
| | 13129 | 19881 | 16317 | 1551 | 13235 | 14888 | 1201 | 20264 | 7800 | 7526 | 2209 | 7384 |
| | 5887 | 10798 | 15317 | 10223 | 11351 | 10105 | 10661 | 15014 | 2908 | 16412 | 22277 | 19851 |
| | 12003 | 19616 | 11003 | 7768 | 6166 | 4620 | 8674 | 20541 | 3458 | 1240 | 15787 | 20099 |
| | 9282 | 11480 | 4994 | 19545 | 802 | 17144 | 13420 | 13439 | 14301 | 1357 | 14011 | 7026 |
| | 1145 | 6281 | 5258 | 6013 | 2805 | 18662 | 7992 | 9661 | 19875 | 11156 | 3619 | 14086 |
| | 20948 | 16946 | 3456 | 6143 | 786 | 6709 | 5954 | 17926 | 20839 | 22351 | 21072 | 13277 |
| | 15307 | 11701 | 15113 | 22057 | 6368 | 7704 | 18694 | 3644 | 12154 | 3794 | 21257 | 21638 |
| | 18386 | 18111 | 21498 | 10731 | 13776 | 5539 | 14530 | 20282 | 7762 | 9529 | 17675 | 15191 |
| | 12380 | 14865 | 15825 | 2818 | 5956 | 16442 | 6255 | 5901 | 8220 | 6918 | 18578 | 17465 |
| | 13297 | 2495 | 21913 | 4526 | 16085 | 10965 | 15558 | 22565 | 22251 | 810 | 14127 | 7570 |
| | 2692 | 13168 | 10912 | 15666 | 20574 | 4894 | 2526 | 10115 | 18982 | 19796 | 4020 | 2984 |
| | 11522 | 11245 | 21570 | 8695 | 427 | 16749 | 17392 | 7325 | 10184 | 2132 | 20312 | 4655 |
| | 16568 | 21093 | 13882 | 5730 | 7976 | 7079 | 13035 | 2800 | 16658 | 18348 | 16408 | 4157 |
| | 5264 | 8112 | 509 | 307 | 305 | 12545 | 2037 | 11704 | 9571 | 21379 | 3712 | 7685 |
| | 4483 | 18456 | 22341 | 3397 | 11197 | 13107 | 675 | 16006 | 532 | 20604 | 18536 | |
| 477: | 14477 | 7991 | 15716 | 18037 | 2783 | 11158 | 22007 | 11719 | 9318 | 11530 | 1246 | 21214 |
| | 10621 | 8796 | 4280 | 19646 | 1037 | 3266 | 19426 | 6571 | 6888 | 17781 | 1697 | 10045 |
| | 1251 | 14694 | 7276 | 7126 | 12814 | 14355 | 17583 | 1180 | 17847 | 8316 | 20573 | 7140 |
| | 18820 | 7036 | 21056 | 15143 | 13926 | 18581 | 4999 | 20923 | 5501 | 1142 | 3253 | 7339 |
| | 4338 | 16547 | 15305 | 10287 | 11127 | 20511 | 19012 | 13060 | 4347 | 12691 | 12055 | 3704 |
| | 15743 | 19675 | 16542 | 21229 | 11524 | 9274 | 11075 | 8804 | 17224 | 3133 | 3607 | 10123 |
| | 11459 | 11620 | 2973 | 15872 | 11732 | 19109 | 740 | 1359 | 17419 | 10051 | 6843 | 1680 |
| | 16067 | 3406 | 4041 | 4022 | 9511 | 2595 | 4623 | 2369 | 19292 | 17333 | 5395 | 17305 |
| | 10611 | 1428 | 7631 | 15733 | 18432 | 1959 | 21902 | 6814 | 13183 | 20320 | 12959 | 3032 |
| | 4738 | 13205 | 22294 | 3286 | 19123 | 13158 | 20759 | 22152 | 18157 | 16447 | 10847 | 14538 |
| | 4797 | 21087 | 7452 | 19143 | 16659 | 16620 | 11651 | 17070 | 10166 | 6601 | 15463 | 22431 |
| | 10652 | 13842 | 11862 | 19136 | 1897 | 9220 | 12697 | 22065 | 20558 | 17946 | 13996 | 16162 |
| | 7667 | 10376 | 2355 | 4084 | 14756 | 8726 | 10960 | 18769 | 3480 | 2838 | 20595 | 20275 |
| | 1292 | 4853 | 20642 | 11502 | 11759 | 11992 | 9201 | 12553 | 14724 | 15765 | 17537 | 5294 |
| | 9934 | 3608 | 15894 | 19202 | 4614 | 3319 | 11943 | 7304 | 4298 | 9147 | 11434 | 11341 |
| | 10440 | 4734 | 13768 | 7695 | 7039 | 10493 | 13737 | 14607 | 16005 | 5151 | 2008 | 20772 |
| | 4271 | 19954 | 4883 | 11303 | 15488 | 5027 | 17894 | 16991 | 7608 | 5609 | 16228 | 8198 |
| | 18306 | 2556 | 6626 | 5829 | 13676 | 20616 | 12968 | 22378 | 16437 | 7624 | 20184 | 6039 |
| | 10274 | 13230 | 16495 | 10978 | 13806 | 5631 | 6912 | 2955 | 21137 | 12918 | 16985 | 16430 |
| | 8847 | 22400 | 13954 | 1905 | 19874 | 18505 | 9524 | 7297 | 20802 | 5035 | 20321 | 12454 |
| | 9019 | 13953 | 2462 | 4887 | 16352 | 1889 | 17058 | 15457 | 8559 | 7962 | 11126 | 15081 |
| | 22027 | 2791 | 7622 | 8042 | 4393 | 8437 | 1128 | 12634 | 21033 | 21247 | 5138 | 1952 |
| | 10420 | 4794 | 21353 | 11932 | 13160 | 19797 | 13358 | 2289 | 10875 | 9733 | 12426 | 14341 |
| | 7723 | 5120 | 12064 | 10942 | 15784 | 8171 | 17196 | 20434 | 21075 | 20432 | 4222 | 8716 |
| | 18464 | 12196 | 630 | 8403 | 8582 | 6184 | 18819 | 9392 | 16256 | 4056 | 17228 | 16302 |
| | 10762 | 13412 | 17350 | 12703 | 17792 | 4597 | 11159 | 7291 | 1072 | 4183 | 5466 | 17341 |
| | 4892 | 1108 | 22046 | 1630 | 17859 | 11923 | 5617 | 18198 | 20318 | 1264 | 22123 | 2225 |
| | 1997 | 13091 | 5701 | 8047 | 6109 | 22157 | 7745 | 16695 | 6934 | 1574 | 18516 | |
| 478: | 19887 | 10135 | 21002 | 14580 | 12123 | 15919 | 12579 | 5844 | 2744 | 4525 | 1601 | 15195 |
| | 13066 | 547 | 20326 | 18377 | 314 | 8202 | 4733 | 7841 | 16690 | 17977 | 2012 | 6367 |
| | 10918 | 3637 | 18964 | 16866 | 17780 | 7398 | 19262 | 8152 | 16337 | 16385 | 15522 | 10127 |
| | 11277 | 18934 | 3901 | 22130 | 7812 | 16808 | 7324 | 19680 | 2408 | 19428 | 11882 | 19522 |
| | 16434 | 9215 | 10784 | 19210 | 9199 | 9487 | 12925 | 15096 | 6578 | 16140 | 12862 | 976 |
| | 11288 | 12658 | 20505 | 12973 | 11420 | 19873 | 8358 | 17414 | 300 | 8602 | 17310 | 6259 |
| | 15328 | 15736 | 16123 | 1022 | 4666 | 6077 | 8815 | 10323 | 18236 | 1980 | 4532 | 17009 |
| | 7605 | 19668 | 1127 | 2857 | 17664 | 21589 | 11961 | 19154 | 6093 | 3017 | 11359 | 3533 |
| | 21439 | 16651 | 4677 | 18511 | 4730 | 696 | 9569 | 17797 | 18687 | 7097 | 20259 | 450 |
| | 9399 | 14915 | 21157 | 20002 | 20371 | 3563 | 12591 | 16308 | 15626 | 7639 | 2807 | 13480 |
| | 8017 | 8740 | 16746 | 716 | 21161 | 1662 | 7626 | 4212 | 19798 | 19458 | 5691 | 18292 |
| | 16130 | 21296 | 2832 | 830 | 14553 | 6434 | 18295 | 22345 | 20848 | 19451 | 4148 | 6755 |
| | 20779 | 1281 | 17745 | 16586 | 7955 | 12705 | 15449 | 988 | 20859 | 1768 | 11129 | 6547 |
| | 22518 | 5552 | 9854 | 11376 | 6669 | 5359 | 9132 | 10964 | 1879 | 22087 | 13137 | 17298 |
| | 3333 | 13752 | 20301 | 19370 | 2425 | 6946 | 14568 | 4694 | 21621 | 8841 | 16662 | 11120 |
| | 14081 | 7280 | 15204 | 6565 | 1345 | 14320 | 2978 | 9294 | 7482 | 9493 | 1277 | 7813 |
| | 7306 | 12296 | 12021 | 6645 | 9286 | 22489 | 13745 | 16653 | 19069 | 7780 | 16663 | 20476 |
| | 7333 | 6482 | 14526 | 7151 | 14429 | 6992 | 788 | 4653 | 2925 | 17755 | 9673 | 7253 |
| | 9771 | 3362 | 11716 | 21088 | 4458 | 18575 | 9584 | 12794 | 21399 | 14605 | 15265 | 10699 |
| | 6281 | 18662 | 7992 | 9661 | 19875 | 11156 | 3619 | 14086 | 20948 | 16946 | 3456 | 6143 |
| | 16455 | 786 | 6709 | 5954 | 17926 | 20839 | 22351 | 19605 | 13277 | 16667 | 9507 | 1392 |
| | 9772 | 15558 | 21992 | 22438 | 5600 | 18371 | 10363 | 19255 | 11144 | 11875 | 3318 | 21951 |
| | 4300 | 19052 | 16019 | 10566 | 17447 | 7523 | 21878 | 18982 | 5589 | 4804 | 15183 | 17109 |
| | 19009 | 17084 | 20892 | 22180 | 11635 | 13124 | 4102 | 12865 | 2079 | 3506 | 509 | 6351 |
| | 4815 | 532 | 372 | 6844 | 9299 | 5904 | 14428 | | | | | |

TABLE 17-continued

| Seq ID NO: | homolog Seq ID NOs |
|---|---|
| | Sequence IDs for homolog proteins |
| 479: | 21743 1760 3495 6194 14521 17761 15144 21403 16214 6891 10614 7713 1057 3816 17150 12489 10225 5157 8783 |
| 480: | 21754 6794 12450 9614 4412 5824 9276 21813 1463 11059 4808 13206 9578 13428 3072 15596 4328 3690 8876 7086 15462 6444 12263 8993 5420 6407 12246 1242 4404 4259 22020 4611 9408 14680 3680 10238 9797 6568 8934 7500 |
| 481: | 17081 17400 17733 17377 12323 9631 5203 18639 16889 16035 17467 19493 3726 14585 14637 |
| 482: | 6638 7562 10477 1852 4661 1068 13778 18473 9233 12209 5474 831 3220 16416 19485 21657 17736 2773 6559 19274 11791 2362 1290 |
| 483: | 15521 9926 9372 3535 14815 17378 15342 16992 22270 6694 8651 10442 9501 20248 14291 19051 3324 8926 19254 5893 16393 10149 19420 11920 8831 8248 4517 12007 9386 15721 21801 17774 10932 11965 11946 |
| 484: | 3750 6233 2713 11380 12023 5512 8397 9963 4401 17914 21042 20938 15212 2563 21028 4455 18141 21707 15335 2976 12163 |
| 485: | 12915 8353 10649 15559 21532 1766 2706 8964 20052 20655 17361 14417 5510 14469 5001 8855 14600 20649 14614 15591 20286 2606 9471 1305 12051 13261 12077 17015 15608 2231 9209 13625 14471 16566 18336 20911 10270 15117 22496 11939 2250 12212 10593 15979 5988 |
| 486: | 21080 8598 20902 564 3747 14584 4202 15248 1415 21487 2776 8440 6441 6856 4639 13249 14411 6300 7237 7568 8497 20720 5330 2288 3218 10413 16585 19827 2466 13415 19277 19479 4274 5139 8341 13715 |
| 487: | 6455 20477 1176 8864 15945 3915 15571 16266 6450 1211 18350 6737 21409 1653 14641 22433 16158 5655 11725 |
| 488: | 13633 11464 17818 4487 22079 19811 14672 20311 5875 1804 5805 8760 3617 12276 17631 6644 1838 1416 13999 2846 1536 21067 951 9346 9547 21436 4596 13884 12781 4010 10761 12933 16680 14715 12582 16262 4172 17700 6985 11107 17731 21246 3488 4816 11798 4381 9680 2173 8661 11802 13722 4211 7971 6750 14655 2765 2588 17564 9533 14335 13862 22447 12417 16557 9483 20169 6497 2050 3881 20747 3124 21130 11454 11582 14837 2614 4779 6358 16323 14350 7275 16234 10634 8984 18673 3036 12657 921 5211 10884 8362 20529 8627 7103 8149 15778 6773 11819 1672 12073 7102 20447 2872 7433 19593 19806 21911 5516 15286 11661 8992 14562 3219 17911 15808 5506 20741 21530 15240 20344 18214 15575 12427 3217 20435 7796 2375 11017 10944 13834 12971 20581 6080 16884 1900 7505 3937 11188 811 9207 2830 20690 12613 5666 4380 15312 18349 17639 10145 13494 664 6567 13052 6979 13432 17364 2224 22187 6961 13798 7944 4112 9995 15431 15530 10764 1676 8678 7407 22255 22276 8963 4880 11857 15344 7420 20168 20601 21712 7009 15363 8126 3045 7044 2098 12067 13898 7690 |
| 489: | 21080 8598 20111 19932 20211 6441 6856 13249 4639 14411 6300 15103 8497 20720 5330 2288 19827 16585 13715 |
| 490: | 18170 1316 6082 19848 9272 9871 15911 5917 19405 7429 21327 20596 8045 10178 4720 16346 7401 11417 5176 9427 22532 19611 6616 10826 2235 7529 22399 668 22163 10888 10947 17345 20889 1019 13964 12858 12745 21803 19731 15370 19455 |
| 491: | 14629 |
| 492: | 9026 18203 9034 17176 19316 18425 10191 3057 4291 19993 19117 633 19344 14181 6581 17129 12690 10130 10179 8823 14022 7424 4363 |
| 493: | 11676 10500 20010 22061 13770 5046 17871 10828 15052 1942 11251 10057 14213 |
| 494: | 2867 20983 17787 12926 13702 2680 4336 1898 7033 4692 1931 11547 4004 17355 7966 21453 6141 17522 20009 20155 3861 20641 13805 9004 5518 9100 6706 6460 9101 19945 14203 18615 8818 2078 21644 13350 9869 8593 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| 495: | 10049 | 5921 | 9432 | 4046 | 3753 | 21873 | 9833 | 14362 | 8333 | 13672 | 19390 | |
| | | | | | | | | | | | 1216 | |
| | 3131 | 18992 | 9486 | 11253 | | | | | | | | |
| 496: | 3127 | 1607 | 15003 | 2751 | 9086 | 18256 | 7201 | 3526 | 20063 | 8184 | 14575 | 14132 |
| | 3886 | 15754 | 11997 | 10334 | 8002 | 19176 | 6325 | 12719 | 15443 | 14454 | 10921 | 14581 |
| | 14745 | 9990 | 9911 | 1762 | 10972 | 16402 | 1520 | 16638 | 1856 | 10874 | 3967 | 20026 |
| | 4426 | 20686 | 9163 | 20462 | 20942 | 17529 | 11988 | 17803 | 8476 | 6783 | 21168 | 19191 |
| | 2426 | 12096 | 15664 | 7561 | 11891 | 12826 | 17289 | 3387 | 19858 | 12743 | 98531 | 9481 |
| | 615 | 8569 | 14610 | 1310 | 14283 | 3903 | 16792 | 22556 | 12950 | 6759 | 5113 | 5803 |
| | 20040 | 13866 | 7531 | 12876 | 9534 | 7024 | 13251 | 663 | 2377 | 20537 | 22479 | 20413 |
| | 17045 | 11984 | 22225 | 3341 | 1812 | 7226 | 19298 | 20768 | 6766 | 10544 | 12090 | 22407 |
| | 18361 | 8222 | 5162 | 22240 | 11887 | 8295 | 15781 | 14468 | 2137 | 9880 | 12861 | 16260 |
| | 21244 | 21191 | 22495 | | | | | | | | | |
| 497: | 4536 | 12720 | 13909 | 16764 | 14068 | 5500 | 2174 | 17809 | 20213 | | | |
| 498: | 7246 | 13566 | 4922 | 7189 | 11908 | 21432 | 19713 | 9021 | 8001 | 4169 | 9591 | 18319 |
| | 12836 | 14209 | 15108 | 20572 | 4881 | 2021 | 2629 | 13362 | 21200 | 14093 | 18917 | 5199 |
| | 21121 | 8529 | 17053 | 2009 | 2989 | 6906 | 19492 | 5789 | 6127 | 7577 | 22482 | 6916 |
| | 4185 | 8063 | 10716 | 15947 | 17616 | 22376 | 714 | 9711 | 8995 | 19804 | 16484 | 10432 |
| | 16415 | 18397 | 17120 | 5711 | 20348 | 11410 | 22426 | 5459 | 17025 | 20374 | 5057 | 3996 |
| | 1399 | 16384 | 8557 | 3401 | 18399 | 9470 | 18719 | 2158 | 3928 | 19925 | 15780 | 1172 |
| | 19003 | 4754 | 6752 | 7557 | 15694 | 2929 | 15268 | 8286 | 16534 | 8056 | 2719 | 1955 |
| | 18895 | 5457 | 22161 | 17041 | 8512 | 21678 | 7854 | 18098 | 13647 | 15831 | 11038 | 15162 |
| | 8205 | | | | | | | | | | | |
| 499: | 14500 | 1413 | 1282 | 1702 | 21840 | 19911 | 17917 | 16929 | 17820 | 4161 | 16375 | 12532 |
| | 18092 | 1532 | 5902 | 19438 | 13718 | 6024 | 19735 | 13044 | 2787 | 19276 | 8082 | 9213 |
| | 13875 | 2729 | 19946 | 19636 | 13441 | 11906 | 5009 | 21052 | 8166 | 12467 | 5788 | 10596 |
| | 21948 | 8953 | 11461 | 18890 | 14782 | 22256 | 22200 | 7502 | 22419 | 22028 | 9688 | 19279 |
| | 20234 | 20394 | 3662 | 13624 | 5037 | 17822 | 19294 | | | | | |
| 500: | 17384 | 19962 | 11922 | 12514 | 975 | 11652 | 22218 | 7145 | 9489 | 16374 | 595 | 10439 |
| | 11174 | 6276 | 2673 | 2273 | 5345 | 20790 | 14336 | 21369 | 16362 | 13555 | 12890 | 20920 |
| | 16827 | 21155 | 6409 | 16703 | 4160 | 18249 | 5053 | 1371 | 16010 | 3265 | 21504 | 10158 |
| | 7203 | 22449 | 12631 | 15261 | 19335 | 9198 | 7318 | 16504 | 7195 | 4503 | 21207 | 10641 |
| | 8201 | 15388 | 10167 | 17571 | 2611 | 3434 | 12571 | 13501 | 9308 | 8098 | 13986 | 4294 |
| | 6690 | 17338 | 11438 | 16124 | 14788 | 9510 | 20668 | 22077 | 11494 | 16723 | 5320 | 3714 |
| | 18672 | 19620 | 11228 | 1183 | 17223 | 1503 | 20710 | 7345 | 17503 | 10327 | 18402 | 18415 |
| | 3756 | 1040 | 19384 | 13970 | 1810 | 20021 | 12766 | 10244 | 7980 | 16489 | 3481 | 1266 |
| | 2213 | 5652 | 5230 | 6678 | 19037 | 22307 | 5389 | 18546 | 3014 | 22259 | | |
| 501: | 16649 | 18243 | 16414 | 4207 | 20589 | 9444 | 16449 | | | | | |
| 502: | 22464 | 13448 | 15971 | 16611 | 16582 | 2337 | 16931 | 10640 | 13818 | 19924 | 15868 | 13017 |
| | 5333 | 7271 | 18106 | 6613 | 20999 | 5327 | 19529 | 19566 | 15187 | 19703 | 13925 | 6927 |
| | 17013 | 11388 | 20074 | 15701 | 3553 | 10267 | 14357 | | | | | |
| 503: | 10199 | 16886 | 2241 | 18245 | 1886 | 9716 | 7985 | 8744 | 20562 | 11084 | 13088 | 19819 |
| | 22302 | 17049 | 990 | 2306 | 15235 | 2417 | 1433 | 2115 | 19923 | 19064 | 1002 | 16264 |
| | 8492 | 2272 | 70913 | 39912 | 601 | 4956 | 19182 | 6191 | 7426 | 9434 | 14994 | 11105 |
| | 6247 | 10698 | 8645 | | | | | | | | | |
| 504: | 8253 | 556 | 21865 | 11532 | 13731 | 17389 | 13431 | 10078 | 1271 | 12610 | 10733 | 21490 |
| | 10485 | 18060 | 14669 | 11177 | 20124 | 7109 | 12716 | 1462 | 14936 | 5986 | 8097 | 5080 |
| | 6289 | 3372 | 19867 | 2939 | 10924 | 773 | 11608 | 16138 | 4495 | 6375 | 3829 | 10354 |
| | 13565 | 9492 | 7772 | 17813 | 19072 | 19386 | 6691 | 804 | 12615 | 3475 | 9031 | 16143 |
| | 1291 | 12201 | 12820 | 1857 | 14937 | 19224 | 20789 | 10619 | 4585 | 1580 | 8663 | 12262 |
| | 20460 | 1321 | 17853 | 6723 | 5237 | 11503 | 749 | 5651 | 8384 | 14280 | 17145 | 5419 |
| | 15332 | 13013 | 5297 | 12732 | 19655 | 7901 | 7020 | 16059 | 19539 | 4387 | 1475 | 21505 |
| | 2671 | 5714 | 1191 | 2608 | 21672 | 3296 | 15495 | 21919 | 1209 | 12295 | 15820 | 14193 |
| | 14631 | 6254 | 7207 | 20109 | 13220 | 15146 | | | | | | |
| 505: | 15140 | 1261 | 13853 | 2474 | 14749 | 2848 | 6699 | 13353 | 5174 | 10742 | 4290 | 12981 |
| | 5167 | 19956 | 3782 | 14080 | 3433 | | | | | | | |
| 506: | 4704 | 7409 | 3027 | 1782 | 17403 | 2728 | 12116 | 22243 | 18039 | 19464 | 20608 | 21816 |
| | 20161 | 9586 | 9832 | 1168 | 20257 | 8215 | 2055 | 2915 | 21159 | 8994 | 19097 | 4800 |
| | 10831 | 3258 | 3511 | 5759 | 8010 | 5683 | 18509 | 3517 | 13649 | 8892 | 8848 | 13892 |
| | 15978 | 11205 | 19106 | 17806 | 10914 | 8163 | 22263 | 5036 | 9958 | 17199 | 17195 | 12100 |
| | 14343 | 7851 | 2637 | 16675 | 11823 | | | | | | | |
| 507: | 1698 | 1006 | 429 | 10217 | 7363 | 6232 | 18461 | 5240 | 6367 | 19001 | 18925 | 7778 |
| | 526 | 3438 | 7812 | 20057 | 286 | 2857 | 17664 | 21589 | 11961 | 19154 | 21437 | 11195 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 20933 | 21506 | 3533 | 4677 | 18511 | 4730 | 696 | 9569 | 17797 | 18687 | 7097 | 20259 |
| | 15252 | 13221 | 450 | 11335 | 20777 | 12713 | 22502 | 14915 | 21157 | 20371 | 3563 | 12591 |
| | 16308 | 7626 | 4212 | 19798 | 19458 | 5691 | 18292 | 17864 | 4456 | 16130 | 21296 | 2832 |
| | 830 | 14553 | 6434 | 18295 | 17956 | 829 | 476 | 12043 | 20779 | 1281 | 17745 | 16586 |
| | 7955 | 12705 | 15449 | 988 | 20859 | 1768 | 11129 | 6547 | 22518 | 5552 | 9854 | 11376 |
| | 6669 | 5359 | 9132 | 10964 | 1879 | 22087 | 13137 | 884 | 17298 | 3333 | 13752 | 20301 |
| | 19370 | 2425 | 6946 | 19538 | 14273 | 15340 | 6427 | 17165 | 15603 | 12419 | 10809 | 8003 |
| | 13658 | 14064 | 4221 | 7387 | 13284 | 20981 | 2316 | 3116 | 8418 | 3386 | 6508 | 18217 |
| | 3578 | 22249 | 992 | 13442 | 3471 | 14855 | 19949 | 5277 | 19885 | 2816 | 10917 | 9436 |
| | 18538 | 18659 | 12816 | 12308 | 15943 | 2515 | 20364 | 14701 | 8193 | 17579 | 22076 | 8890 |
| | 2649 | 9329 | 21073 | 8376 | 15177 | 10882 | 859 | 5990 | 9814 | 16053 | 5209 | 3144 |
| | 13848 | 22428 | 19076 | 5454 | 17056 | 14918 | 4088 | 11270 | 5837 | 9604 | 22455 | 19840 |
| | 12234 | 1149 | 801 | 953 | 9960 | 21301 | 1656 | 3755 | 12278 | 22119 | 21098 | 1005 |
| | 10264 | 13037 | 11702 | 20954 | 5581 | 5063 | 1118 | 6454 | 20632 | 1696 | 19474 | 14911 |
| | 9381 | 4111 | 13374 | 2932 | 3071 | 18551 | 22362 | 1431 | 12923 | 6509 | 19229 | 14012 |
| | 5372 | 12362 | 17380 | 20272 | 16391 | 13395 | 5132 | 901 | 9540 | 19228 | 14568 | 17630 |
| | 2371 | 4694 | 12396 | 15369 | 16597 | 3697 | 10741 | 16309 | 4927 | 13396 | 21621 | 8841 |
| | 16662 | 11120 | 14081 | 21135 | 8692 | 9484 | 15204 | 6565 | 14320 | 2978 | 9294 | 7482 |
| | 9493 | 1277 | 4952 | 7813 | 7306 | 12296 | 12021 | 6645 | 9286 | 22489 | 13745 | 16653 |
| | 19069 | 7780 | 15219 | 16969 | 14762 | 18330 | 10802 | 10479 | 16663 | 3678 | 16713 | 7751 |
| | 13703 | 3630 | 4691 | 9472 | 10709 | 8542 | 7060 | 6112 | 22457 | 21974 | 20476 | 7333 |
| | 6482 | 14526 | 7151 | 2644 | 835 | 10655 | 12264 | 9315 | 2786 | 16253 | 9488 | 5634 |
| | 17372 | 788 | 11307 | 11198 | 9280 | 22095 | 18903 | 3706 | 15256 | 18593 | 5764 | 11115 |
| | 12583 | 11568 | 13613 | 2331 | 5136 | 8073 | 15998 | 5630 | 11304 | 19137 | 5817 | 5580 |
| | 14145 | 18341 | 8588 | 12540 | 2454 | 4970 | 17445 | 2401 | 11869 | 6193 | 21516 | 10889 |
| | 5190 | 13207 | 16465 | 9673 | 9771 | 11716 | 22279 | 18575 | 9584 | 12794 | 21399 | 20485 |
| | 9218 | 18691 | 3350 | 18263 | 4846 | 544 | 19667 | 9933 | 4140 | 1318 | 20418 | 11128 |
| | 20105 | 16734 | 2376 | 15699 | 7061 | 4232 | 15357 | 14036 | 5339 | 7107 | 19030 | 7165 |
| | 21370 | 12103 | 4848 | 13211 | 22530 | 15360 | 12863 | 9975 | 6398 | 14067 | 16683 | 21170 |
| | 1924 | 890 | 8155 | 15866 | 10131 | 7187 | 4332 | 1235 | 20330 | 12927 | 7088 | 5099 |
| | 2302 | 12424 | 8303 | 17466 | 14322 | 11383 | 2282 | 15956 | 3414 | 12982 | 18548 | 15665 |
| | 10961 | 21084 | 10824 | 18440 | 16819 | 3730 | 13940 | 18821 | 14864 | 1818 | 19607 | 7969 |
| | 6546 | 16771 | 5441 | 8459 | 18266 | 5000 | 15749 | 13014 | 14274 | 8444 | 4707 | 13097 |
| | 15930 | 11872 | 2621 | 7158 | 6942 | 18502 | 5408 | 10837 | 21928 | 13800 | 5188 | 19614 |
| | 16117 | 4719 | 1833 | 13499 | 3107 | 21492 | 12503 | 21929 | 7921 | 1429 | 14398 | 22189 |
| | 6439 | 12993 | 12307 | 19714 | 6650 | 18994 | 747 | 5932 | 18630 | 6683 | 1921 | 15651 |
| | 5594 | 6958 | 13597 | 19763 | 10097 | 14124 | 14687 | 1094 | 5780 | 7770 | 7688 | 15110 |
| | 5797 | 7907 | 21169 | 3329 | 4065 | 19882 | 12627 | 22067 | 19211 | 2061 | 7038 | 8909 |
| | 16914 | 13129 | 19881 | 16317 | 1551 | 13235 | 14888 | 1201 | 20264 | 7800 | 7526 | 2209 |
| | 5887 | 10798 | 15317 | 10223 | 11351 | 10105 | 10661 | 15014 | 2908 | 16412 | 22277 | 19851 |
| | 12003 | 19616 | 11003 | 7768 | 6166 | 4620 | 13850 | 16231 | 7016 | 2717 | 20541 | 3458 |
| | 1240 | 15787 | 20099 | 9282 | 11480 | 4994 | 6281 | 18662 | 7992 | 9661 | 19875 | 11156 |
| | 3619 | 14086 | 20948 | 16946 | 3456 | 6143 | 786 | 6709 | 5954 | 17926 | 20839 | 22351 |
| | 13277 | 21057 | 15113 | 6368 | 7704 | 18694 | 3644 | 12154 | 3794 | 21257 | 21638 | 18386 |
| | 18111 | 21498 | 10731 | 13776 | 5539 | 14530 | 20282 | 7762 | 9529 | 17675 | 15191 | 12380 |
| | 14865 | 15825 | 2818 | 16442 | 5901 | 8220 | 18578 | 13297 | 2495 | 21913 | 4526 | 16085 |
| | 10965 | 15558 | 18982 | 2984 | 11245 | 20659 | 477 | 304 | 427 | 12456 | 2132 | 20312 |
| | 4655 | 16568 | 21093 | 13882 | 5730 | 7976 | 7079 | 13035 | 2800 | 19890 | 12545 | 2037 |
| | 11704 | 9571 | 21379 | 3712 | 7685 | 4483 | 18456 | 22341 | 11197 | 13107 | 12449 | 16006 |
| | 532 | | | | | | | | | | | |
| 508: | 19543 | 4932 | 20425 | 19108 | 19812 | 10140 | 21350 | 7766 | 14738 | 13289 | 13966 | 559 |
| | 10501 | 18670 | 21326 | 12614 | 16425 | 9945 | 1996 | 21651 | 12806 | 13430 | 17362 | 21330 |
| 509: | 5942 | 14707 | 1006 | 429 | 20069 | 10217 | 6051 | 533 | 535 | 478 | 10352 | 18305 |
| | 21211 | 21561 | 20755 | 17549 | 15547 | 13386 | 8817 | 2523 | 18461 | 15773 | 19497 | 5240 |
| | 22508 | 3614 | 6367 | 19001 | 3539 | 12446 | 15801 | 15469 | 13944 | 13012 | 20409 | 13620 |
| | 15377 | 4732 | 4983 | 11962 | 10129 | 873 | 20622 | 7812 | 18242 | 8809 | 14606 | 18228 |
| | 2931 | 3322 | 9023 | 6902 | 3558 | 3304 | 13684 | 21120 | 3950 | 12291 | 4958 | 21675 |
| | 7657 | 4473 | 17017 | 4318 | 22410 | 19999 | 2415 | 22330 | 534 | 6329 | 4819 | 10093 |
| | 8054 | 966 | 16945 | 14639 | 6901 | 14032 | 21397 | 2354 | 2669 | 10194 | 5075 | 2367 |
| | 11025 | 6751 | 20059 | 21308 | 14038 | 2857 | 17664 | 21589 | 11961 | 19154 | 2340 | 7408 |
| | 6244 | 17569 | 13074 | 21437 | 14633 | 11195 | 20933 | 21506 | 4167 | 3533 | 18759 | 4677 |
| | 18511 | 4730 | 696 | 9569 | 17797 | 18687 | 7097 | 20259 | 15252 | 13221 | 450 | 10725 |
| | 22502 | 14915 | 21157 | 18816 | 20371 | 3563 | 12591 | 16308 | 7626 | 4212 | 19798 | 19458 |
| | 5691 | 18292 | 16130 | 21296 | 2832 | 830 | 14553 | 6434 | 18295 | 17956 | 829 | 476 |
| | 12043 | 2658 | 7437 | 19427 | 14568 | 17630 | 2371 | 4694 | 12396 | 15369 | 16597 | 3697 |
| | 10741 | 16309 | 4927 | 13396 | 21621 | 8841 | 16662 | 11120 | 14081 | 8692 | 9484 | 15204 |
| | 6565 | 14320 | 2978 | 9294 | 7482 | 9493 | 1277 | 4952 | 7813 | 7306 | 12296 | 12021 |
| | 6645 | 9286 | 22489 | 13745 | 16653 | 19069 | 7780 | 15219 | 16969 | 14762 | 18330 | 10802 |
| | 10479 | 16663 | 3678 | 16713 | 7751 | 13703 | 3630 | 4691 | 9472 | 10709 | 8542 | 7060 |
| | 6112 | 22457 | 21974 | 20476 | 7333 | 6482 | 14526 | 7151 | 2644 | 835 | 10655 | 12264 |
| | 9315 | 2786 | 16253 | 9488 | 5634 | 17372 | 21009 | 788 | 5630 | 10889 | 5190 | 13207 |
| | 16465 | 3748 | 4100 | 8138 | 14088 | 9673 | 20541 | 3458 | 1240 | 15787 | 20099 | 9282 |
| | 11480 | 4994 | 5496 | 4783 | 20946 | 10965 | 15558 | 12797 | 4801 | 18251 | 14926 | 14677 |
| | 6310 | 18248 | 15246 | 7925 | 15740 | 18982 | 2984 | 5765 | 4060 | 11245 | 20786 | 4379 |

TABLE 17-continued

Sequence IDs for homolog proteins

| Seq ID NO: | homolog Seq ID NOs | | | | | | | | | | |
|---|---|---|---|---|---|---|---|---|---|---|---|
| | 2132 | 20312 | 4655 | 16568 | 21093 | 13882 | 5730 | 7976 | 7079 | 13035 | 2360 | 2800 |
| | 16617 | 17577 | 19315 | 17164 | 15726 | 12545 | 2037 | 11704 | 9571 | 21379 | 3712 | 7685 |
| | 4483 | 18456 | 22341 | 11197 | 13107 | 2227 | 16006 | 17470 | 10632 | 372 | 16331 | 4975 |
| | 18567 | 13264 | | | | | | | | | | |
| 510: | 2585 | 13077 | 1296 | 15698 | 1085 | 3129 | 8567 | 7012 | 16480 | 1063 | 15389 | 13708 |
| | 17974 | 17451 | 15792 | 19280 | 10142 | 3469 | 4227 | 11718 | 15847 | 3638 | 2801 | 9326 |
| | 10221 | 3742 | 13816 | 3280 | 4884 | 9923 | 11360 | 17722 | 15873 | 1490 | 20214 | 10492 |
| | 13528 | 3713 | 8475 | 15933 | 21666 | 11740 | 9134 | 1633 | 11990 | 17965 | 20492 | 19212 |
| | 13533 | 17131 | 16793 | 11371 | 3728 | 8594 | 17461 | 20347 | 8134 | 13823 | 22260 | 9279 |
| | 7419 | 22025 | 5521 | 19185 | 8730 | 10999 | 4586 | 16348 | 19281 | 11567 | 19991 | 17098 |
| | 20028 | 1067 | 6210 | 7658 | 19756 | 20830 | 10712 | 16037 | 2865 | 20878 | 3207 | 18632 |
| | 20070 | 2980 | 6612 | 2087 | 5122 | 7489 | 19025 | 20408 | 5867 | 9692 | 13244 | 17130 |
| | 19056 | 19348 | 18818 | 779 | 3699 | 15218 | 22456 | 11541 | 11135 | 2201 | 20058 | 15161 |
| | 16612 | 6739 | 10651 | 14992 | 19392 | 15341 | 4204 | 21922 | 22540 | 19457 | 14075 | 17880 |
| | 4186 | 15353 | 17073 | 5661 | 13025 | 14487 | 20671 | 6849 | 10343 | 6103 | 4142 | 17366 |
| | 14159 | 2380 | 18164 | 13366 | 8153 | 19958 | 15839 | 6670 | 8947 | 2506 | 15249 | 9712 |
| | 22234 | 1377 | 18798 | 8620 | 19625 | 10515 | 15887 | 9429 | 5493 | 7939 | 18930 | 19761 |
| | 8714 | 3572 | 20073 | 19642 | 9602 | 11161 | 19552 | 7180 | 10987 | 2971 | 8438 | 4675 |
| | 2938 | 8709 | 9900 | 4636 | 9435 | 3485 | 18162 | 15411 | 20078 | 15262 | 14563 | 3415 |
| | 19829 | 9555 | 8928 | 16342 | 19361 | 1362 | 1940 | 12060 | 11259 | 18358 | 21475 | 7454 |
| | 16972 | 20517 | 14458 | 5311 | 9206 | 3026 | 4246 | 21394 | 11663 | 5647 | 21680 | 18756 |
| | 632 | 3100 | 18856 | 13204 | 14390 | 13351 | 12707 | 15711 | 10265 | 5221 | 14958 | 18751 |
| | 17138 | 17198 | 2504 | 8197 | 10940 | 11642 | 7410 | 19473 | 13298 | 3551 | 3009 | 15678 |
| | 14990 | 9133 | 18124 | 6205 | 1024 | 9670 | 14097 | 21447 | 2996 | 6377 | 19672 | 22172 |
| | 21975 | 4551 | 21676 | 6123 | 2672 | 21984 | 2725 | 19700 | 14920 | 15674 | 7537 | 9974 |
| | 11780 | 5242 | 13895 | 9998 | 3670 | 18115 | 16824 | 20178 | 18010 | 7493 | 13466 | 21265 |
| | 8951 | 14511 | 18486 | 7701 | 6098 | 7554 | 17622 | 11381 | 6309 | 22198 | 19059 | 21658 |
| | 15854 | 16625 | 12681 | 12161 | 11609 | 12398 | 6162 | 3022 | 5109 | 7314 | 14439 | 8366 |
| | 13945 | 12198 | 11746 | 19463 | 8918 | 13801 | 5301 | 15197 | 3210 | 11365 | 15206 | 19669 |
| | 17546 | 2720 | 10926 | 1742 | 6963 | 11828 | 6972 | 8450 | 14550 | 1267 | 11591 | 19644 |
| | 11212 | 14447 | 15125 | 21242 | 13309 | 14497 | 17159 | 832 | 17245 | 5903 | 7432 | 18321 |
| | 3663 | 3061 | 4860 | 9406 | 7511 | 10188 | 13056 | 4196 | 11132 | 3684 | 3623 | 8675 |
| | 14569 | 21430 | 19252 | 10739 | 16443 | 8119 | 10193 | 17100 | 16296 | 16004 | 11852 | 17566 |
| | 10552 | | | | | | | | | | | |
| 511: | 1655 | 3326 | 8875 | 4957 | 8311 | 19832 | 4954 | 10256 | 13907 | 20915 | 2896 | 5571 |
| | 12394 | 6016 | 4944 | 12546 | 7522 | 2423 | 2681 | 8552 | 10982 | 7116 | 5314 | 12119 |
| | 21099 | 18607 | 12329 | 4674 | 13459 | 21805 | 3969 | 14769 | 20266 | 22203 | 3114 | 336 |
| | 12480 | 7283 | 9746 | 8207 | 7204 | 14337 | 11300 | 20397 | 20746 | 1530 | 5147 | 14828 |
| | 21034 | 3906 | 2359 | 21177 | 8537 | 10139 | 16166 | 2594 | 13784 | 16485 | 20871 | 14720 |
| | 1825 | 16147 | 17234 | 8065 | 17167 | 16501 | 11902 | 18924 | 5861 | 14539 | 14230 | 2788 |
| | 2072 | 18571 | 2501 | 4192 | 13524 | 4842 | 3095 | 7769 | 10089 | 16575 | 6956 | 16293 |
| | 11570 | 10846 | 19759 | 20187 | 21448 | 19904 | 10891 | 15038 | 1868 | 12675 | 6957 | 653 |
| | 16915 | 12203 | 12409 | 8067 | 4947 | 19061 | 2619 | 13364 | 4888 | 5566 | 10650 | 17254 |
| | 18049 | 16316 | 7313 | 11076 | 14440 | 1765 | 10770 | 13783 | 5839 | 16261 | 12061 | 9852 |
| | 10237 | 10732 | 19814 | 4893 | 6882 | 6805 | 4262 | 4557 | 3971 | 638 | 11527 | 13153 |
| | 22347 | 12730 | 10796 | 3084 | 18028 | 9061 | 7136 | 21153 | 925 | 8750 | 18082 | 12774 |
| | 8584 | 13536 | 12518 | 6788 | 979 | 8900 | 18133 | 5696 | 15970 | 16063 | 14470 | 16701 |
| | 5862 | 12183 | 3705 | 6658 | 16350 | 9557 | 8971 | 3717 | 1724 | 22354 | 16718 | 3854 |
| | 3536 | 4599 | 16869 | 11895 | 16555 | 16258 | 4214 | 20552 | 21819 | 7135 | 16259 | 15280 |
| | 4762 | 13775 | 4531 | 3367 | 13517 | 21549 | 8105 | 18643 | 4066 | 13282 | 14115 | 5130 |
| | 10429 | 5920 | 4306 | 3192 | 5443 | 21499 | 6557 | 11929 | 20598 | 20903 | 4176 | 9050 |
| | 15849 | 2723 | 15314 | 5993 | 12041 | 21869 | 14163 | 7930 | 9081 | 20569 | 9795 | 20396 |
| | 11150 | 12443 | 4358 | 9475 | 10811 | 2552 | 11877 | 17685 | 21729 | 20974 | 12598 | 14790 |
| | 20989 | 15004 | 17240 | 6237 | 17208 | 21930 | 8580 | 11818 | 5442 | 17259 | 20256 | 16046 |
| | 5065 | 2308 | 2128 | 12182 | 17118 | 2251 | 7155 | 2892 | 13229 | 9845 | 20431 | 4311 |
| | 16583 | 21037 | 18490 | 9763 | 6826 | 11713 | 15211 | 21554 | 16813 | 7056 | 18009 | 3039 |
| | 19296 | 6673 | 11484 | 17841 | 21732 | 6456 | 2378 | 9054 | 19996 | 15355 | 21362 | 7381 |
| 512: | 11789 | 20550 | 12924 | 14464 | 4011 | 19063 | 17858 | 148251 | 17933 | 18215 | 18506 | 8574 |
| | 11311 | 14714 | 10870 | 5173 | 18503 | 12871 | 11792 | 6319 | 5991 | 16072 | 5679 | 7664 |
| | 7997 | 7724 | 13724 | 15843 | 5179 | 21486 | 13257 | 20843 | 5253 | 15239 | 8745 | 4317 |
| | 11829 | 5762 | 17201 | | | | | | | | | |
| 513: | 5799 | 17656 | 10980 | 3449 | 13335 | 20959 | 11238 | 9736 | 21154 | 8759 | 1349 | 18282 |
| | 16665 | 17907 | 1107 | 9170 | 6492 | 20516 | 7727 | 5847 | 9065 | 19902 | 9931 | 8677 |
| | 21320 | 19055 | 9044 | 19475 | 21629 | 4209 | 3873 | 10407 | 3831 | 21694 | 7261 | 11569 |
| | 1480 | 1407 | 5128 | 14542 | 607 | 2784 | 18463 | 12009 | 8535 | 4917 | 22501 | 18918 |
| | 12152 | 19362 | 6874 | 3988 | 10827 | 20140 | 18080 | 14167 | 1710 | 4124 | 3650 | 20877 |
| | 6031 | 11044 | 12822 | 11665 | 16321 | 4669 | 19156 | 10011 | 15957 | 10312 | 16955 | 17469 |
| | 9415 | 12205 | 21650 | 12324 | 10985 | 4763 | 17086 | 19498 | 18609 | 9205 | 19889 | 13760 |
| | 11234 | 3128 | 3060 | 17868 | 7045 | 10721 | 18775 | 8340 | 16607 | 22199 | 8687 | 3652 |
| | 8147 | 19720 | 4090 | 22058 | 13973 | 15250 | 5813 | 3005 | 6442 | 5423 | 4181 | 11396 |
| | 20254 | 11686 | 18648 | 22257 | 3514 | 5054 | 17718 | 19944 | 22383 | 13148 | 10185 | 9304 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 9674 | 13580 | 20000 | 5106 | 14024 | 15026 | 15535 | 16386 | 22442 | 21036 | 12653 | 8647 |
| | 894 | 4170 | 18619 | 16370 | 14161 | 13064 | 13337 | 2689 | | | | |
| 514: | 19430 | 2217 | 13653 | 7909 | 3447 | 18614 | 2248 | 3672 | 3914 | 9037 | 2661 | 14057 |
| 515: | 21829 | 10688 | 1896 | 2695 | 15238 | 6923 | 13321 | 678 | 19909 | 21886 | 6620 | 4554 |
| | 4937 | 9312 | 1954 | 4679 | 2233 | 18331 | 21411 | | | | | |
| 516: | 12014 | 16420 | 2750 | 15538 | 18414 | 1466 | 5013 | 18876 | 17795 | 12046 | 9951 | 6600 |
| | 5934 | 11750 | 5835 | 2034 | 4693 | 13740 | 10307 | 909 | 4231 | 1436 | 13779 | 16112 |
| | 13219 | 4984 | 13214 | 18231 | 18179 | 2811 | 4814 | 18531 | 554 | 6050 | 18257 | 2903 |
| | 3484 | 19943 | 17271 | 7129 | 1721 | 20263 | 20319 | 16055 | 20881 | 9942 | 13994 | 18838 |
| | 11636 | 7029 | 16119 | 5257 | 1043 | 19478 | 20619 | 13417 | 11422 | 10160 | 20613 | 5029 |
| | 8196 | 19429 | 9805 | 1861 | 17540 | 5288 | 14683 | 10272 | 7443 | 2656 | 16627 | 2315 |
| | 772 | 9104 | 9410 | 4096 | 4548 | 9824 | 8485 | 17962 | 16475 | 22107 | 21011 | 15087 |
| | 8840 | 15594 | 20392 | 9440 | 6125 | 9757 | 11164 | 17673 | 20924 | 4254 | 8176 | 16401 |
| | 14437 | 18646 | 12057 | 12830 | 10159 | 17174 | 8040 | | | | | |
| 517: | 13062 | 19774 | 2825 | 8829 | 8332 | 18558 | 21964 | 19050 | 1627 | 16157 | 11534 | 19742 |
| | 19647 | 13280 | 1517 | 9695 | 19320 | 10835 | 10293 | 13202 | 9174 | 14643 | 15719 | |
| 518: | 3195 | 21607 | 10760 | 14223 | 22323 | 21616 | 11305 | 21976 | 16169 | 8132 | 2667 | 11216 |
| | 15637 | 4652 | 2270 | 8808 | 10309 | 18374 | 9291 | 7790 | 12784 | 7569 | 1295 | 5525 |
| | 20767 | 17464 | 15920 | 7877 | 6705 | 4550 | 14008 | 15544 | 7616 | 1791 | 14358 | 15686 |
| | 13182 | 14560 | 16722 | 8357 | 1472 | 4000 | 4261 | 10693 | 20144 | 4624 | 13338 | 17893 |
| | 7464 | 11142 | 13491 | 15676 | 17655 | 17116 | 17984 | 9925 | 18333 | 10247 | 16818 | 4579 |
| | 2385 | 20648 | 983 | 3200 | 6435 | 14763 | 13495 | 12036 | 16066 | 6740 | 14948 | 2307 |
| | 14063 | 6851 | 10240 | 1728 | 16533 | 12629 | 10196 | 17078 | 16048 | 17609 | 11181 | 20629 |
| | 575 | 18286 | 21518 | 5309 | 13744 | 15880 | 19484 | 16840 | 4959 | 15622 | 1288 | 18892 |
| | 15176 | 815 | 7329 | 1175 | 20218 | 8827 | 7588 | 658 | 8704 | 16710 | 12907 | 17705 |
| | 21364 | 16998 | 4945 | 15440 | 14372 | 12879 | 20119 | 17194 | 19468 | 10410 | 10451 | 11618 |
| | 12006 | 12191 | 17175 | 20965 | 12916 | 6796 | 9139 | 17057 | 11008 | 18605 | 3353 | 4650 |
| | 12741 | 1237 | 7988 | 20088 | 8231 | 4522 | 18497 | 11952 | 2866 | 15466 | 10449 | 5850 |
| | 8504 | 22473 | 14806 | 5364 | 12620 | 20699 | 20034 | 4409 | 917 | 9156 | 629 | 12665 |
| | 12908 | 7530 | | | | | | | | | | |
| 519: | 11427 | 19017 | 6602 | 1864 | 10522 | 13385 | 3923 | 15070 | 3821 | 6415 | 1572 | 5050 |
| | 15882 | 10935 | 5721 | 20535 | 12645 | 22402 | 8448 | 1350 | 7112 | 8649 | 5148 | 21245 |
| | 11236 | 6476 | 14907 | 12714 | 20807 | 15311 | 9469 | 4739 | 13575 | 9732 | 8564 | 14799 |
| | 12721 | 13373 | 4868 | 12893 | 19038 | 13333 | 8973 | 17817 | 15414 | 18146 | 11390 | 22248 |
| | 13609 | 10100 | 15109 | 10007 | 5125 | 12633 | 6880 | 5388 | 20060 | 21032 | 8509 | 17168 |
| | 19622 | 20280 | 21442 | 12066 | 17299 | 20123 | 12902 | 2062 | 656 | 6457 | 19453 | 20032 |
| | 10850 | 8420 | 3813 | 21339 | 19516 | 16171 | 21635 | 2450 | 21079 | 19226 | 22202 | 17856 |
| | 19847 | 1215 | 16964 | 11846 | 9253 | 18683 | 16927 | 3145 | 2877 | 4684 | 8416 | 4696 |
| | 4925 | 14172 | 18178 | 10122 | 20134 | 11437 | 19509 | 20038 | 17265 | 10957 | 11114 | 11985 |
| | 13382 | 4424 | 21277 | 6642 | 11395 | 19354 | 3216 | 17000 | 10584 | 4383 | 608 | 11099 |
| | 3606 | 4061 | 6926 | 11774 | 3799 | 5172 | 3696 | 17840 | 9961 | 17641 | 22548 | 13507 |
| | 6182 | 1731 | 2207 | 5353 | 5367 | 13860 | 8912 | 20922 | 11967 | 3241 | 16963 | 17734 |
| | 10073 | 13903 | 22521 | 12149 | 4120 | 617 | 13506 | 13612 | 8031 | 6763 | 7546 | 6218 |
| | 16311 | 10707 | 1223 | 21269 | 9414 | 8360 | 4885 | 3852 | 955 | 17284 | 19833 | 11354 |
| | 2803 | 14827 | 1301 | 19175 | 10717 | 10910 | 12224 | 11516 | 13340 | 5262 | 5684 | 2178 |
| | 13200 | 5913 | 9157 | 7959 | 17542 | 20440 | 18229 | 4805 | 8038 | 13587 | 16238 | 15602 |
| | 18860 | 3544 | 7650 | 12674 | 17624 | 7074 | 576 | 17060 | 7413 | 22374 | 15047 | 21681 |
| | 651 | 17560 | 6085 | 12160 | 12805 | 10775 | 4709 | 11401 | 6838 | 18364 | 17014 | 10752 |
| | 17012 | 8980 | 17510 | 10711 | 8219 | 16107 | 16692 | 19401 | 17191 | 18405 | 15984 | 5384 |
| | 19201 | 4362 | 883 | 6527 | 6410 | 867 | 12321 | 17889 | 17964 | 11941 | 14152 | 6591 |
| | 4578 | 7461 | 4633 | 14845 | 14113 | 9478 | 16306 | 10792 | 5394 | 8423 | 16472 | 5538 |
| | 5726 | 15272 | 22541 | 13274 | 19969 | 1344 | 17982 | 3299 | 6241 | 17488 | 6970 | 16632 |
| | 2724 | 14874 | 2212 | 22392 | 12804 | 12135 | 15618 | 11858 | 552 | 17686 | 5585 | 19912 |
| | 21050 | 1222 | 14554 | 13068 | 15732 | 8905 | 5854 | | | | | |
| 520: | 12932 | 18316 | 8070 | 15251 | 8216 | 15182 | 21583 | 18345 | 17227 | 19404 | 5489 | 17421 |
| | 19679 | 6636 | 1134 | 14441 | 20247 | 13276 | 19767 | 5072 | | | | |
| 521: | 14618 | 7172 | 4577 | 10111 | 4971 | 9921 | 11310 | 2304 | 19058 | 4919 | 2407 | 21318 |
| | 6019 | 13841 | 12405 | 6079 | 22166 | 21222 | 11447 | 3834 | 2957 | 2876 | 3847 | 10030 |
| | 3657 | 8737 | 2532 | 19313 | 13162 | 19695 | 11283 | 21477 | 13270 | 11090 | 20277 | 5569 |
| | 11224 | 1524 | 7689 | 5785 | 1443 | 1174 | 5378 | 3463 | 7893 | 2512 | 20456 | 11012 |
| | 5357 | 17062 | 17203 | 17936 | 14894 | 10285 | 19219 | 19980 | 15015 | 19783 | 22068 | 1918 |
| | 19153 | 5369 | 14302 | 9654 | 16742 | 15180 | 4073 | 14772 | 14901 | 3954 | 13470 | 8012 |
| | 15898 | 12241 | 11155 | 18311 | 11712 | 3109 | 18530 | 17791 | 1700 | 6065 | 18830 | 8838 |
| | 7741 | 20399 | 7063 | 8515 | 13562 | 2024 | 8969 | 7647 | 12054 | 19078 | 2184 | 16655 |
| | 8540 | 7852 | 16491 | 13169 | 20514 | 20202 | 7535 | 18320 | 11710 | 7747 | 15987 | 17730 |
| | 7302 | 1993 | 2766 | 4031 | 5562 | 21493 | 10046 | 1799 | 4731 | 18131 | 8100 | 10005 |
| | 7123 | 2520 | 10396 | 22156 | 9867 | 7052 | 11207 | 4505 | 21049 | 11504 | 21868 | 11614 |
| | 5889 | 12118 | 13000 | 22505 | 2411 | 10176 | 6296 | 9619 | 18566 | 20017 | 11928 | 3767 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 11046 | 7551 | 2528 | 11302 | 21596 | 6991 | 7083 | 2350 | 736 | 10023 | 5402 | 21313 |
| | 14934 | 14110 | 14248 | 11521 | 15498 | 3429 | 17829 | 15576 | 19218 | 22393 | 10506 | 19723 |
| | 20354 | 6720 | 17694 | 8466 | 4273 | 4916 | 22208 | 20427 | 9107 | 15921 | 4439 | 10197 |
| | 2338 | 16397 | 13942 | 15715 | 20725 | 18142 | 3311 | 2926 | 10795 | 3889 | 17244 | 10288 |
| | 19160 | 8477 | 12011 | 3565 | 21062 | 9658 | 16357 | 6172 | 2617 | 1734 | 15245 | 22324 |
| | 7974 | 4678 | 3698 | 3992 | 10876 | 20303 | 19258 | 17048 | 4272 | 20359 | 11598 | 8412 |
| | 6693 | 19116 | 5690 | 8276 | 912 | 4024 | 10472 | 12647 | 6733 | 5738 | 15800 | 21800 |
| | 3295 | 8590 | 20011 | 17717 | 4177 | 7227 | 20102 | 5504 | 13132 | 11762 | 15477 | 18479 |
| | 9793 | 17968 | 11404 | 21844 | 17913 | 17281 | 14938 | 1225 | 7663 | 13582 | 11349 | 16247 |
| | 19951 | 3778 | 8781 | 7268 | 10618 | 18594 | 14849 | 15471 | 22337 | 22454 | 4787 | 4244 |
| | 12088 | 1992 | 9332 | 15917 | 17106 | 13790 | 19542 | 19573 | 2089 | 1592 | 7878 | 12361 |
| | 19383 | 14253 | 17356 | 4238 | 9481 | 1439 | | | | | | |
| 522: | 14431 | 6239 | 11377 | 22466 | 13606 | 11763 | 4871 | 19242 | 19036 | 9779 | 970 | 4882 |
| | 15417 | 18050 | 2958 | 13661 | 18314 | 19970 | 8044 | 8672 | 8262 | 4077 | 12369 | 12815 |
| | 15194 | 7431 | 19112 | 585 | 5289 | 17307 | 6089 | 5537 | 5935 | 21766 | 1304 | 15168 |
| | 4356 | 6485 | 15400 | 19439 | 706 | 14453 | 1031 | 5411 | 11160 | 12131 | 10020 | 11249 |
| | 8415 | 21643 | 14449 | 14017 | 1963 | 10261 | 1703 | 1878 | 4023 | 12040 | 9720 | 17260 |
| | 21578 | 15343 | 11117 | 16514 | 14299 | 20222 | 12107 | 18114 | 13664 | 4184 | 14261 | 16823 |
| | 13551 | 22313 | 3921 | 1998 | 666 | 4628 | 20928 | 18508 | 9588 | 8794 | 5200 | 619 |
| | 4115 | 20171 | 1555 | 3070 | 5376 | 7843 | 10040 | 19791 | 19447 | 20093 | 16957 | 19231 |
| 523: | 5718 | 10805 | 6298 | 2166 | 20556 | 21748 | 9437 | 8027 | 3472 | 10338 | 7212 | 20501 |
| | 11491 | 4341 | 11669 | 9303 | 16917 | 8868 | 14506 | 2160 | 21476 | 17596 | 18688 | 9966 |
| | 15557 | 11767 | 2124 | 18956 | 7553 | 18747 | 18697 | 17873 | 7757 | 16320 | 22134 | 13292 |
| | 7913 | 9948 | 6980 | 17735 | 634 | 12444 | 16435 | 5350 | 17955 | 19423 | 15565 | 11353 |
| | 20128 | 13016 | 5239 | 860 | 22552 | 2379 | 6033 | 16520 | 21986 | 17573 | 5222 | 14074 |
| | 2603 | 19569 | 20484 | 2875 | 1313 | 5161 | 7288 | 21179 | 5370 | 19621 | 980 | 10087 |
| | 20381 | 3366 | 6986 | 21533 | 16164 | 20883 | 3426 | 1157 | 16729 | 6898 | 20593 | 17576 |
| | 9698 | 12169 | 10986 | 8048 | 17173 | 5809 | 21767 | 582 | 9317 | 13750 | 3110 | 18945 |
| | 19532 | 13594 | 14859 | 19926 | 14149 | 16203 | 18916 | 2694 | 2259 | 3885 | 16893 | 6833 |
| | 6096 | 16248 | 7576 | 1925 | 6278 | 10533 | 5649 | 20618 | 13912 | 17331 | 9831 | 9223 |
| | 1851 | 20107 | 18714 | | | | | | | | | |
| 524: | 5146 | 21711 | 9443 | 19434 | 17798 | 8271 | 15157 | 6680 | 1121 | 22072 | 17654 | 19028 |
| | 13218 | 6405 | 9244 | 5217 | 7137 | 8194 | 21221 | 12019 | 13471 | 17578 | 11153 | 9140 |
| | 11727 | 17633 | 3462 | 17166 | 6295 | 21753 | 828 | 13617 | 9059 | 2402 | 16458 | 7601 |
| | 13675 | 21744 | 12228 | 3556 | 9011 | 10297 | 8699 | 1058 | 17727 | 3732 | 888 | 19098 |
| | 19007 | 20328 | 22435 | 9743 | 8151 | 9884 | 5912 | 13874 | 1793 | 20963 | 14276 | 11662 |
| | 13913 | 18489 | 16461 | 9898 | 8731 | 15745 | 3973 | 880 | 2296 | 9092 | 18765 | 17370 |
| | 18888 | 13547 | 17231 | 13680 | 4367 | 14754 | 17832 | 2159 | 8925 | 6054 | 4836 | 21950 |
| | 16483 | 17585 | 20898 | 15188 | 9783 | 19045 | 2088 | 7805 | 5781 | 7540 | 21423 | 10626 |
| | 3232 | 3412 | 16951 | 12593 | 7133 | 7230 | 17422 | 10172 | 19629 | 20061 | 15226 | 16396 |
| | 13106 | 16858 | 12395 | 8064 | 18608 | 10913 | 18148 | 14559 | 11640 | 22231 | 949 | 3806 |
| | 922 | 6047 | 14424 | 20294 | 21512 | 2844 | 21750 | 10411 | 1285 | 598 | 9413 | 13278 |
| | 5979 | 15078 | 9781 | 11382 | 15932 | 16934 | 17171 | 3994 | 21427 | 3887 | 3113 | 10974 |
| | 15635 | 18526 | 5503 | 9904 | 16377 | 17644 | 12020 | 15507 | 18396 | 5802 | 16207 | 16206 |
| | 6951 | 13409 | 14980 | 12042 | 9197 | 20762 | 11969 | 14942 | 19111 | 1373 | 9467 | 797 |
| | 8518 | 2947 | 13489 | 6590 | 10901 | 7185 | 7646 | 6204 | 6548 | 8825 | 7264 | 13425 |
| | 13837 | 10201 | 11983 | 19803 | 21421 | 11553 | 9049 | 3356 | 19634 | 16334 | 3944 | 7749 |
| | 20163 | 662 | 8190 | 6651 | 20724 | 22285 | 8240 | 12389 | 5598 | 11233 | 14315 | 15485 |
| | 11282 | 20624 | 12145 | 12327 | 13242 | 17891 | 1217 | 8203 | 12727 | 22111 | 8826 | 9668 |
| | 20863 | 11483 | 21587 | | | | | | | | | |
| 525: | 6387 | 20127 | 15922 | 6468 | 22478 | 5164 | 14961 | 7042 | 16305 | 2182 | 16677 | 7733 |
| | 8221 | 13250 | 4225 | 10787 | 11039 | 2823 | 13281 | 6380 | 6824 | 6360 | 20082 | 1398 |
| | 14175 | 14977 | 21194 | 5933 | 9986 | 10799 | 2049 | 7444 | 4924 | 15193 | 2703 | 12215 |
| | 13851 | 836 | 5401 | 12967 | 18193 | 18801 | 1103 | 3308 | 20749 | 18446 | 18404 | 15606 |
| | 19308 | 7496 | 14462 | 10044 | 21187 | 16900 | 8754 | 16101 | 22544 | 1746 | 5089 | 13111 |
| | 9288 | 15179 | 4423 | 14999 | 11584 | 15673 | 5028 | 18076 | 21294 | 12622 | 21553 | 14776 |
| | 12325 | 6837 | 10013 | 20597 | 20543 | 11805 | 18067 | 18468 | 4428 | 3795 | 8921 | 3661 |
| | 8624 | 4476 | 13323 | 11313 | 7963 | 22062 | 20636 | 18513 | 1030 | 8805 | 22083 | 5807 |
| | 3830 | 19568 | 5055 | 4025 | 10497 | 21824 | 10898 | 19772 | 590 | 10473 | 8226 | 20982 |
| | 6273 | 21435 | 16209 | 9607 | 18881 | 10143 | 5700 | 11596 | 10735 | 19808 | 17961 | 19021 |
| | 1837 | 21662 | 20927 | 1365 | 7598 | 21243 | 15848 | 17757 | 8577 | 12564 | 9707 | 7488 |
| | 9892 | 1675 | 13967 | 1620 | 3282 | 2358 | 18278 | 15275 | 15531 | 18220 | 21540 | 22120 |
| | 14812 | 13263 | 6574 | 14679 | 2574 | 16215 | 1945 | 10259 | 15499 | 11627 | 12347 | 2605 |
| | 6895 | 7286 | 10483 | 2487 | 10289 | 3346 | 7293 | 9601 | 10220 | 7996 | 4547 | 4237 |
| | 7808 | 7341 | 5250 | 14483 | | | | | | | | |
| 526: | 8075 | 16099 | 8242 | 429 | 13036 | 10217 | 18174 | 535 | 533 | 507 | 306 | 11062 |
| | 15313 | 16399 | 14594 | 314 | 3820 | 5717 | 20464 | 15374 | 18461 | 18690 | 9504 | 8137 |
| | 11945 | 3327 | 4030 | 1064 | 15390 | 4708 | 6367 | 19001 | 8581 | 6859 | 18172 | 3305 |
| | 18107 | 12112 | 13896 | 2465 | 12130 | 19906 | 4949 | 17359 | 16220 | 13607 | 10705 | 15889 |
| | 16978 | 8246 | 16554 | 18467 | 9002 | 9780 | 17882 | 21655 | 20242 | 9063 | 5705 | 9204 |
| | 9915 | 11991 | 16148 | 15840 | 14589 | 6171 | 20389 | 6007 | 14898 | 1840 | 4491 | 7812 |

TABLE 17-continued

| Sequence IDs for homolog proteins | | | | | | | | | | | | |
|---|---|---|---|---|---|---|---|---|---|---|---|---|
| Seq ID NO: | homolog Seq ID NOs | | | | | | | | | | | |
| | 8977 | 13027 | 6371 | 15170 | 21310 | 12535 | 9755 | 2819 | 3052 | 12267 | 8377 | 3804 |
| | 7983 | 22167 | 21674 | 22450 | 891 | 13549 | 7113 | 14532 | 9354 | 7858 | 8394 | 2044 |
| | 9345 | 2341 | 6836 | 19148 | 17763 | 286 | 18665 | 2645 | 14240 | 13516 | 9032 | 15489 |
| | 8304 | 7822 | 9993 | 17083 | 7310 | 5481 | 11010 | 1093 | 7789 | 21306 | 21699 | 11113 |
| | 8956 | 18128 | 7880 | 3416 | 6279 | 2857 | 11961 | 19154 | 10481 | 11542 | 21609 | 21506 |
| | 3533 | 6663 | 3391 | 4677 | 18511 | 4730 | 696 | 9569 | 17797 | 18687 | 7097 | 20259 |
| | 15252 | 13221 | 3261 | 14692 | 22502 | 14915 | 21157 | 20371 | 3563 | 12591 | 16308 | 7626 |
| | 16130 | 21296 | 2832 | 830 | 14553 | 6434 | 18295 | 17956 | 20230 | 10392 | 12043 | 21065 |
| | 20779 | 1281 | 17745 | 3289 | 3754 | 5487 | 8587 | 11548 | 12578 | 2882 | 5552 | 16586 |
| | 7955 | 1768 | 22518 | 12705 | 15449 | 988 | 20859 | 11129 | 6547 | 9854 | 11376 | 6669 |
| | 5359 | 9132 | 10964 | 19776 | 1879 | 22087 | 13137 | 13752 | 17298 | 3333 | 20301 | 19370 |
| | 15830 | 2425 | 6946 | 19538 | 14273 | 15340 | 6427 | 17165 | 15603 | 12419 | 10809 | 8003 |
| | 13658 | 14568 | 12544 | 17630 | 2371 | 4694 | 12396 | 15369 | 16597 | 3697 | 10741 | 13396 |
| | 21621 | 16662 | 8841 | 11120 | 14081 | 13456 | 21472 | 7487 | 12898 | 12787 | 8692 | 9484 |
| | 15204 | 6565 | 11203 | 14320 | 2978 | 9294 | 7482 | 9493 | 1277 | 4952 | 7813 | 7306 |
| | 12296 | 12021 | 6645 | 9286 | 22489 | 13745 | 16653 | 19069 | 7780 | 15219 | 16969 | 19357 |
| | 14762 | 10802 | 10479 | 16663 | 3678 | 16713 | 7751 | 13703 | 3630 | 4691 | 9472 | 10709 |
| | 8542 | 7060 | 6112 | 22457 | 21974 | 20476 | 7333 | 6482 | 14526 | 7151 | 2644 | 835 |
| | 10655 | 12264 | 17372 | 10889 | 6281 | 10965 | 15558 | 5973 | 1482 | 22476 | 19408 | 9637 |
| | 5773 | 5016 | 20819 | 18982 | 19997 | 4572 | 640 | 19168 | 8691 | 17905 | 2970 | 2132 |
| | 20312 | 4655 | 16568 | 21093 | 13882 | 5730 | 7976 | 7079 | 13035 | 3505 | 2800 | 12522 |
| | 8939 | 2155 | 3206 | 2017 | 15587 | 6277 | 1297 | 1423 | 18728 | 305 | 509 | 12545 |
| | 2037 | 11704 | 9571 | 21379 | 13089 | 11197 | 13107 | 22367 | 17943 | 2420 | 7599 | 5997 |
| | 372 | 1801 | 21374 | 16528 | 8722 | 16672 | | | | | | |
| 527: | 3642 | 15482 | 8461 | 18796 | 11646 | 4433 | 18911 | 12512 | 19895 | 14727 | 7891 | 5229 |
| | 8941 | 8192 | 671 | 3621 | 19293 | 20133 | 7775 | 16444 | 5601 | 9047 | 7456 | 1332 |
| | 15241 | 20870 | 3570 | 13126 | 6335 | 14830 | 17816 | 4052 | 1048 | 11934 | 7415 | 16817 |
| | 11466 | 15006 | 17149 | 16740 | 13546 | 20225 | 18675 | 12360 | 11085 | 4464 | 12955 | 7636 |
| | 18831 | 17524 | 21731 | 2244 | 8988 | 9012 | 18649 | 8617 | 6285 | 18612 | 1053 | 1455 |
| | 4829 | 16779 | 15889 | 18827 | 14953 | 12980 | 10447 | 1034 | 15656 | 2581 | 22412 | 4354 |
| | 10756 | 21138 | 3468 | 6872 | 6990 | 15371 | 16865 | 14170 | 14485 | 16553 | 7703 | 21199 |
| | 6847 | 729 | 14001 | 18779 | 7182 | 2836 | 8312 | 3038 | 18069 | 16737 | 4357 | 10422 |
| | 3567 | 6722 | 22039 | 3264 | 5085 | 20829 | 6719 | 2934 | 10564 | 14973 | 13027 | 2205 |
| | 9393 | 19576 | 7148 | 2665 | 6959 | 16605 | 4997 | 17039 | 7857 | 4310 | 11556 | 19590 |
| | 12715 | 6725 | 8377 | 3489 | 3770 | 22024 | 3546 | 20586 | 5189 | 20926 | 2245 | 1604 |
| | 7700 | 18947 | 5485 | 22116 | 21537 | 11706 | 18715 | 21536 | 17691 | 17398 | 2949 | 3079 |
| | 6290 | 961 | 6042 | 4750 | 8302 | 20882 | 5852 | 13136 | 16392 | 2643 | 14077 | 9240 |
| | 11996 | 3702 | 14090 | 19402 | 7233 | 5546 | 10148 | 20680 | 8638 | 3269 | 15282 | 9663 |
| | 15009 | 15604 | 8648 | 14392 | 18782 | 10570 | 6318 | 19862 | 13514 | 13217 | 3980 | 5231 |
| | 11578 | 4812 | 18337 | 3004 | 3073 | 8249 | 18941 | 9036 | 3233 | 864 | 15080 | 19930 |
| | 6746 | 1476 | 10866 | 20483 | 19942 | 7450 | 762 | 21276 | 3235 | 15320 | 22462 | 11955 |
| | 1562 | 13099 | 7710 | 9136 | 7251 | 16129 | 19467 | 10892 | 10630 | 13600 | 12857 | 14732 |
| | 4581 | 18096 | 3518 | 12368 | 1009 | 17283 | 4039 | 6864 | 5773 | 6063 | 15842 | 16851 |
| | 18149 | 7977 | 14608 | 4572 | 10553 | 4514 | 11848 | 18068 | 17157 | 12223 | 18597 | 15178 |
| | 10550 | 11835 | 16242 | 11778 | 20884 | 16907 | 14445 | 5068 | 7404 | 1516 | 6277 | 17663 |
| | 17662 | 21513 | 5526 | 14789 | 7565 | 21347 | 1238 | 10660 | 18496 | 16381 | 20827 | 19639 |
| 528: | 22368 | 2262 | 4500 | 18087 | 11171 | 3257 | 5531 | 17538 | 11849 | 9017 | 9287 | 9644 |
| | 19677 | 20195 | 3911 | 3945 | 21129 | 6446 | | | | | | |
| 529: | 18280 | 2326 | 4826 | 11407 | 11186 | 16051 | 1917 | 13113 | 10636 | 10206 | 19238 | 18366 |
| | 6941 | 11986 | 7683 | 16587 | 14340 | 18850 | 6892 | 3404 | 17954 | 20223 | 11450 | 10435 |
| | 19074 | 13384 | 7518 | 15985 | 8336 | 5383 | 3907 | 13379 | 12855 | 14509 | 12217 | 3398 |
| 530: | 1719 | 15257 | 12828 | 16494 | 8849 | 18495 | 10061 | 1831 | 11005 | 20446 | 21892 | 17075 |
| | 9052 | 1023 | 10386 | 2348 | 6364 | 14482 | 15814 | 7746 | 9263 | 3529 | 9935 | 10786 |
| | 20919 | 12407 | 11705 | 8493 | 5095 | 8481 | 6104 | 3104 | 14770 | 19267 | 1032 | 17399 |
| | 8085 | 17728 | 7344 | 673 | 15714 | 3361 | 5103 | 21218 | 15350 | 7539 | 761 | 19758 |
| | 16925 | 17515 | 8371 | 9594 | 13769 | 16744 | 17772 | 4420 | 8605 | 6819 | 6628 | 9541 |
| | 19100 | 13982 | 7360 | 20665 | 9903 | 5639 | 8487 | 13488 | 9666 | 5511 | 11106 | 17709 |
| | 5021 | 19088 | 20007 | 12811 | 14758 | 15329 | 7823 | 21543 | 20508 | 1178 | 5558 | 16935 |
| | 1252 | 7312 | 20192 | 18963 | 5305 | 19575 | 17193 | 1262 | 3577 | 20951 | 2711 | 18829 |
| | 9159 | 6009 | 6176 | 17751 | 9694 | 17992 | 12429 | 15448 | 4598 | 18452 | 7077 | 10597 |
| | 16197 | 705 | 8820 | 11971 | 19192 | 1370 | 996 | 1578 | 21971 | 6312 | 17349 | 2736 |
| | 3936 | 10254 | 10398 | 22265 | 20083 | 15853 | 14066 | 5564 | 9113 | 3087 | 1078 | 7435 |
| | 14028 | 16372 | 9321 | 18704 | 8983 | 21564 | 9660 | 11558 | 17282 | 12695 | 19057 | 13847 |
| | 17094 | 11400 | 7613 | 2232 | 17213 | 17103 | 19378 | 6072 | 14868 | 8879 | 6825 | 12193 |
| | 1427 | 3275 | 9458 | 15007 | 6271 | 4411 | 4190 | 12430 | 16366 | 20438 | 15680 | 10929 |
| | 4035 | 20030 | 4556 | 17229 | 4660 | 597 | 1587 | 15707 | 4334 | 22484 | 21035 | 8211 |
| | 16251 | 13133 | 11295 | 2966 | 14058 | 5665 | 6592 | 8738 | 6102 | 13087 | 3436 | 12074 |
| | 14546 | 13772 | 20692 | 10970 | 19345 | 13509 | 5329 | 19187 | 16282 | 9968 | 21671 | 9048 |
| | 8976 | 7492 | 21462 | 19662 | 8457 | 8317 | 18846 | 12864 | 10746 | 4141 | 8673 | 21010 |
| | 10417 | 4329 | 7895 | 998 | 10132 | 8852 | 14795 | 5620 | 6695 | 13781 | 19165 | 7258 |
| | 20895 | 4154 | 7359 | 12259 | 11737 | 12704 | 21606 | 3865 | 5520 | 6932 | 12901 | 20940 |
| | 15027 | 3236 | 4907 | 20734 | 15492 | 10607 | 2472 | 15046 | 8506 | 18724 | 11671 | 15259 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 15936 | 7889 | 5596 | 2053 | 6905 | 8323 | 16351 | 10263 | 15826 | 21160 | 19461 | 17456 |
| | 3953 | 3584 | 4314 | 6428 | 14221 | 4758 | 5800 | 22365 | 17678 | 16252 | 14893 | 17154 |
| | 19437 | 16453 | 21224 | 9572 | 16225 | 9367 | 1899 | 8751 | 8426 | 12483 | 4441 | 20592 |
| | 6867 | 2168 | 16928 | 13225 | 22460 | 20208 | 12970 | 2591 | 5304 | 13498 | 21581 | 4699 |
| | 21894 | 1461 | 5860 | 21622 | 18703 | 2500 | 7014 | 15116 | 596 | 14962 | 5517 | 13693 |
| | 21739 | 19681 | 11533 | 3338 | 3956 | 11364 | 17988 | | | | | |
| 531: | 15910 | 22524 | 13589 | 1006 | 11575 | 20349 | 18523 | 10911 | 13067 | 10217 | 9609 | 5233 |
| | 4966 | 9015 | 21390 | 18461 | 9866 | 21665 | 7323 | 5049 | 9997 | 5240 | 6367 | 19001 |
| | 2814 | 21443 | 1880 | 1396 | 3615 | 13867 | 7787 | 22538 | 13411 | 13344 | 1205 | 18398 |
| | 13083 | 17485 | 1550 | 757 | 11281 | 11029 | 21967 | 827 | 1873 | 21174 | 14091 | 5281 |
| | 885 | 7332 | 8229 | 21103 | 4400 | 1012 | 15883 | 7812 | 7121 | 16424 | 1339 | 1866 |
| | 3474 | 11617 | 19918 | 14296 | 1352 | 17699 | 12367 | 3388 | 20896 | 20167 | 6697 | 19989 |
| | 9358 | 15375 | 4618 | 11468 | 13543 | 3097 | 15540 | 19380 | 14287 | 5051 | 11086 | 12824 |
| | 13271 | 15196 | 6303 | 4194 | 1182 | 15803 | 1842 | 19299 | 2857 | 17664 | 21589 | 11961 |
| | 19154 | 12506 | 21814 | 6334 | 21437 | 20936 | 11195 | 20933 | 21506 | 22069 | 5476 | 3533 |
| | 19583 | 7949 | 4677 | 18511 | 4730 | 696 | 9569 | 17797 | 18687 | 7097 | 20259 | 15252 |
| | 13221 | 13305 | 450 | 22502 | 14915 | 21157 | 6730 | 2195 | 19855 | 10324 | 11089 | 1744 |
| | 19917 | 16130 | 21296 | 2832 | 830 | 14553 | 6434 | 18295 | 17956 | 829 | 476 | 12043 |
| | 2457 | 13959 | 12384 | 5220 | 3209 | 19341 | 5731 | 10908 | 4395 | 21843 | 14568 | 17630 |
| | 2371 | 4694 | 12396 | 15369 | 13051 | 16597 | 3697 | 10741 | 16309 | 4927 | 13396 | 21621 |
| | 8841 | 16662 | 11120 | 14081 | 19449 | 21259 | 15204 | 6565 | 18317 | 14304 | 4952 | 7813 |
| | 7306 | 12296 | 12021 | 6645 | 21386 | 16505 | 9286 | 22489 | 3622 | 14762 | 18330 | 10802 |
| | 10479 | 16663 | 3678 | 16713 | 7751 | 13703 | 3630 | 4691 | 9472 | 10709 | 8542 | 7060 |
| | 6112 | 22457 | 21974 | 20476 | 7333 | 6482 | 14526 | 7151 | 2644 | 835 | 10655 | 12264 |
| | 9315 | 2786 | 16253 | 9488 | 5634 | 17372 | 3836 | 7637 | 4946 | 18143 | 11559 | 18362 |
| | 12059 | 10889 | 5190 | 13207 | 16465 | 17346 | 3323 | 5354 | 5825 | 2210 | 19147 | 9333 |
| | 13177 | 20541 | 3458 | 1240 | 15787 | 20099 | 9282 | 11480 | 4994 | 14011 | 1145 | 19545 |
| | 802 | 17144 | 13420 | 13439 | 14301 | 1357 | 10965 | 15558 | 22251 | 22565 | 810 | 7570 |
| | 2692 | 15666 | 13168 | 10912 | 20574 | 4894 | 2526 | 18982 | 4020 | 19796 | 2984 | 11522 |
| | 11245 | 21570 | 8695 | 16749 | 17392 | 2132 | 20312 | 4655 | 16568 | 21093 | 13882 | 5730 |
| | 7976 | 7079 | 13035 | 2800 | 16658 | 18348 | 16408 | 4157 | 8112 | 5264 | 305 | 12545 |
| | 2037 | 11704 | 9571 | 21379 | 3712 | 7685 | 4483 | 18456 | 22341 | 3397 | 11197 | 13107 |
| | 675 | 16006 | 20604 | 18536 | | | | | | | | |
| 532: | 15542 | 3190 | 1006 | 429 | 7236 | 21108 | 10856 | 10217 | 1694 | 1170 | 507 | 478 |
| | 7946 | 4963 | 10952 | 8465 | 18461 | 9739 | 1850 | 5240 | 2382 | 6367 | 19001 | 19407 |
| | 14319 | 21808 | 15520 | 1498 | 14212 | 14282 | 19450 | 526 | 3987 | 18034 | 12939 | 14517 |
| | 22533 | 14740 | 7812 | 18725 | 15422 | 12515 | 6665 | 8294 | 20640 | 9749 | 7933 | 18742 |
| | 10601 | 1528 | 14184 | 8297 | 11430 | 21253 | 7897 | 4901 | 7308 | 16574 | 19527 | 9882 |
| | 8330 | 6186 | 16730 | 3076 | 15579 | 16073 | 19400 | 17335 | 28571 | 76642 | 15891 | 1961 |
| | 19154 | 6997 | 3197 | 21437 | 4440 | 11195 | 20933 | 21506 | 3533 | 4677 | 18511 | 4730 |
| | 696 | 9569 | 17797 | 18687 | 7097 | 20259 | 2920 | 15252 | 13221 | 3452 | 14930 | 450 |
| | 11335 | 20777 | 12713 | 22502 | 14915 | 21157 | 14054 | 10864 | 5059 | 21184 | 8816 | 9146 |
| | 14653 | 14579 | 20371 | 3563 | 12591 | 16308 | 7626 | 4212 | 19798 | 19458 | 5691 | 18292 |
| | 7706 | 5100 | 4540 | 16130 | 21296 | 2832 | 830 | 14553 | 6434 | 18295 | 17956 | 829 |
| | 476 | 12043 | 13241 | 11023 | 4301 | 9298 | 2269 | 1306 | 13291 | 17064 | 20779 | 5613 |
| | 1281 | 17745 | 11486 | 9723 | 16586 | 7955 | 12705 | 15449 | 988 | 20859 | 1768 | 11129 |
| | 6547 | 22518 | 5552 | 9854 | 11376 | 6669 | 5359 | 9132 | 10964 | 1879 | 22087 | 13137 |
| | 17298 | 3333 | 13752 | 20301 | 19370 | 2425 | 20461 | 6946 | 19538 | 14273 | 15340 | 6427 |
| | 17165 | 15603 | 12419 | 10809 | 8003 | 13658 | 14064 | 14568 | 17630 | 2371 | 4694 | 12396 |
| | 15369 | 16597 | 3697 | 10741 | 12482 | 16309 | 4927 | 13396 | 21621 | 8841 | 16662 | 11120 |
| | 14081 | 15751 | 4903 | 21508 | 18755 | 14599 | 6384 | 8692 | 9484 | 15204 | 6565 | 14320 |
| | 2978 | 9294 | 7482 | 9493 | 1277 | 4952 | 7813 | 7306 | 12296 | 12021 | 6645 | 9286 |
| | 22489 | 13745 | 16653 | 19069 | 7780 | 15219 | 16969 | 14762 | 18330 | 10802 | 10479 | 16663 |
| | 3678 | 16713 | 7751 | 13703 | 3630 | 4691 | 9472 | 10709 | 8542 | 7060 | 6112 | 22457 |
| | 21974 | 20476 | 7333 | 6482 | 14526 | 7151 | 2644 | 835 | 10655 | 12264 | 9315 | 2786 |
| | 16253 | 9488 | 5634 | 17372 | 1733 | 20453 | 21787 | 16624 | 7001 | 20828 | 13302 | 10357 |
| | 4549 | 788 | 10490 | 19133 | 12318 | 5515 | 9280 | 22095 | 18903 | 3706 | 15256 | 18593 |
| | 5764 | 11115 | 12583 | 11568 | 13613 | 2331 | 5136 | 8073 | 15998 | 5630 | 11304 | 19137 |
| | 5817 | 5580 | 3044 | 18341 | 8588 | 5857 | 12540 | 2454 | 4970 | 16919 | 17445 | 2401 |
| | 11869 | 6193 | 21516 | 10889 | 5190 | 13207 | 16465 | 9673 | 11625 | 9771 | 2283 | 11716 |
| | 19554 | 905 | 7481 | 12401 | 19686 | 13656 | 22135 | 9553 | 18575 | 9584 | 12794 | 5644 |
| | 21399 | 20485 | 9218 | 18691 | 3350 | 18263 | 4846 | 544 | 19667 | 9933 | 4140 | 1318 |
| | 20418 | 11128 | 20105 | 16734 | 2376 | 15699 | 7061 | 4232 | 15357 | 14036 | 5339 | 7107 |
| | 19030 | 7165 | 21370 | 12103 | 4848 | 13211 | 22530 | 15360 | 12863 | 9975 | 6398 | 14067 |
| | 16683 | 21170 | 1924 | 890 | 8155 | 15866 | 10131 | 7187 | 4332 | 1235 | 20330 | 12927 |
| | 7088 | 5099 | 2302 | 12424 | 8303 | 17466 | 14322 | 11383 | 2282 | 15956 | 3414 | 12982 |
| | 18548 | 15665 | 21084 | 10824 | 18440 | 16819 | 3730 | 13940 | 18821 | 14864 | 1818 | |
| | | 10961 | | | | | | | | | | |
| | 19607 | 7969 | 6546 | 16771 | 5441 | 8459 | 18266 | 5000 | 15749 | 13014 | 14274 | 8444 |
| | 4707 | 13097 | 15930 | 11872 | 2621 | 7158 | 6942 | 18502 | 5408 | 10837 | 21928 | 13800 |
| | 5188 | 19614 | 16117 | 4719 | 1833 | 13499 | 3107 | 21492 | 12503 | 21929 | 7921 | 1429 |
| | 14398 | 22189 | 6439 | 12993 | 12307 | 19714 | 6650 | 18994 | 747 | 5932 | 18630 | 6683 |
| | 1921 | 15651 | 5594 | 6958 | 13597 | 19763 | 10097 | 14124 | 14687 | 1094 | 5780 | 7770 |
| | 7688 | 15110 | 5797 | 7907 | 21169 | 3329 | 12627 | 4065 | 19882 | 22067 | 19211 | 2061 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 7038 | 8909 | 16914 | 13129 | 19881 | 11720 | 16317 | 1551 | 13235 | 14888 | 1201 | 20264 |
| | 7800 | 7526 | 2209 | 5887 | 15285 | 10798 | 15317 | 10223 | 11351 | 10105 | 10661 | 15014 |
| | 2908 | 16412 | 22277 | 19851 | 12003 | 19616 | 11003 | 7768 | 6166 | 21613 | 4620 | 13850 |
| | 16231 | 7016 | 2717 | 20541 | 3458 | 1240 | 15787 | 20099 | 9282 | 11480 | 4994 | 937 |
| | 16775 | 18459 | 14476 | 9221 | 17450 | 6281 | 18662 | 7992 | 9661 | 19875 | 11156 | 3619 |
| | 14086 | 20948 | 16946 | 3456 | 6143 | 786 | 6709 | 5954 | 17926 | 20839 | 22351 | 13277 |
| | 11255 | 5140 | 4283 | 9455 | 4818 | 14459 | 5187 | 16668 | 10965 | 15558 | 17215 | 14289 |
| | 11685 | 4388 | 14119 | 18982 | 2984 | 11245 | 304 | 477 | 427 | 18112 | 965 | 2900 |
| | 2132 | 20312 | 4655 | 16568 | 21093 | 13882 | 5730 | 7976 | 7079 | 13035 | 5498 | 2800 |
| | 19337 | 9600 | 307 | 12545 | 2037 | 11704 | 9571 | 21379 | 3712 | 7685 | 4483 | 18456 |
| | 22341 | 11197 | 13107 | 16006 | 7623 | | | | | | | |
| 533: | 6090 | 1006 | 429 | 10217 | 10250 | 19910 | 18933 | 314 | 18461 | 5240 | 6367 | 19001 |
| | 16913 | 19119 | 526 | 3693 | 7812 | 13179 | 534 | 300 | 531 | 2857 | 17664 | 21589 |
| | 11961 | 19154 | 21437 | 11195 | 20933 | 21506 | 3533 | 4677 | 18511 | 4730 | 696 | 9569 |
| | 17797 | 18687 | 7097 | 20259 | 15252 | 13221 | 450 | 11335 | 20777 | 12713 | 22502 | 14915 |
| | 21157 | 20371 | 3563 | 12591 | 16308 | 7626 | 4212 | 19798 | 19458 | 5691 | 18292 | 16130 |
| | 21296 | 2832 | 830 | 14553 | 6434 | 18295 | 17956 | 829 | 476 | 12043 | 20779 | 1281 |
| | 17745 | 16586 | 7955 | 12705 | 15449 | 988 | 20859 | 1768 | 11129 | 6547 | 22518 | 5552 |
| | 9854 | 11376 | 6669 | 5359 | 9132 | 10964 | 1879 | 22087 | 13137 | 17298 | 3333 | 13752 |
| | 20301 | 19370 | 2425 | 6946 | 19538 | 14273 | 15603 | 15340 | 6427 | 17165 | 12419 | 10809 |
| | 8003 | 13658 | 14064 | 4221 | 7387 | 13284 | 20981 | 2316 | 3116 | 8418 | 3386 | 6508 |
| | 18217 | 3578 | 22249 | 992 | 13442 | 34711 | 48551 | 9949 | 5277 | 19885 | 2816 | 10917 |
| | 9436 | 18538 | 18659 | 12816 | 12308 | 15943 | 2515 | 20364 | 14701 | 8193 | 17579 | 22076 |
| | 8890 | 2649 | 9329 | 21073 | 8376 | 15177 | 10882 | 859 | 5990 | 9814 | 16053 | 5209 |
| | 3144 | 13848 | 22428 | 19076 | 5454 | 17056 | 14918 | 4088 | 11270 | 5837 | 9604 | 22455 |
| | 19840 | 12234 | 1149 | 801 | 953 | 9960 | 21301 | 1656 | 3755 | 12278 | 22119 | 21098 |
| | 1005 | 10264 | 13037 | 11702 | 20954 | 5581 | 5063 | 1118 | 6454 | 20632 | 1696 | 19474 |
| | 14911 | 9381 | 4111 | 13374 | 2932 | 3071 | 18551 | 22362 | 1431 | 12923 | 6509 | 19229 |
| | 14012 | 5372 | 12362 | 17380 | 20272 | 16391 | 13395 | 5132 | 901 | 9540 | 19228 | 11589 |
| | 13306 | 3179 | 14568 | 17630 | 2371 | 4694 | 12396 | 15369 | 11784 | 16597 | 3697 | 10741 |
| | 16309 | 4927 | 13396 | 21621 | 8841 | 16662 | 11120 | 14081 | 8692 | 9484 | 15204 | 6565 |
| | 14320 | 2978 | 9294 | 7482 | 9493 | 1277 | 4952 | 7813 | 7306 | 12296 | 12021 | 6645 |
| | 9286 | 22489 | 13745 | 16653 | 19069 | 7780 | 15219 | 16969 | 14762 | 18330 | 10280 | 10802 |
| | 10479 | 16663 | 3678 | 16713 | 7751 | 13703 | 3630 | 4691 | 9472 | 10709 | 8542 | 7060 |
| | 6112 | 22457 | 21974 | 20476 | 7333 | 6482 | 14526 | 7151 | 2644 | 835 | 10655 | 12264 |
| | 9315 | 2786 | 16253 | 9488 | 5634 | 17372 | 788 | 9280 | 22095 | 18903 | 3706 | 15256 |
| | 18593 | 5764 | 11115 | 12583 | 11568 | 13613 | 2331 | 5136 | 8073 | 15998 | 5630 | 11304 |
| | 19137 | 5817 | 5580 | 18341 | 8588 | 12540 | 2454 | 4970 | 17445 | 2401 | 11869 | 6193 |
| | 21516 | 2447 | 10889 | 5190 | 13207 | 16465 | 9673 | 9771 | 11716 | 18575 | 9584 | 12794 |
| | 21399 | 20485 | 9218 | 18691 | 3350 | 18263 | 4846 | 544 | 19667 | 9933 | 4140 | 1318 |
| | 20418 | 11128 | 20105 | 16734 | 2376 | 15699 | 7061 | 4232 | 15357 | 14036 | 5339 | 7107 |
| | 19030 | 7165 | 21370 | 12103 | 4848 | 13211 | 22530 | 15360 | 12863 | 9975 | 6398 | 14067 |
| | 16683 | 21170 | 1924 | 890 | 8155 | 15866 | 10131 | 7187 | 4332 | 1235 | 20330 | 12927 |
| | 7088 | 5099 | 2302 | 12424 | 8303 | 17466 | 14322 | 11383 | 2282 | 15956 | 3414 | 12982 |
| | 18548 | 15665 | 10961 | 21084 | 10824 | 18440 | 16819 | 3730 | 13940 | 18821 | 14864 | 1818 |
| | 19607 | 7969 | 6546 | 16771 | 5441 | 8459 | 18266 | 5000 | 15749 | 13014 | 14274 | 8444 |
| | 4707 | 13097 | 15930 | 11872 | 2621 | 7158 | 6942 | 18502 | 5408 | 10837 | 21928 | 13800 |
| | 5188 | 19614 | 16117 | 4719 | 1833 | 13499 | 3107 | 21492 | 12503 | 21929 | 7921 | 1429 |
| | 14398 | 22189 | 747 | 6439 | 12993 | 12307 | 19714 | 6650 | 18994 | 5932 | 18630 | 6683 |
| | 1921 | 15651 | 5594 | 6958 | 13597 | 19763 | 10097 | 4065 | 14124 | 14687 | 1094 | 5780 |
| | 7770 | 7688 | 15110 | 5797 | 7907 | 21169 | 3329 | 12627 | 19882 | 22067 | 19211 | 2061 |
| | 7038 | 8909 | 16914 | 13129 | 19881 | 16317 | 1551 | 13235 | 14888 | 1201 | 20264 | 7800 |
| | 7526 | 2209 | 5887 | 10223 | 10798 | 15317 | 11351 | 10105 | 10661 | 15014 | 2908 | 16412 |
| | 22277 | 19851 | 12003 | 19616 | 11003 | 7768 | 6166 | 4620 | 16231 | 13850 | 7016 | 2717 |
| | 20886 | 14522 | 5254 | 15519 | 20541 | 3458 | 1240 | 15787 | 20099 | 9282 | 11480 | 4994 |
| | 6281 | 18662 | 7992 | 9661 | 19875 | 11156 | 3619 | 14086 | 20948 | 16946 | 3456 | 6143 |
| | 786 | 6709 | 5954 | 17926 | 20839 | 22351 | 13277 | 15113 | 6368 | 7704 | 18694 | 3644 |
| | 12154 | 3794 | 21257 | 21638 | 18386 | 18111 | 21498 | 10731 | 13776 | 5539 | 14530 | 20282 |
| | 7762 | 9529 | 17675 | 15191 | 12380 | 14865 | 15825 | 2818 | 16442 | 5901 | 8220 | 18578 |
| | 13297 | 2495 | 21913 | 4526 | 16085 | 10965 | 15558 | 18982 | 2984 | 11245 | 21040 | 477 |
| | 11140 | 2132 | 20312 | 4655 | 16568 | 21093 | 13882 | 5730 | 7976 | 7079 | 13035 | 2800 |
| | 15563 | 509 | 12545 | 2037 | 11704 | 9571 | 21379 | 3712 | 7685 | 4483 | 18456 | 22341 |
| | 11197 | 13107 | 13802 | 16006 | 428 | | | | | | | |
| 534: | 6383 | 10450 | 1006 | 8266 | 17986 | 13269 | 9010 | 9822 | 18387 | 3735 | 10217 | 533 |
| | 535 | 1774 | 16191 | 18891 | 13849 | 14706 | 571 | 8356 | 3340 | 18461 | 20284 | 20753 |
| | 10192 | 13836 | 5240 | 2653 | 20833 | 3564 | 1870 | 11250 | 6367 | 19001 | 20137 | 15672 |
| | 13176 | 20207 | 8314 | 4015 | 1887 | 8795 | 21466 | 7023 | 18171 | 6876 | 8560 | 16477 |
| | 13630 | 10793 | 4136 | 5249 | 17099 | 9152 | 2730 | 4724 | 8684 | 5821 | 3710 | 16562 |
| | 22562 | 9500 | 21952 | 12129 | 1151 | 5863 | 2635 | 13579 | 5947 | 9543 | 6219 | 4851 |
| | 7812 | 10216 | 19130 | 12258 | 1950 | 8843 | 1084 | 2519 | 12495 | 7141 | 1845 | 6128 |
| | 9067 | 2618 | 1308 | 1202 | 16045 | 2887 | 3970 | 22176 | 2992 | 14189 | 2020 | 3687 |
| | 18669 | 17082 | 7279 | 10946 | 10754 | 10583 | 4481 | 915 | 16903 | 18701 | 14442 | 11182 |
| | 12710 | 8108 | 4737 | 8174 | 21990 | 14565 | 20445 | 20022 | 9861 | 2888 | 17080 | 6216 |
| | 3441 | 9629 | 4034 | 4019 | 17401 | 1207 | 22219 | 1481 | 5143 | 2857 | 17664 | 21589 |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| | 11961 | 19154 | 12425 | 21437 | 17489 | 11195 | 20933 | 21506 | 35331 | 2843 | 4677 | 18511 |
| | 4730 | 696 | 9569 | 17797 | 18687 | 7097 | 20259 | 20966 | 15252 | 13221 | 11335 | 20777 |
| | 12713 | 22502 | 14915 | 21157 | 13596 | 7735 | 6111 | 14062 | 20371 | 3563 | 12591 | 16308 |
| | 7626 | 21483 | 4212 | 19798 | 19458 | 5691 | 18292 | 16130 | 21296 | 2832 | 830 | 14553 |
| | 4632 | 6434 | 18295 | 17956 | 829 | 12043 | 1189 | 3932 | 18731 | 6845 | 21360 | 6772 |
| | 19039 | 21673 | 20779 | 1281 | 16128 | 14568 | 17630 | 2371 | 4694 | 12396 | 15369 | 14260 |
| | 13396 | 21621 | 8841 | 16662 | 11120 | 14081 | 6657 | 8692 | 9484 | 14065 | 2540 | 15204 |
| | 6565 | 14320 | 2978 | 9294 | 7482 | 9493 | 1277 | 4952 | 7813 | 7306 | 12296 | 12021 |
| | 6645 | 9286 | 22489 | 19908 | 893 | 14762 | 18330 | 10802 | 10479 | 16663 | 3678 | 16713 |
| | 7751 | 13703 | 3630 | 4691 | 9472 | 10709 | 8542 | 7060 | 6112 | 22457 | 21974 | 20476 |
| | 7333 | 6482 | 14526 | 7151 | 2644 | 835 | 10655 | 12264 | 9315 | 2786 | 16253 | 9488 |
| | 5634 | 17372 | 2081 | 12643 | 15099 | 7425 | 15838 | 10094 | 788 | 3348 | 9280 | 22095 |
| | 18903 | 3706 | 15256 | 18593 | 5764 | 11115 | 12583 | 5630 | 11568 | 13613 | 2331 | 5136 |
| | 8073 | 15998 | 11304 | 19137 | 5817 | 4430 | 5580 | 8588 | 18341 | 12540 | 2454 | 4970 |
| | 17445 | 2401 | 10889 | 5190 | 13207 | 16465 | 11291 | 16479 | 21467 | 4263 | 2705 | 9673 |
| | 20541 | 3458 | 1240 | 15787 | 20099 | 9282 | 11480 | 4994 | 2798 | 5475 | 1814 | 2683 |
| | 8435 | 4345 | 3627 | 15897 | 9366 | 6281 | 20716 | 18662 | 7992 | 9661 | 19875 | 11156 |
| | 21818 | 3619 | 14086 | 20948 | 16946 | 3456 | 6143 | 786 | 6709 | 5954 | 17926 | 20839 |
| | 13891 | 10965 | 15558 | 15276 | 3513 | 17600 | 11426 | 1123 | 16786 | 5326 | 17407 | 18982 |
| | 2984 | 19817 | 11245 | 5838 | 21039 | 15310 | 2132 | 20312 | 4655 | 16568 | 21093 | 13882 |
| | 5730 | 7976 | 7079 | 13035 | 2800 | 16353 | 4982 | 22032 | 3731 | 7388 | 13436 | 8698 |
| | 509 | 12545 | 2037 | 11704 | 9571 | 21379 | 3712 | 7685 | 4483 | 18456 | 22341 | 15886 |
| | 11197 | 13107 | 5444 | 16006 | 9573 | 20805 | 372 | 19913 | 9499 | 18057 | 7973 | 22459 |
| | 21704 | 8464 | | | | | | | | | | |
| 535: | 9382 | 1006 | 429 | 10217 | 2438 | 9883 | 314 | 18461 | 5240 | 6367 | 19001 | 16674 |
| | 12484 | 526 | 11896 | 7812 | 9819 | 2857 | 17664 | 21589 | 11961 | 19154 | 21437 | 11195 |
| | 20933 | 2150 | 63533 | 4677 | 18511 | 4730 | 696 | 9569 | 17797 | 18687 | 7097 | 20259 |
| | 15252 | 13221 | 450 | 11335 | 20777 | 12713 | 22502 | 14915 | 21157 | 20371 | 3563 | 12591 |
| | 16308 | 7626 | 4212 | 19798 | 19458 | 5691 | 18292 | 16130 | 21296 | 2832 | 830 | 14553 |
| | 6434 | 18295 | 17956 | 829 | 476 | 12043 | 20779 | 1281 | 17745 | 16586 | 7955 | 12705 |
| | 15449 | 988 | 20859 | 1768 | 11129 | 6547 | 22518 | 5552 | 9854 | 11376 | 6669 | 5359 |
| | 9132 | 10964 | 1879 | 22087 | 13137 | 17298 | 3333 | 13752 | 20301 | 19370 | 2425 | 6946 |
| | 19538 | 14273 | 15340 | 6427 | 17165 | 15603 | 12419 | 10809 | 8003 | 13658 | 14064 | 4221 |
| | 7387 | 13284 | 20981 | 2316 | 3116 | 8418 | 3386 | 6508 | 18217 | 3578 | 22249 | 992 |
| | 14855 | 13442 | 3471 | 19949 | 5277 | 19885 | 2816 | 10917 | 9436 | 18538 | 18659 | 12816 |
| | 12308 | 15943 | 2515 | 20364 | 14701 | 8193 | 17579 | 22076 | 8890 | 2649 | 9329 | 21073 |
| | 8376 | 15177 | 10882 | 859 | 5990 | 9814 | 16053 | 5209 | 3144 | 13848 | 22428 | 19076 |
| | 5454 | 17056 | 14918 | 4088 | 11270 | 5837 | 9604 | 22455 | 19840 | 12234 | 1149 | 801 |
| | 953 | 9960 | 21301 | 1656 | 3755 | 12278 | 22119 | 21098 | 1005 | 10264 | 13037 | 11702 |
| | 20954 | 5581 | 5063 | 1118 | 6454 | 20632 | 1696 | 19474 | 14911 | 9381 | 4111 | 13374 |
| | 2932 | 3071 | 18551 | 22362 | 1431 | 12923 | 6509 | 19229 | 14012 | 5372 | 12362 | 17380 |
| | 20272 | 16391 | 13395 | 5132 | 901 | 9540 | 19228 | 14568 | 17630 | 2371 | 4694 | 12396 |
| | 15369 | 16597 | 3697 | 10741 | 16309 | 4927 | 13396 | 21621 | 8841 | 16662 | 11120 | 14081 |
| | 8692 | 9484 | 15204 | 6565 | 14320 | 2978 | 9294 | 7482 | 9493 | 1277 | 4952 | 7813 |
| | 7306 | 12296 | 12021 | 6645 | 9286 | 22489 | 13745 | 16653 | 19069 | 7780 | 15219 | 16969 |
| | 14762 | 18330 | 10802 | 10479 | 16663 | 3678 | 16713 | 7751 | 13703 | 3630 | 4691 | 9472 |
| | 10709 | 8542 | 7060 | 6112 | 22457 | 21974 | 20476 | 7333 | 6482 | 14526 | 7151 | 2644 |
| | 835 | 10655 | 12264 | 9315 | 2786 | 16253 | 9488 | 5634 | 17372 | 788 | 9280 | 22095 |
| | 18903 | 3706 | 15256 | 18593 | 5764 | 11115 | 12583 | 11568 | 13613 | 2331 | 5136 | 8073 |
| | 15998 | 5630 | 11304 | 19137 | 5817 | 5580 | 8588 | 18341 | 12540 | 2454 | 4970 | 17445 |
| | 2401 | 11869 | 6193 | 21516 | 10889 | 5190 | 13207 | 16465 | 9673 | 9771 | 11716 | 18575 |
| | 9584 | 12794 | 21399 | 20485 | 9218 | 18691 | 3350 | 18263 | 4846 | 544 | 19667 | 9933 |
| | 4140 | 1318 | 20418 | 11128 | 20105 | 16734 | 2376 | 15699 | 7061 | 4232 | 15357 | 14036 |
| | 5339 | 7107 | 19030 | 7165 | 21370 | 12103 | 4848 | 13211 | 22530 | 15360 | 12863 | 9975 |
| | 6398 | 14067 | 16683 | 21170 | 1924 | 890 | 8155 | 15866 | 10131 | 7187 | 4332 | 1235 |
| | 20330 | 12927 | 7088 | 5099 | 2302 | 12424 | 8303 | 17466 | 14322 | 11383 | 2282 | 15956 |
| | 3414 | 12982 | 18548 | 15665 | 10961 | 21084 | 10824 | 18440 | 16819 | 3730 | 13940 | 18821 |
| | 14864 | 1818 | 19607 | 7969 | 6546 | 16771 | 5441 | 8459 | 18266 | 5000 | 15749 | 13014 |
| | 14274 | 8444 | 4707 | 13097 | 15930 | 11872 | 2621 | 7158 | 6942 | 18502 | 5408 | 10837 |
| | 21928 | 13800 | 5188 | 19614 | 16117 | 4719 | 1833 | 13499 | 3107 | 21492 | 12503 | 21929 |
| | 7921 | 1429 | 14398 | 22189 | 6439 | 12993 | 12307 | 19714 | 6650 | 18994 | 747 | 5932 |
| | 18630 | 6683 | 1921 | 15651 | 5594 | 6958 | 13597 | 19763 | 10097 | 14124 | 14687 | 1094 |
| | 5780 | 7770 | 7688 | 15110 | 5797 | 7907 | 21169 | 3329 | 19882 | 12627 | 4065 | 22067 |
| | 19211 | 2061 | 7038 | 8909 | 16914 | 13129 | 19881 | 16317 | 1551 | 13235 | 14888 | 1201 |
| | 20264 | 7800 | 7526 | 2209 | 5887 | 10798 | 15317 | 10223 | 11351 | 10105 | 10661 | 15014 |
| | 2908 | 16412 | 22277 | 19851 | 12003 | 19616 | 11003 | 7768 | 6166 | 4620 | 13850 | 16231 |
| | 7016 | 2717 | 20541 | 3458 | 1240 | 15787 | 20099 | 9282 | 11480 | 4994 | 6281 | 18662 |
| | 7992 | 9661 | 19875 | 11156 | 3619 | 14086 | 20948 | 16946 | 3456 | 6143 | 786 | 6709 |
| | 5954 | 17926 | 20839 | 22351 | 13277 | 15113 | 6368 | 7704 | 18694 | 3644 | 12154 | 3794 |
| | 21257 | 21638 | 18386 | 18111 | 21498 | 10731 | 13776 | 5539 | 14530 | 20282 | 7762 | 9529 |
| | 17675 | 15191 | 12380 | 14865 | 15825 | 2818 | 16442 | 5901 | 8220 | 18578 | 13297 | 2495 |
| | 21913 | 4526 | 16085 | 10965 | 15558 | 18982 | 2984 | 11245 | 16474 | 304 | 477 | 427 |
| | 5067 | 2132 | 20312 | 4655 | 16568 | 21093 | 13882 | 5730 | 7976 | 7079 | 13035 | 2800 |
| | 20416 | 509 | 307 | 305 | 12545 | 2037 | 11704 | 9571 | 21379 | 3712 | 7685 | 4483 |
| | 18456 | 22341 | 11197 | 13107 | 13268 | 16006 | 428 | | | | | |

TABLE 17-continued

Sequence IDs for homolog proteins

| Seq ID NO: | homolog Seq ID NOs | | | | | | | | | | | |
|---|---|---|---|---|---|---|---|---|---|---|---|---|
| 536: | 8250 | 5293 | 17519 | 10969 | 8775 | 16532 | 10286 | 11811 | 5689 | 2871 | 680 | 20415 |
| | 14104 | 16888 | 17043 | 10273 | 6777 | 22396 | 602 | 4866 | 12333 | 9909 | 22327 | 4344 |
| | 9005 | 16476 | 2573 | 10616 | 19638 | 15657 | 8950 | 4378 | 2657 | 3364 | 21708 | 985 |
| | 6316 | 8776 | 2238 | 13856 | 1099 | 10466 | 19656 | 6879 | 9313 | 19604 | 12069 | 8122 |
| | 21385 | 16087 | 20487 | 1424 | 14078 | 2427 | 4175 | 7418 | 9385 | 16892 | 15809 | 3499 |
| | 16714 | 5768 | 6322 | 13627 | 19469 | 8252 | 19551 | 14976 | 12742 | 10499 | 11322 | 9597 |
| | 3569 | 9336 | 20132 | 5283 | 22127 | 10381 | 3149 | 7067 | 13886 | 7478 | 3897 | 20869 |
| | 19398 | 13086 | 4191 | 3669 | 20800 | 6799 | 8453 | 17539 | 21956 | 5724 | 13878 | 16687 |
| | 1797 | | | | | | | | | | | |
| 537: | 12225 | 7991 | 19769 | 20707 | 6346 | 21228 | 18920 | 15677 | 22007 | 17216 | 1246 | 1299 |
| | 3482 | 8428 | 4864 | 1869 | 18259 | 5076 | 18894 | 10621 | 1194 | 21241 | 4280 | 10372 |
| | 9939 | 3461 | 22101 | 14388 | 9687 | 1934 | 3266 | 19426 | 6888 | 17781 | 1697 | 1251 |
| | 15687 | 11467 | 11444 | 7248 | 4960 | 3598 | 18026 | 17460 | 7270 | 18737 | 20522 | 18581 |
| | 16569 | 13403 | 4999 | 20923 | 3253 | 12847 | 6541 | 12065 | 13811 | 442 | 18246 | 10039 |
| | 21176 | 20831 | 13532 | 19077 | 10287 | 9635 | 12724 | 898 | 4347 | 11482 | 12691 | 8702 |
| | 12055 | 8006 | 14571 | 19675 | 16542 | 21229 | 14891 | 11459 | 15395 | 15872 | 9301 | 10051 |
| | 6843 | 5509 | 11707 | 10865 | 18908 | 12031 | 9844 | 20469 | 4041 | 4623 | 22346 | 1849 |
| | 12095 | 14281 | 3840 | 16733 | 15322 | 21786 | 17305 | 10611 | 1428 | 7631 | 22045 | 6676 |
| | 5894 | 8015 | 21902 | 14896 | 17330 | 3090 | 15122 | 7759 | 6196 | 16678 | 475 | 20224 |
| | 3032 | 21119 | 21396 | 1165 | 20759 | 22152 | 18157 | 1337 | 3062 | 12222 | 10847 | 14596 |
| | 3679 | 21087 | 17626 | 3743 | 10092 | 21220 | 22333 | 4831 | 6340 | 2684 | 14394 | 17353 |
| | 12317 | 2073 | 22147 | 10166 | 9664 | 11412 | 21185 | 7389 | 11862 | 11526 | 9220 | 2983 |
| | 5429 | 13258 | 10529 | 12270 | 6868 | 5672 | 2355 | 11711 | 9314 | 17713 | 6624 | 12386 |
| | 17898 | 3480 | 10028 | 20275 | 1292 | 12254 | 17594 | 20642 | 4853 | 10383 | 4591 | 8186 |
| | 16379 | 15333 | 9201 | 15765 | 17720 | 5294 | 9934 | 7376 | 4038 | 2297 | 1916 | 7144 |
| | 16736 | 10304 | 3319 | 3762 | 20614 | 11341 | 10440 | 4734 | 9677 | 12289 | 20772 | 4271 |
| | 19954 | 22175 | 3020 | 19748 | 16083 | 8948 | 19737 | 22114 | 2955 | 21137 | 3274 | 1408 |
| | 6780 | 10848 | 7124 | 14060 | 11449 | 17939 | 4794 | 16058 | 21761 | 10251 | 4961 | 19141 |
| | 1661 | 9701 | 6223 | 5983 | 18048 | 10670 | 17196 | 1709 | 4904 | 12196 | 630 | 8403 |
| | 8582 | 6184 | 18819 | 3380 | 9202 | 16022 | 17350 | 12703 | 15237 | 17792 | 4597 | 11159 |
| | 1072 | 20441 | 15476 | 15612 | 17341 | 12261 | 21044 | 4892 | 1108 | 1406 | 22046 | 18198 |
| | 6967 | 20318 | 12469 | 22123 | 7645 | 10452 | 1264 | 712 | 14602 | 6109 | 14712 | 22157 |
| | 7745 | 16695 | 11050 | 22271 | 21574 | | | | | | | |
| 538: | 8633 | 21066 | 20486 | 15659 | 19893 | 20341 | 18625 | 7202 | 9210 | 15561 | 8243 | 19452 |
| | 10486 | 9599 | 20104 | 5911 | 17836 | 3744 | 3313 | 22371 | 13393 | 8083 | 14598 | 8878 |
| | 4121 | 11696 | 16024 | 6949 | 9760 | 18073 | 21021 | 1691 | 3955 | 13639 | 14076 | 5677 |
| | 2739 | 10860 | 20215 | 14300 | 10639 | 13585 | 11393 | 3392 | 7331 | 2940 | 4631 | 3646 |
| | 14037 | 5709 | 8396 | 7169 | 3234 | 9515 | 13640 | 21141 | 9848 | 13213 | 16854 | 10018 |
| | 17683 | 4171 | 20607 | 15041 | 2557 | 19483 | 17558 | 19443 | 20760 | 13774 | 16065 | 5097 |
| | 13747 | 713 | 8505 | 18788 | 18352 | 817 | 5302 | 8167 | 10335 | 22171 | 13497 | 18845 |
| | 11474 | 8093 | 22332 | 17185 | 18392 | 15387 | 7019 | 17613 | 13932 | 22281 | 9232 | 21810 |
| | 19046 | 14214 | 6221 | 10362 | 21188 | 12117 | 2909 | 9179 | 16519 | 21842 | 14950 | 5628 |
| | 5467 | 18729 | 7240 | 8434 | 11000 | 2806 | 17205 | 1863 | 9645 | 18886 | 6782 | 20838 |
| | 7708 | 6070 | 7788 | 22286 | 19842 | 16891 | 9527 | 18008 | 7791 | 11889 | 5849 | 2006 |
| | 3823 | 12758 | 17857 | 15410 | 11552 | 11047 | 5550 | 18384 | 903 | 18870 | 12346 | 18758 |
| | 1298 | 11723 | 11231 | 13187 | 11334 | 10943 | 11898 | 11754 | 4492 | 6688 | 19935 | 13184 |
| | 13651 | 1487 | 20841 | 6884 | 6464 | 8803 | 16050 | 6362 | 1430 | 1363 | 10992 | 6297 |
| | 3031 | 2620 | 18570 | 22021 | 21438 | 13674 | 22415 | 1440 | 6599 | 17348 | 16403 | 2064 |
| | 5725 | 621 | 12956 | 13371 | 3689 | 813 | 8410 | 17547 | 5880 | 7069 | 7272 | 13965 |
| | 9296 | 18273 | 16456 | 7801 | 2112 | 17834 | 8758 | 7378 | 19838 | 6388 | 10579 | 19671 |
| | 16279 | 806 | 14835 | 2530 | 4277 | 795 | 12076 | 5622 | 13454 | 3935 | 4559 | 18529 |
| | 18155 | 19209 | 15646 | 5247 | 6539 | 16369 | 5499 | 21300 | 14158 | 12126 | 17163 | 16184 |
| | 993 | 21342 | 16623 | 17172 | 10687 | 11363 | 1456 | 21186 | 21282 | 21603 | 10623 | 6475 |
| | 17459 | 18745 | 21602 | 9996 | 3042 | 16551 | 1505 | 5224 | 5300 | 3833 | 4119 | 10925 |
| | 11838 | 21509 | 15409 | 13868 | 11753 | 16835 | 13881 | 7206 | 18880 | 6510 | 4201 | 3942 |
| | 968 | 5155 | 13073 | 10765 | 5458 | 12673 | 3180 | 3108 | 15770 | 908 | 21482 | 5413 |
| | 18381 | 14279 | 4351 | 15582 | 22158 | 16937 | 12412 | 13635 | 14711 | 5969 | 9888 | 21962 |
| | 11801 | 16194 | 10513 | 4703 | 11781 | 15593 | 17383 | 18258 | 9184 | 7699 | 9109 | 1971 |
| | 18780 | 3171 | 11419 | 10405 | 631 | 15583 | 21710 | 7483 | 5744 | 22254 | 12810 | 13894 |
| | 20089 | 6909 | 5948 | 3120 | 15669 | 17412 | 19244 | 2016 | 16850 | 22002 | 7260 | 14202 |
| | 3293 | 4461 | 2271 | 14582 | 18598 | 17872 | 1569 | 18470 | 5671 | 8965 | 4082 | 7327 |
| | 22511 | 15167 | 1160 | 15734 | 5450 | 19432 | 14387 | 14587 | 3176 | 8359 | 18160 | 11357 |
| | 15085 | 6948 | 5337 | 2567 | 10321 | 22182 | 10881 | 10168 | 18477 | 12537 | 19015 | 20260 |
| | 2170 | 18422 | 2440 | 3225 | 5484 | 1260 | 1822 | 7532 | 19248 | 7693 | 4353 | 10441 |
| | 2660 | 5734 | 10038 | 19976 | 3453 | 19019 | 1674 | 12312 | 16581 | 10232 | 3727 | 1523 |
| | 2140 | 22432 | 20580 | 9947 | 19324 | 20180 | 1384 | 2325 | 18901 | 10198 | 20110 | 9744 |
| | 9208 | 3182 | 14144 | 18875 | 14329 | 929 | 22054 | 2752 | 4524 | 986 | 977 | 21117 |
| | 9567 | 9679 | 12352 | 20957 | 4772 | 12912 | 19652 | 11510 | 5608 | 21827 | 13765 | 8183 |
| | 14331 | 13670 | 20503 | 12206 | 21116 | 22320 | 844 | 2226 | 21795 | 13733 | 11051 | 20995 |
| | 2615 | 7715 | 4478 | 2290 | 12549 | 15082 | 2491 | 2301 | 14182 | 15076 | 1227 | 10071 |
| | 3792 | 13186 | 4722 | 1595 | 10880 | 11269 | 8528 | 3213 | 14537 | 4257 | 8761 | 17108 |
| | | 4834 | 2651 | 19705 | 3355 | 7552 | 6681 | | | | | |

Example 3

Consensus Sequence Build

ClustalW program was selected for multiple sequence alignments of the amino acid sequence of SEQ ID NO: 379 and 10 homologs. Three major factors affecting the sequence alignments dramatically are (1) protein weight matrices; (2) gap open penalty; (3) gap extension penalty. Protein weight matrices available for ClustalW program include Blosum, Pam and Gonnet series. Those parameters with gap open penalty and gap extension penalty were extensively tested. On the basis of the test results, Blosum weight matrix, gap open penalty of 10 and gap extension penalty of 1 were chosen for multiple sequence alignment. Attached are the sequences of SEQ ID NO: 379, its homologs and the consensus sequence SEQ ID NO: 22569 at the end. The symbols for consensus sequence are (1) uppercase letters for 100% identity in all positions of multiple sequence alignment output; (2) lowercase letters for >=70% identity; symbol; (3) "X" indicated <70% identity; (4) dashes "–" meaning that gaps were in >=70% sequences.

```
SEQ ID NO
 2406     --------------------------MGSNGGSSNNNNNKVLEKPGQDQLVQQQQQQQE-
15414     --------------------------MGSNGGSSNNNNNKVLEKPGQDQLVQQQQHPQE-
  587     ------------------------------------MMGRVMEKPSQDLLQQQQQ-----
 9696     ------------------------------------MMGRVMEKPSQDLLQQQQQ-----
 5895     ------------------------------------MMGRVMEKPSQDLLQQQQQ-----
17251     MFGNGNCDVDNEKTIITSSKWTQSEIDDHKVSMASSTGNRVMEKPGQELLQQQQQ-----
19549     -----------------------------------------MEKQGQELLQQHHQQQQQQ
  379     ----------------------------------MQSKNMIVASSHQQQQQQQPQQPQP
21357     --------MGLSSKQVSSSGLDWKQTLLEAQNLELPKPNLMRKQQQQQQQQQQQTQPNSE
17711     --------MGLSSKQVSSSGLDWKQTLLEAQNLELPKPNLMRKQQQQQQQQQQQTQPNSE
13715     -----------------------------------LTLTKCCMQRGSHFRSRSGSQEARS
consensus --------------------------xxxxxxxxxxxxxxxxxxxxxqxxxqqqxxxxxx
22569

APKCPRCDSSNTKFCYYNNYSLSQPRHFCKACKRYWTRGGTLRNVPVGGGCRRNKRVKRP
APKCPRCDSSNTKFCYYNNYSLSQPRHFCKACKRYWTRGGTLRNVPVGGGCRRNKRVERP
ALKCPRCESSNTKFCYYNNYSLSQPRHFCKACKRYWTRGGTLRNVPVGGGCRKNKRVKRP
ALKCPRCESSNTKFCYYNNYSLSQPRHFCKACKRYWTRGGTLRNVPVGGGCRKNKRVKRP
ALKCPRCESSNTKFCYYNNYSLSQPRHFCKACKRYWTRGGTLRNVPVGGGCRKNKRVKRP
ALRCPRCDSSNTKFCYYNNYSLTQPRHFCKACKRYWTRGGTLRNVPVGGGCRKNKRLKRP
ALKCPRCDSSNTKFCYYNNYSLSQPRHFCKACKRYWTRGGTLRNVPVGGGYRRNNKRSTS
QLKCPRCDSSNTKFCYYNNYSLSQPRHFCKACKRYWTRGGTLRNVPVGGSYRKNKRVKRP
SLKCPRCDSTNTKFCYYNNYNKSQPRHFCRACKRHWTKGGTLRNVPVGG-GRKNKRVKKS
SLKCPRCDSTNTKFCYYNNYNKSQPRHFCRACKRHWTKGGTLRNVPVGG-GRKNKRVRKS
GSSMSRCNSMDTKFCYYNNYNVNQPRHFCKNCQRYWTAGGSMRNVPVGAGRRKNKHTGSV
xlkcpRCxSsnTKFCYYNNYslsQPRHFCkaCkRyWTrGGtlRNVPVGggxRkNkrvxxx

LITTNPSSAAIDTAASNNSSN-SSSAPLQPPIDTASTS--------------NHINPLFY
ITSPCSAAIDTASNSSNSSSAPTAAASLQPQIDTASTS--------------NHINPLFY
TNHGDSSSSAANSPSSSNSNPPSQPHLDNIIASSSTTN------------HINNISPFFY
TNHGDSSSSAANSPSSSNSNPPSQPHIDNIIASSSTTN------------HINNISPFFY
TNHGDSSSSAANSPSSSNSNPPSQPHIDNIIASSSTTN------------HINNISPFFY
TYPCSNNNNIDFSASPSSSTPSSVVANPNPPSQSQQQQQQQQHHSFDIAATSNHINTMLY
SSNGPTSTTTLIKRPISTIETATTSNSSSPSSTHSSTS--------------NHMNPMFY
------STATTTTASTVSTTNSSSPNNPHQISHFSSMN----------------HHPLFY
ITPITTSSTTTTPITTATSTCTATVTTSIGNNNNNMDAMLG----------CYSHMTIQT
ITTPITTSSTTTHQSQPPLQLALPQSQPQLATTTTTWMLCW----------VVIAT----
YRHTVITPDSLASLQVDGPDLVDHKPLSPFKVNGTILKFG--------------PDAPLC
xxxxxxxxxxxxxxxxxxxxxxxxxxxxxxxxxxxxxxxx----------xxxxxxxxxy

GLPSSS-SDVNLPLFSRFGSRISSS----GFDLQLNNALGLGFSSGVLSNEASDNNGYR-
GLPSSS-SDVNLPLFSRFGSRISSS----GFDLQLNNALGLGFSSRVLSNEASDNNRYR-
GG-----DVMSSVPFPRFNLHSQLN------------ALGLGFSTGVSENGFSTSNNN--
GG-----DVMSSVPFPRFNLHSQLN------------ALGLGFSTGVSENGFSTSNNN--
GG-----DVMSSVPFPRFNLHSQLN------------ALGLGFSTGVSENGFSTSNNN--
GGNSCH-DVMNFPFSTRFNSTTRVSNPASGYDNLPQNGLGLGFSSGILMSAAGGEVNLNH
GLSSTNNPCDPNLPFSRFNITSRLSTSSGYDLQPQMNFFGLGFSSGFENNGYTNGFNTS-
GLSDHMSSCNNNLPMIPSRFSDSSK-----------TCSSSGLESEFLSSGFSSLSALG-
PLADDQKNMSSSLYQALIRPPPLLLQQQNLLNTRELEGKDFGIGIGNGNNGIFPSSTLAL
------------------------------------------------------------
ESMASILNLGEQNLSSQLDFTAGAE-----------NREETSCSSACKPVKKKDITQHN-
gxxxxxxxxxxxxxxxxxxxxxxxx----xxxxxxxxxxxxgxsxxxxxxxxxxxxxxx-

-------------NWFGSNNTLLSSYTSTTSTTTPAMSSLLSSSLLQQKFMTDGVD----
-------------SGFGSNNMLLSSYTSTT-TTTPAMSSLLLQQKFISGGLKNDAD----
------------SFFSAYNSMFGSSSSSTCAPSTPVMASLLSSTLLQQNLMGGGG---GG
------------SFFSAYNSMFGSSSSSTCAPSTPVMASLLSCTLLQQNFMGGGG---GG
------------SFFSAYNSMFGSSSSSTCAPSTPVMASLLSSTLLQQKLMSGGG---GG
HHHHHHDEGSYRNGFSTSNNNNYSSIFGSSSTTTPVMASLLSSTLLQQKFMGTGGGIKGG
----------------NNNYDSIFSSSTSASNNTSVMPSVLSSTLLQHKFFDDGLK----
```

-continued

```
--------LGLPHQMSHDHTINGSFINNSTTNKPFLLSGLFGSSMSSSSTLLQHP-----
P-------------IPHQSQSLLFPFSASSRSFDTNPCSVVSTSLRSSNVYNYGED----
------------------------------------------------------------
------------------------------------------------------------
------------xxxxxxxxxxxxxxxxxxxxxxxxxxsxxxxxxxxxxxxxxxxx--xx

--------STNTFQHGLGLTPLEQLQMASDHSSEAGMVALKDVKVELGQNNRLEWNNGAA
--------SSNTFQHGLSLTSLEQLQIASDHSSEAGMVALKDVKVELGQNNNRLEWNGGA
VKGRDHDQGDNTFHGLAPLQGLRVEGDSNNNIGSKEVKGEGQNRFEWSNNNNNNNNNGGG
VKGRDHDQGDNTFHGLAPLQGLRVEGDSNNNIGSKEVKGEGQNRFEWSNNNNNNNNNGGG
EGEEVVIMIKVATLSMAWHRYKGCKWKGIIIIVIILAQKK--------------------
GGGGGGDDDPFHHHQEMDSKEVKLGEGLQNRLDQWNMNNLNGNGGAVFQNQMENMGLSDN
----------YGSDAGSNGAFQDLQFGSKMQNQMEHIGGFYDPASSIYLNATSSSAIGVW
----------HKPMNNGGDMLGQSHLQTLASLQDLHVGGNNEDMKYKEGKLDQISGNING
---------QFKAIEEPTINSTTATIVPSTGGTNNTHHPWEIAAATSGVGLGTSSNSNYW
------------------------------------------------------------
------------------------------------------------------------
xxxxxxxxxxxxxxxxxxxxxxxxxxxxxxxxxxxxxxxxxxxxxxxxxxxxxxxxxxxx

CQSQIQHVGLYDPSLYWNNSAATALGVWNDQAANIGSSVTSLI
FQSQIQHVGLYDPLLYWNN-SATALGVWNDQAANIGSSVTSLI
GQNQMEHVGLSDPNSLYWN-TATGLGAWSDQPNNIGPSVTSLI
GQNQMEHVGLSDPNSLYWN-TATGLGAWSDQPN-IGPSVTSLI
-----------------------------------------
NASLYWNNNHNNSNNNTSA-TATGLSSVWSTDQPGSNSVSSLI
NDQGANNIGSSVTSLI-------------------------
FMSSSSSLDPSNYNNMWNNASVVNGAWLDPTNNNVGSSLTSLI
NWEDFDSLVSTDLKDPWDDSDIKP-----------------
-----------------------------------------
-----------------------------------------
xxxxxxxxxxxxxxxxxxx-xxxxxxxxxxxxxxxxxxxxx
```

Example 4

Corn Transformation Construct

GATEWAY™ destination vectors (available from Invitrogen Life Technologies, Carlsbad, Calif.) are constructed for insertion of trait-improving DNA for corn transformation. The elements of each destination vector are summarized in Table 18 below and include a selectable marker transcription region and a DNA insertion transcription region. The selectable marker transcription region comprises a Cauliflower Mosaic Virus 35S promoter operably linked to a gene encoding neomycin phosphotransferase II (nptII) followed by both the 3' region of the *Agrobacterium tumefaciens* nopaline synthase gene (nos) and the 3' region of the potato proteinase inhibitor II (pinII) gene. The DNA insertion transcription region comprises a rice actin 1 promoter, a rice actin 1 exon 1 intron 1 enhancer, an att-flanked insertion site and the 3' region of the potato pinII gene. Following standard procedures provided by Invitrogen the att-flanked insertion region is replaced by recombination with trait-improving DNA, in a sense orientation for expression of a trait-improving protein and in a gene suppression orientation (i.e., either anti-sense orientation or in a sense- and anti-sense orientation) for a trait-improving suppression of a protein. Although the vector with trait-improving DNA inserted at the att-flanked insertion region is useful for plant transformation by direct DNA delivery, such as microprojectile bombardment, it is preferable to bombard target plant tissue with tandem transcription units that have been cut from the vector. For *Agrobacterium*-mediated transformation of plants the vector also comprises T-DNA borders from *Agrobacterium* flanking the transcription units.

Vectors for *Agrobacterium*-mediated transformation are prepared with each of the trait-improving genes having a sequence of SEQ ID NO:1 through SEQ ID NO:269 with the DNA solely in sense orientation for expression of the encoded, cognate trait-improving protein and in a gene suppression orientation for suppression of the cognate protein. Each vector is transformed into corn callus which is propagated into a plant that is grown to produce transgenic seed for each transgenic event. Progeny plants are self-pollinated to produce seed which is selected for homozygous seed. Homozygous seed is used for producing inbred plants, for introgressing the trait into elite lines, and for crossing to make hybrid seed. The progeny transgenic plants comprising the trait-improving DNA with a sequence of SEQ ID NO: 1 through SEQ ID NO: 269 have one or more improved traits identified by agronomic trait screening including, but not limited to, enhanced nitrogen use efficiency, increased yield, enhanced water use efficiency, growth under cold stress and enhanced oil, starch and protein levels. Transgenic corn including inbred and hybrids are also produced with DNA from each of the identified homologs of DNA of SEQ ID NO: 1 through SEQ ID NO: 269 to provide transgenic seeds and plants which are identified from total transgenic events by screening for the improved agronomic trait. Transgenic corn plants are also produced where the trait-improving DNA is transcribed by each of the promoters from the group selected from, a maize globulin 1 promoter, a maize oleosin promoter, a glutelin 1 promoter, an aldolase promoter, a zein Z27 promoter, a pyruvate orthophosphate dikinase (PPDK) promoter, a soybean 7S alpha promoter, a peroxiredoxin antioxidant (Per1) promoter and a CaMV 35S promoter.

Seed produced by the plants is provided to growers to enable production of corn crops with improved traits associated with the trait-improving DNA.

TABLE 18

| FUNCTION | ELEMENT | REFERENCE |
|---|---|---|
| DNA insertion transcription region | Rice actin 1 promoter | U.S. Pat. No. 5,641,876 |
| | Rice actin 1 exon 1, intron 1 enhancer | U.S. Pat. No. 5,641,876 |
| DNA insertion transcription region (att - flanked insertin region) | AttR1 | GATEWAY ™ Cloning Technology Instruction Manual |
| | CmR gene | GATEWAY ™ Cloning Technology Instruction Manual |
| | ccdA, ccdB genes | GATEWAY ™ Cloning Technology Instruction Manual |
| | attR2 | GATEWAY ™ Cloning Technology Instruction Manual |
| DNA insertion transcription region | Potato pinII 3' region | An et al., (1989) Plant Cell 1: 115-122 |
| selectable marker transcription region | CaMV 35S promoter | U.S. Pat. No. 5,858,742 |
| | nptII selectable marker | U.S. Pat. No. 5,858,742 |
| | nos 3region | U.S. Pat. No. 5,858,742 |
| | PinII 3' region | An et al., (1989) Plant Cell 1: 115-122 |
| *E. coli* maintenance region | ColE1 origin of replication | |
| | F1 origin of replication | |
| | Bla ampicillin resistance | |

Example 5

Soybean Transformation Construct

Constructs for use in transformation of soybean are prepared by restriction enzyme based cloning into a common expression vector. Elements of an exemplary common expression vector are shown in Table 19 below and include a selectable marker expression cassette and a gene of interest expression cassette. The selectable marker expression cassette comprises *Arabidopsis* act 7 gene (AtAct7) promoter with intron and 5'UTR, the transit peptide of *Arabidopsis* EPSPS, the synthetic CP4 coding region with dicot preferred codon usage and a 3' UTR of the nopaline synthase gene. The gene of interest expression cassette comprises a Cauliflower Mosaic Virus 35S promoter operably linked to a trait-improving gene in a sense orientation for expression of a trait-improving protein and in a gene suppression orientation (i.e., either anti-sense orientation or in a sense- and anti-sense orientation for a trait-improving suppression of a protein.

Vectors similar to that described above are constructed for use in *Agrobacterium* mediated soybean transformation systems, with each of the trait-improving DNA having a sequence of SEQ ID NO:1 though SEQ ID NO:269 and the respective identified homologs with the DNA in sense orientation for expression of the encoded, cognate protein and in a gene suppression arrangement for suppression of the cognate protein. Each vector is transformed into soybean embryo tissue to produce transgenic events which are grown into plants that produce progeny transgenic plants and seed for screening to identify the transgenic soybean plants of this invention that exhibit the enhanced agronomic trait imparted by DNA with a sequence of SEQ ID NO:1 through SEQ ID NO:269 or a respective homolog. The transgenic soybean plants of this invention are identified by agronomic trait screening including, but not limited to, enhanced nitrogen use efficiency, increased yield, enhanced water use efficiency, growth under cold stress and enhanced oil, starch and protein levels. Transgenic soybean plants are also produced where the trait-improving DNA is transcribed by a napin promoter and *Arabidopsis* SSU promoter.

Seed produced by the plants is provided to growers to enable production of soybean crops with improved traits associated with the trait-improving DNA.

TABLE 19

| Function | Element | Reference |
|---|---|---|
| Agro transformation | B-ARGtu.right border | Depicker, A. et al (1982) Mol Appl Genet 1: 561-573 |
| Antibiotic resistance | CR-Ec.aadA-SPC/STR | |
| Repressor of primers from the ColE1 plasmid | CR-Ec.rop | |
| Origin of replication | OR-Ec.oriV-RK2 | |
| Agro transformation | B-ARGtu.left border | Barker, R. F. et al (1983) Plant Mol Biol 2: 335-350 |
| Plant selectable marker expression cassette | *Arabidopsis* act 7 gene (AtAct7) promoter with intron and 5'UTR | McDowell et al., (1996) Plant Physiol. 111: 699-711. |
| | 5' UTR of *Arabidopsis* act 7 gene | |
| | Intron in 5'UTR of AtAct7 | |
| | Transit peptide region of *Arabidopsis* EPSPS | Klee, H. J. et at (1987) MGG 210: 437-442 |
| | Synthetic CP4 coding region with dicot preferred codon usage | |

TABLE 19-continued

| Function | Element | Reference |
|---|---|---|
| | A 3' UTR of the nopaline synthase gene of Agrobacterium tumefaciens Ti plasmid | U.S. Pat. No. 5,858,742 |
| Plant gene of interest expression cassette | Promoter for 35S RNA from CaMV containing a duplication of the −90 to −350 region | U.S. Pat. No. 5,322,938 |
| | Gene of interest insertion site | |
| | Cotton E6 3' end | GenBank accession U30508 |

Example 6

Cotton Transformation

Vectors similar to that described above for soybean transformation are constructed for use in 5 *Agrobacterium* mediated cotton transformation systems, with each of the trait-improving DNA having a sequence of SEQ ID NO:1 though SEQ ID NO:269 and the respective identified homologs with the DNA in sense orientation for expression of the encoded, cognate protein and in a gene suppression arrangement for suppression of the cognate protein. Each vector is transformed into cotton embryo tissue to produce transgenic events which are grown into plants that produce progeny transgenic plants and seed for screening to identify the transgenic soybean plants of this invention that exhibit the enhanced agronomic trait imparted by DNA with a sequence of SEQ ID NO:1 through SEQ ID NO:269 or a respective homolog. The transgenic cotton plants of this invention are identified by agronomic trait screening including, but not limited to, enhanced nitrogen use efficiency, increased yield, enhanced water use efficiency, growth under cold stress and enhanced oil, starch and protein levels. Transgenic cotton plants are also produced where the trait-improving DNA is transcribed by a napin promoter and *Arabidopsis* SSU promoter.

Seed produced by the plants is provided to growers to enable production of cotton crops with improved traits associated with the trait-improving DNA.

SEQUENCE LISTING (22569 sequences)

SEQ ID NO: 1 - DNA, 867 bp, Arabidopsis thaliana
atgagttcggctctacctttgaagcttttgttgcctcttacaacaacttcattgctaccttctcctttccgatcggataaccctaacttctatcgccgtcgttcctcttcctctacttcgtgttcttctcaatcccaatcgtttcagcttttctctgttagacgacgccgatccagatcctcctctccctctattcccatgtgctttcctgaacaaacgagagatcaagacgacgtggatagttgggtgaacaaagaggacaatgtgacttgtaggtttgactcagatgaagacaccaccaccaccggactccggattccaacacaagctcaagctatcgttgaaggacctggttcacttgctgtgtcggagctacaacgagtccctgatgtagattatatacaagaactgttggctatacagcaacaaggaccaagaacaattggcttctttggaactagaaatatgggtttcatgcatcaagagctcattcagattcttagctatgctatggttataactaaaaaccatatctacacatcaggtgcagctggaaccaatgcagctgttataagaggtgcacttagagcagagagaccagagcttcttacagttatcttacctcaaagtttgaaaaagcaacctcctgaaagccaggaactactgtcaaaagtacaaaacgtgatagaaaagcctcacaacgaccatttaccgttattagaagccagcaggctatgtaacatggatatcatatcacaagtgcaacaaatcatttgctttgcgtttcatgatagtaagcttctcatggagacatgtcaagaagctagaaatctccggaagattgttaccctcttctacctggattga

SEQ ID NO: 2 - DNA, 1107 bp, Arabidopsis thaliana
atgtcttctacaacaatcggcgagcacatcagactccgacgagctagaaaccaaacaatccgtcatctccacgccgccgacgatgatccgccgctaagccacgtcgttcttccgatttcacaacctaatcgcttctgtaactccgcaatgtcttccttctttcccctcccgacttcctcctccaacgaaagcacgaggaagaaaccgtaccaaacgtcgtcgtttcgagggatgggttgctatgccgcagcagcagcagcagctcaagaggtttctgttccctccgtcattcgctactccgcggatttggatgccagaattagaaaagataagaagaagaagaagcataagcataagaaaaagaaaaagaagaataaaggaagctacgaagatggttcgattaggattttaagcgaagaagctagagacgttattgatgtttggtgcagacctggattaggcttctccacggatgctgtaattggtcgatcggttgatcctcctcggggaaggaatattccgtcgtctcgtcgcaaaattgatgtggataacaacaattataatcacacactgggttcttctgttcttcccattcggtttctcaatcaagaaactcattctcatgatatcttcaactctgattctacttttgtgacatcatcacgcgctgaaccaacgatgttgtcaagtagatgtcgtggccatcttccacgctcttaccctgatgatcttaccgagatgaggatgctccagaatggttttgtaatgggaagaataacagattcccgtgataactaccacgaattgaggctcgatgttgatagcatgtcatacgagcaacttcttgagcttggtgatagaattggttatgtgaatactggactaaaagaaagcgagatacatcgttgtcttgggaaaatcaaaccatccgtatcacatactcttgttgatagaaaatgtagcatctgtcaggatgagtatgagagagaggatgaggttggggaattgaactgtggacacagctttcatgtccattgcgtgaaacaatggctttcgaggaagaatgcttgtccggtctgtaagaaggcagcatatggcaagccttaa

SEQ ID NO: 3 - DNA, 249 bp, Arabidopsis thaliana
atggagggtctaattccgttagtatacaaagccgtcatgcaaatccgttacggtaacgagtcgcagcaactttcttcttcttactacgttcgtcttcccggtgattcgggtcggtttgtaagatccgatttagatgtatcgggtcctggatctaattcctccaatagggcgtcgtcgtcgacaagcacaactacgtttgctgtttacgcgggagtccagtcacctgtttctcgtcaggttgtcacgtga

SEQ ID NO: 4 - DNA, 753 bp, Arabidopsis thaliana
atgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcaacaagatggaatgggagcaggaccaagtgtgaataattacatgttgggttggttaccttatgacaccaactctatttga

SEQ ID NO: 5 - DNA, 942 bp, Arabidopsis thaliana
atggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaa

SEQ ID NO: 6 - DNA, 1084 bp, Arabidopsis thaliana
ttaattaatgtgatgaaatcgatgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgtaagtcatattccgttatcataatcatgatcaactctttttttttttttttttttaattagcattttgttatattgtttcttggtatgtgtaggaaaggagattattttcgatatatggcagagtttggttctgatgctgaacgtaaagaaaatgcagataattctctagatgcatataaggtcttctttcaatcatgtttaccctcaactttaatattttattttcccctattttcttcgaaatattagtttggaaaaagcatggaaaaacatgaaaaaggcatatattttgtaggttgcaatggaaatggcagagaatagtttagcacccaccaatatggttagacttggattggctttaaatttctcgatattcaattatgagatccataaatctattgaaaggtaatatcacatttgcttataaataaaataagtgcggcgtttcaaaatctatcaaaaactttgtatatataataactaatttatattttcattgccaattaattttaatgaacagttttttacagttttttgaatatcttagtttcttacagttaactaatagtaattttatatgtgaatttatacagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttagaggcgcgcc

SEQ ID NO: 7 - DNA, 735 bp, Arabidopsis thaliana
atgccaaaaatcttgtggaaaagcctccatctttgcttcccgtcaaatctcaccaaatgctattcttcgccgtgtattcctccgtcctccgccgatcccgacggtatcatccaacctaaccgtccctccatcgttcttctcaataacttcaacctcctttaccacaatgacaaccaccaccacccccatcgtgtcattgacttaccttcttcctccaccacaaccactccggccgccacctcctcctcatccacgtcatcatatgaatctgatatctctcctgatgtatccgccgcttttgcttcccgtcgcttcttcttctcttcccctggtcggtccaatgcaatcaccgactcaccagaaccccggtcaagagaattctctgataattacgatgatgccactatcacgtcgacaaagaagaagaaaaagaaggtttatgataattccgtgactactactactacgaggcttataagcggaggaaccgccgtaactcaacacgtggactcaccggatccgttaactgacttccggcgatccatgcaagagatgattgacgccgccatcgacgccggagaacttagtcgtgatccgaacgacggttacgatttcttggatgaactgctactcacttatctctctttaaatccagccgacacacacaagttcgtcatcagggctttctccgacatattggtctcactcttgtcggaagaacgccggatatgctga

SEQ ID NO: 8 - DNA, 1036 bp, Arabidopsis thaliana
ttaattaaaattcaatggctgcattaccagtattcataccagcagagtcatttccatcgatcctctcacatgaaaccttgatcaatcactttcggaccaatcttccgaaacattcatcaacaatcacaagccctgtccggcaaaactacaccgtttcatcaccttcctctctcctcctcatgccttcttggtcatcttcttcttctctcccttacatgggcgtcaagctcgtgacctatttccctcataactcttctcagaacttacctggcatccatggatcctacacactctttagctccactacaggccaaaccttagctacaatggatggtactgttttaaccctttaccgtacttcctctgtttcaggcttaggatccaaaatcctagctagagacgatagtcaagtgctgatcatggttggttccggtgctctcgcaccacacctgatcaaatcccatctagctgcgaaaccaagcttgagaagagtgatcatatggaacagaactccacaaagggctcaggagttagctgaaaccctctccaaggatcctcaacacaaggagatttcattcgatagccacgattcgctagatcaaatcattcctctaggagatattataagctgtgcaacaaactcaactgttccattggtcaaaggtgagttcttgaaacccggaactcatcttgaccttgttggatcgtttagccatgaaatgaaggaatgtgacgacaatgcgatacagagagggagtgtgtttgtcgataatgacactgcgatgatagaagcaggagagctcgcgggagcgtttgagagaggagtgattaagagagaagacatttgtgggaatttggtggagttgatcaaaggtgacaaagaagggagaaagagttcaacagacataacagtgtttaagtccgtcggttcgggtaccgtagatctcttaaccgcacaacttgttcacgagacttacctcagccgttgttaagcagtgtgaatgaatcttgtttgatcattgcgtttgggcgcgcc

SEQ ID NO: 9 - DNA, 1096 bp, Arabidopsis thaliana
ttaattaaatggcggaaaactacgaccgtgccagtgagttaaaagcattcgacgagatgaagattggcgtgaaaggactcgtcgacgccggagtcacaaaagtcccgcgcattttccataacccgcatgttaacgtagcaaaccctaagcctacatcgacggtggtgatgattccaacaatcgatctaggtggcgtgttcgaatccacggtcgtgcgagagagtgtagttgcgaaggttaaagacgcaatggagaagtttggatttttccaggcgattaaccatggggttccacttgatgtgatggagaagatgataaatggtattcgtcggtttcacgaccaagatccagaagtgaggaaaatgttctatacccgagacaaaaccaaaaagcttaaatatcactctaatgctgatctctatgagtctcctgctgcgagttggagagataccttaagttgtgtcatggctcctgatgttccaaaagcacaggacttacctgaggtttgtggggagatcatgttggagtactcaaaggaagtgatgaagttagcggagttaatgtttgaaattttatcagaagctttagggttgagtcctaaccacctcaaagaaatggattgcgcaaaaggtttatggatgctctgtcattgttttccaccctgtcctgagccaaaccgaacattcggcggcgctcagcacacagacagatctttccttactattcttcttaacgacaacaatggaggacttcaagttctctacgatggatactggatcgatgttcctcctaatcccgaagcacttatctttaacgtaggagatttcctccagcttatctcgaatgacaagtttgtaagcatggagcatagaattttggcaaatggaggtgaagagccgcgcatttcggtcgcttgtttctttgtgcatacttttacttcaccaagttcgagagtatatggacccattaaagagcttctgtctgagctaaaccctccaaaatacagagacaccacctcggaatcctccaatcactatgtggctagaaaacctaatgggaattcttcgttggaccatttaaggatctgaggcgcgcc

SEQ ID NO: 10 - DNA, 2471 bp, Arabidopsis thaliana
ttaattaagctccaacttgattcgctcaattgatctcttttgtatcgacaacctgcgatggcgccggcggaatctggagtctctccccgtcggaatccttctcaactctcgtggatgaatctctctagtaacttgattttggcctaccagagctttggtgtagtctacggtgatctcagtacttctcctctttatgtcttccctagcacatttattggaaagttgcacaagcatcacaacgaggatgccgtatttggtgctttctctttgattttctggaccctcacgctcattccccttctcaaataccttcttgtattactgagtgccgatgacaatggagaaggcggaacatttgctctctattccctgctttgtaggcatgctaagcttagcttacttcctaaccagcaagctgctgatgaggagctctcagcttacaagtttggtccttccacggatactgtaacttcatcccccttcagaacatttcttgaaaagcacaaaaggctgaggaccgctttgctgcttgttgtactttttggagctgctatggtcattggagacggggttctgaccccagctttatcagttctgtcgtccttgtcaggcttgcaagctacagagaagaatgtgactgatggcgaactactggtgcttgcctgtgtcatattggtcggactgtttgctttgcaacattgtggtactcacagggtggctttcatgtttgcaccaattgtgatcatctggcttatttcaatattcttcatcggtttatacaacatcatccgttggaatccaaagataatacatgcagtttccccactgtatatcatcaaattcttcagagtgactggtcaagatggatggatatctcttggaggggttcttctttctgtaacaggtactgaagccatgtttgcaaatcttggccatttcacctcggtctcaatcagagttgctttcgccgttgtcgtgtacccctgtctggtggtacaatacatgggccaggcagctttcctgtcaaagaacctcgggtctattcctaacagtttttacgattcagtcccagatcctgttttctggcctgtctttgtcattgccacacttgcagccattgttggcagtcaggctgtgataaccactacgttctcaataatcaaacaatgccatgccctagggtgcttcccacgcatcaaagtagtccatacttcgaaacatatatatggacagatctatatcccggagatcaactggatcctgatgatccttactcttgcaatggctataggctttcgagacacaactttgattggaaatgcctacggaatcgcatgcatggtagtaatgttcatcacaacgtttttcatggctcttgtcatagtcgtggtttggcaaaagagttgttttctggcggctttgtttcttggaactctatggataattgaaggtgtctacctctcagcagcgctaatgaaagttaccgagggaggttgggtgccttttgtgctcacgttcatatttatgatcgccatgtatgtgtggcactatggcacccgtaggaaatacagctttgatcttcataacaaagtttcattgaagtggttgctgggattaggacctagtctaggtattgtccgcgttcctggaataggactcgtttactcagaacttgcaactggagttcctgcaattttctctcactttgtgaccaacctgcctgcattccataaagtcgtggtgtttgtttgtgtgaaatcagttccagtgcctcatgtttcccctgaggaacgcttcctcattggtcgagtttgcccgaagccttatcgtatgtacaggtgcatagtgaggtacggttacaaggacattcaacgggaagacggggactttgagaatcagcttgtacagagcatagcggagttcatccagatggaagcaagcgacctccaatcctcggcttctgagtctcaatctaatgatgggagaatggccgttctaagcagccagaagagtctctctaactcaatcctgacggtttcagaggtagaggagattgattatgctgaccccacgatacaaagcagtaaatccatgactctgcagagtttgcgttcagtgtacgaggatgagtatccgcaagggcaagtgaggaggaggcatgtgaggttccagttaacggcgtcaagtggtgggatggggtcctcagtgagggaagagctaatggatctgatacgggcgaaagaggcgggtgttgcatatataatgggccactcgtatgtgaaatcgaggaaatcctcgtcttggttgaagaagatggcgatagacatcggttattctttcttgaggaagaactgcagagggccagccgtagcactcaacattcctcacatcagcctcattgaagttggcatgatttactatgtttaagccactaatatgagtagcattcataattcatgggggatttaaat

SEQ ID NO: 11 - DNA, 923 bp, Arabidopsis thaliana
ttaattaaatggataagccaagcttcgtaatccaatccaaagaagcagaatccgccgcgaaacaactcggcgtttccgtcattcagctcctcccgtcgctagtcaaaccagcacaatcctacgctcgaactccgatttcgaaattcaacgtcgcagtcgtcggactcggatcatcaggtcggatcttcttaggcgtcaatgtcgaattcccaaatctccctctccaccactcaatccacgccgaacagttcctcgtcaccaatctcacactcaacggtgaacgtcatctcaatttcttcgccgtctccgccgcaccatgtggccattgccgtcaattcctccaagaaattcgcgacgcacctgaaatcaaaatccttatcaccgatccaaacaactccgccgattccgattccgccgccgattcagacggattcttacgtctcggaagcttcttgccacacagattcggtcccgacgatcttctcgggaaagatcatcctcttcttctcgaatctcacgataaccatctcaaaatctcagatctggattcgatttgtaacggaaacaccgattcatccgccgatttgaaacaaacggctttagcggcggcgaatagatcgtacgcgccgtatagtttatgtccatcgggagtttcgctggtggattgtgacgggaaagtgtacagaggttggtatatggaatcggcggcgtataatcctagtatgggaccagtacaggcggcgttggttgattatgtggctaatggtggtggaggaggatacgagaggatcgtcggagcggttctggtggagaaagaagatgcggtggtgaggcaagagcacacggcgaggttgttattagagactatatcgccgaaatgcgaattcaaagtgtttcattgctatgaagcttagacctatata

SEQ ID NO: 12 - DNA, 2260 bp, Arabidopsis thaliana
ttcatttatttgtcagctttcaaactctttgtttcttgtttgttgattaacccttaattaaggaaatggcggctttattagcttctcagagctgctgctatggcggtgagaccgcaagagtcaccaaagctattggtttcagtagctctttggagaatcatttcactggggaagccactcagtgttatggcagcaagtctaagagatttcgtattgagatgagacagtcggaattgccctctaaggttggaatcaatggacgttcagtcaaaatggttcctgcgagtgaggtggtgaagaggaaagatggtgtgaatggatcggctgggaaaggtgttaatggagcgagtttggttagtagtagaaacattaatggtgcggcgtcaactttggttaaggcaccaaagaaaacaacagaatcgtaccttcctccaccggttgaaggagttagggttcttccttctgatgaaggttttagctgggctgatgagaattatagctcacttcaacgcagtattgatgtttggtcatttgttatttccctgaggattcgtatcttgttcgataattcgaaatgggcttatgttggaggattcacagaagaaaaacagaaaagcagaagaagagaaacagcttcatggttgagagagagtgtattgcagcttggtccaacgtttatcaaactgggacagttgtcttcaactaggtcagacttgtttccgcgcgaattcgtggatgagctttccaagttgcaggacagagtccccgctttttctccagagaaagcaaagcgcttcattgaggctgaacttggggctcctattagtgtaatgtataaagaatttgaagagcaacccatagctgcagctagccttggtcaggtacacagagctgttttgcacaatggcgagaaagtggtagtaaaagtacaaagacccggactaaagaaacttttcgatattgatctacgaaatctgaagctgattgccgagtatttccagaaaagtgaatcatttggtacaaacgattgggttggtatctatgaagaatgtgccttaattttgtatcaagagattgactacataaacgaagctaagaacgctgacagattccggagagacttccggaatataaactgggtccgcgtacctttggtttattgggattactctgccatgaaggtcttgactttggagtatgtaccaggtgttaagatcaacaacttggacgccttagctgcacggggttttaaccgttctagaatcgcatcacgggccattgaagcttatcttatacagatactcaaaaccggcttttttcatgcggatccgcacccaggaaaccttgcaattgatgtagatgaatcaatcatctactatgacttcggcatgatgggagagatcaaaacatttactcggaagagattacttgatctcttctattctgtttatgaaaaaggtgcaaaaaaggtcatgcaaaaccttatagaccttgaagcacttcaacccactggagatctttcatcggtaaggagatctgttcagtttttcttggacaacctattaagccaatcaccagatcagcaacagactttggcagctattggagaggatctgtttgcaatttcccaggatcagccattccgtttcccatcaactttcacctttgtcatccgagcattttccacacttgagggtattggttacatccttgatccagaattttcctttgtgaaggttgcggctccttatgcgcaggaactcctggatctaaaacaaaggcaacgctcgggaactcagcttgtccaagaaataaggaagcaggctgatgatgccaggtcttctactctgtctatgccatatcgagtgcagcgaatagaagagtttgtgaaagaactcgattcaggcgatctgaaactccgtgttcgggttcttgagtcggaaagagcagcccggaaagcgacaatactgcagatggcgacgatgtatacagttcttggaggaactctacttaatattggggttacatttagcaaccaaggaagtcagcttgttgccaatggatccttcattggagcagggatattcatgttattggtactgaggtctatgcaaagggtaaataagcttgataaatttgagaagatgatataatgatgactggtggtctggtggatagtttattcttttaaagctccaaatatcagaggcgcgccaaaaattggagctctgcagagctttcgttcgtatcatcggtttcg

SEQ ID NO: 13 - DNA, 2119 bp, Arabidopsis thaliana
ttaattaaatggttctcgaggtgattttccaattacttgtgcttatcttcgttgatgatccacgttgaatgctttttctcatcgatgatttcttgttgtaggcgactatgatatgtatcgacaactccgagtggatgcgaaacggagattactctccgtctaggttacaggcgcaaacggaagctgttaatcttctttgcggagccaaaacccaggtaataatttacgttttttcacttgattcgattagggtttttgggtttgcgtgagattgtgatttttagggatctttcttttttgcaattgcagtcgaatccggagaatacggtggggattttgacaatggctggcaaaggagttagagtattgactactcctacctctgatcttggcaaaattctggcctgtatgcacggtatgtatctctctctccaatctttctatttattattagctgtctacttagagcaattagaaaaaatctgttctttctctttatcattgagtttgacatcaatttgctacttgcgtcatcttttcaggccttgatgtgggaggagagatcaacttaaccgcagctatccagatcgcccagctagctcttaagcatcgccaaaacaagaatcaacgccaaaggattattgtttttgctggaaggtaccgaattgctttgtttttgctgagtaacttttgtatagttttatactgatgtttttcttctgcttctactttttagtccaatcaagtacgagaagaaggccctagagatagttggaaaaaggctgaagaagaatagtgtctctcttgatattgtcaatttcggggaggatgatgatgaggaaaagcctcagaaactcgaggcgctccttacagctgtgaataacaatgacggtagccacattgttcatgttccttctggagccaatgctctctcagatgtgcttctcaggtaccatcccttttcttctttttttctaggttatgtagattgtaaaaggaacagtttcaacaatatccggcttggtaggtgcacttcatgtggttttgtgtgtttaggtcttttgagctctctagtcttgctttttatcaatgctgcaacaaaacatttagacagtgatttgaatcatagatagtgttttaacttttaaattttcttccagcacacctgtattcacgggtgatgagggtgcaagtggctatgtttctgcggcagctgctgcagcggccgcaggtggggacttcgactttggtgtggacccaaatatcgatccagaacttgctcttgcccttcgggtctccatggaggaggagagagcaagacaagaagctgctgccaagaaggcggccgatgaggcaggtcagaaagacaaagatggggacacagcttccgcctcacaggagacagttgctaggacaactgacaagaacgctgaaccaatggttagttgttacttaaaattgagtgtagcattcttatatagtcacaggcggagagattgttaatcatacaaccttttgtggcaggatgaggacagtgcgttgctagatcaggcaattgctatgtctgttggtgatgtgaatatgtcagaagcggctgatgaggaccaggatctggctttaggtaagtagaacagtgtggtaaaagtatatccatggcaatcaaaattggcatttttcttatatttttttatactccatgtgcagctctgcaaatgtcaatgagtggggaagagtcaagtgaagctacaggtgctggaaacaacctcttgggaaatcaagccttcatatcgtctgttctctcatcggtaagcctacataaaccttagtcagtttttttcacaagcaaaatgaaagagaaaagtagtagggttagctttggtactaagactttgtgtacacgcagcttcctggggtggatccaaatgatccggcagttaaagaactactagcgtctctgccagacgagtcaaaggtgtgtctttgttgatgtttatgattacatctttttgttatttgaaaaagaagattctgataaatgtatatggttaaaatgacagcgtaccgaggaggaagagagtagtagcaaaaaaggcgaggatgagaagaagtgaggcgcgcc

SEQ ID NO: 14 - DNA, 374 bp, Arabidopsis thaliana
ttaattaaatcattccaattctctaatcaaaatgtggagcaacaagttcttcttccttcttccagttgtatgcatcgtagtgttcgctacttctcaaccattgccatcaccacaaccttcccaactagattgttggtcatcactagaagttattcccgactgtgtcccggaaattttccgatcgataacaaatggacagttcgggaatgtaggtccttcttgctgccatgcttttataggtctcgatactgaatgcatccctcagatgtttatcttcgctcccctcatcccgccttctcgcagactcagggatcattgttcccacaaaataattgtgccataaacattttgagactttgttagttgggcgcgcc

SEQ ID NO: 15 - DNA, 981 bp, Arabidopsis thaliana
aactctttgtttcttgtttgttgattaacccttaattaagatgcagcaaggtgactcaatgctgagcttgaggcctggaggtggtcgtggaggaagcagacgctttgccccacgctttaccttatcttcttcctctgatcttaccaatggcggagacgctccttcttttgccgttaagaaaggagactcgcgatttgagggtcatgagcttttgcggttcactcgagaacagctgcttcagctcagagaggtaattcaaggctgctacctcagggcagtggaggccttctgaacgatagaccaagtgcccttgtgcaaggtaatggttcccaacagcctaaacctgttccttccccgaccagacaaactgtggagaagccaaaaccacaaccacagccacaggaggtggctcctcctacgactactagcttgaacacagtagagctcagtagaaagaccaactcgcttttggaggaatatttcaatgtccgtctattggatgaggcattacaatgcatagaagaactgaaaaccccgtcttaccatcctgagcttgtcaaggaagctatctccctcggcttggagaagaaccctccttgtgttgaaccagtggcgaagctcttggaacatctggtctctaagaatgttctaactcctaaagacttaaggaatggttgtctgctctatgggtctatgctcgatgacattgggatcgatctgccaaaagcgccaaacaactttggggagatccttgggagtttggttatggccaaagcatcggattctgagttggtgaaagagattctaatgaaaatgggagacgaatggttcaagaaagcagtcttggaagctgtgatgaggagtgttagtgagtctctactcactacggaagcagtagaggttgaggcttgccgtggtttggtgtagatttaaatacccagaaatacccagcaaattggagctctgcagagctttcgttcg

SEQ ID NO: 16 - DNA, 1232 bp, Xenorhabdus nematophilus
aactctttgtttcttgtttgttgattaacccttaattaatccgggcgcgcctgatttatcacaagtttgtacaaaaaagcaggctcctgcaggaccatggaaacattaggcgaattcatcgtcgaaaaacagcacgactttcctcatgctacaggtgaattgaccgcattactttctgctatcaaactgggtgccaagatcattcatcgggacatcaataaagcgggtctcgtggatattctgggcactagcggtgtttcaaatgttcagggtgaagttcagatgaagctggacttgtatgccaatgaaaaactcaaggcagcactgaaagctcgcggtgaagtagctggtatcgcttctgaagaagaagacgatatcgtcatctttgatggcgaccgggcagaaaatgcaaaatatgttgttttgatggatccactggatggttcttcgaatattgatgtaaacgtttccgttggtactattttctctatttaccaccgaattacaccaatcgggcaaccggttactgaagaagactttctgcaaccgggccatcgtcaggttgcggctggttatgtcgtctacggctcatccaccatgttggtttacactactggctgtggtgttcataccttcacttatgatccttctctgggtgtattctgcctgacccatgaaaaagttcagttcccggcaaaaggcaatatgtactccattaacgaagggaactacattaaattccctcaaggtgtgaagaaatacatcaaatattgtcaggagcaggatgaagaaactcagcgcccttacactacccgttatgtcggttcactcgttgctgacttccatcgcaacctgctgaaaggcggtatttacatttacccaagtacagccagccatccgaccggcaaattacgcctgttatatgagtgcaacccgattgcattcctggctgaacaggctggcggtaaagccagtgacggtacaaaccggatactggatatcgtaccaaatcagttgcaccagcgcgttccactgtttgtcggaaccaaatcgatggtggaaaaagccgaaagttttatggctgagtttcccgaagaataaatcgatttattaaatggttaattgaagagacggtgtttcgtctcttcttcataaagactcgagacccagctttcttgtacaaagtggtgataaattggagctctgcagagctttcgttcgtatcatcggtt

SEQ ID NO: 17 - DNA, 1601 bp, Bacillus subtilis subsp. subtilis str. 168
gtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaatttgaacagtctcatgtattgaaggaattgcctaaacaattcttcgcttctctggtgcagaaagtgaaccgaaagcttgcagaaggacatgacgttatcaatctgggacagggaaatccagatcagccgactcctgagcatattgttgaggagatgaaacgagctgtcgctgatcctgagaatcataaatattcgtcttttcgcggctcataccgtctgaagtcagcggctgctgcattttacaaaagagaatacggcattgatctggatccggaaaccgaagtcgctgtattattcggcggaaaagccggtctagtcgagctcccgcaatgcttgttgaatcccggtgatacgattttagttcccgatccgggttatcctgattactggtcgggtgtcacacttgcaaaagcaaagatggaaatgatgccgctcgtaaaggacagagcgtttctccctgattacagcagcataaccgctgaaataagggaacaggcgaaattgatgtatttgaattatccgaataatccgactggagctgttgctacttccgagttctttgaagataccgtgcgttttgcggctgaaaacggaatctgcgtcgttcacgattttgcttacggcgctgtaggatttgacggctgcaagcctttaagctttttgcagactgaaggtgcgaaggatatcggaattgaaatttacacgctgtcaaaaacgtataatatggcaggatggcgggttggctttgccgtcggaaacgcttcggtcattgaagcgatcaatctttatcaagaccatatgtttgtcagtcttttcagagcgactcaggaggctgcagcagaggcactgttagccgatcagacgtgtgtggcagagcaaaatgccaggtatgagagcaggagaaacgcttggatcacggcatgccgggaaatcggctgggatgtaacagctcccgcaggttctttttttgcatggctgcctgtgcctgaaggctatacttctgagcagttctcagatcttttgctggaaaaagcgaatgtggcagttgcggctggaaacggcttcggtgaatatggcgagggctacgtcagagtcggacttttaacaagtgaagaaagacttaaggaagccgcttatcgaattggcaaactgaacctgtttacccaaaaaagcattgacaagaccttataactcgagacccagctttcttgtacaaagttggcattataagaaagcattgcttatcccccaaatacccagcaaattggagctctgcagagctttcgttcgtatcatc

SEQ ID NO: 18 - DNA, 1078 bp, Arabidopsis thaliana
ttaattaaatggctttgtcttccaaaaccctaaagtcaactctcttcttcctctctattattttcctctgtttctccttgatcctagctcacggcggcatagacgacggcgacgaagaagaggagaccaaccagccacctccggccaccggaacaaccaccgtcgtgaatctccgatcgaaaagcttggtgcttgtgaagatctactgtattataatactcttctttagcacattcttagccggagtttcaccttacttttaccgatggaacgagtcgtttctcctcctcggaactcaattctccggtggtatattcctcgcgaccgctctaatccatttcctcagcgacgctaacgagactttccgagggttaaaacacaaagagtatccttacgccttcatgttagcagccgctggatattgccttacaatgctggcagatgtggcggttgcgtttgtagcggctgggagtaataacaaccacgtcggagctagcgtcggagagtcgagggaggatgatgacgtggcagtgaaagaggaaggacgtcgtgagataaagagtggtgttgatgtgagtcaagcgcttatacgaactagtggatttggagacacagctttgctgatttttgctctttgttttcactccatctttgagggaatcgccattggtctctcagacactaaaagcgacgcttggagaaacctatggacaatatcgttgcacaaggtctttgcggccgtagcaatgggaatagctcttctcaagctaatccctaaacgtccattcttcctcactgtcgtctactccttcgcctttgggatatcgagtcccataggtgtcgggattggcataggaatcaatgccactagccaaggagctggtggtgactggacctacgcgatctctatgggccttgcgtgtggagtttttgtgtacgttgcggttaaccatctcatctcaaaagggtataagcctcgtgaggaatgttacttcgacaagccaatctacaagtttattgccgtcttcctcggtgttgctttgctctctgttgtaatgatttgggattgaggcgcgcc

SEQ ID NO: 19 - DNA, 612 bp, Arabidopsis thaliana
atgggtaacacagataagctgatgaatcagatattcgatttgaaatttacgtcaaagtctctgcaaaggcaatcaaggaagtgtgagaaggaagagaaagcagagaaattgaaggtgaagaaggctatcgagaagggtaatatggatggtgctcggatctacgctgagaacgccattcgtaagcgtagcgagcagatgaactatctccgtctcgcttctcgccttgacgctgttgttgctcgtcttgatactcaggctaagatgaccaccatcaccaaatccatgaccaatatcgtcaaatcccttgagtcttctcttgccacagggaatctacagaagatgtcagagacaatggattcattcgagaagcagtttgtgaacatggaggtccaagctgagttcatggagaatgctatggctggttcaacttcattgtccactccagaaggcgaagtcaacagccttatgcagcaggtggcagatgactatggtttggaagtctctgtggggcttcctcagcctgctggtcatgccattcctactaagactgaggagaaagtcgatgaggatgatttgtcgaggaggcttgcggagcttaaagccagaggataa

SEQ ID NO: 20 - DNA, 831 bp, Saccharomyces cerevisiae
gattttagataatggcaaataaaaatgaaatagtatcaatataccgaaaaattaatcacactcaatgcgactgtgatagctgataagtggagctcagaaatattcagaagcgtaagaataatgaaagcaaccattcaaagagtaacatctgtatttggagttccccgagcatctgtattcgtgccaagaatcagcacaccatttattttgcataattatatctctaatggcagaatggaccttttttccaaagaattccacaatggccgcgtatccaaatctgatctttggtcaagcaacaaggaagaggagctcttagtatctcaaaggaaaaaaagaccgatctctcctcatttaactgtttacgaacctgaaatgagctggtatctttcctctttacatcgtatatctggcgttttactggctcttggattctatgctttcacaattactttgggtgtgacgacaataatgggaatggatacgacttttcaggatctaaacaagtggtatcacgaaaagatgcctaagtggtcccaatgggtggccaaaggctctgcagcatatctgtttgcattccattttggtaacggtataaggcatctcatctgggatatgggctacgaattgaccaaccgtggggttataaaaaccggatcaatcgttttagccggcacactcgtcttaggaacgtatttactggctcagtaaatgaaatgtaaggaatgtacttagtgttttttgctacatagcttttatgatactctttataatgttatattcaataaatttgattcaacgtagaaggacccgcgaaagcagaagaggtta

SEQ ID NO: 21 - DNA, 537 bp, Arabidopsis thaliana
ttaattaagtgtgaccacaaaatacgacagaattagagagaaaagatagagagatgtcaggttctgtcttcgttcccggtatggcgattggagttcccacgctttctcgttcgagctctgttcaccggagcttagaaccgacgaagaagatgactatgagtagtgtcaaattcgtgaccagttttcgaaacccgtcaaactgttcagggacaaaacggtcatttcgcgttatggcttccgatgaccggtcggaacaagcagataacggtcaaggaattcaggaggacttaaactacttgttgaagatcggagttggttcagtggcaggtgcagctataatcaaatacggaagtgtcttgttcccacagatcacaagacctaatctcactctagccctcttcattatcatagctcctgttgtaatctccgttatccttttgtccctatcatcatcatcttcctccaagaaacagaactgattggttaaaaaaatgtgtaaatgtatttcacctcattgtgaaaaagatcgggcgcgcc

SEQ ID NO: 22 - DNA, 576 bp, Arabidopsis thaliana
ttaattaagtttcttggtcgacgtgatgagtcatcggcgagattacggcagtgatgcagttcacgtgagaatcacccacgaccctccgcctgagaattgttttccaaattccggcgacagttccgtctgggccactgaggatgattacagccgtgtctgggccataaactctgatggcgcagagtctccgagcaagaagacacgatcttcctcctcctccgagatcgggaaatcgttcttcaagacgaagctttgcttcaaattccgcgccggaacttgtccctactccgcgagctcttgccactttgctcacagcgcggaggagctccgtcttcctccgccgccgccgcccaattggcaggagacggtgacagaggcttcaagaaacagagaaagctttgcggttagtttaggccctcgtggcaatgttgctcagactctcaagtctccgaattggaagacaaggatttgcaataagtggcagactactggctattgtccttttggttctcactgccattttgctcatggaccttcaggtaaagctacggcctttttcatctattagggcgcgcc

SEQ ID NO: 23 - DNA, 1824 bp, Arabidopsis thaliana
atgatgtggaagaacattgctgggttgtcgaaggcagcggcagcggcaagaacacacggatctcggcggtgcttttccacagcgattcctggtccttgcatcgtccacaagcgtggtgctgatattcttcacgatccatggttcaataaggacacaggttttcctttgactgagagagatagattagggatacgaggcttgcttcctcctcgtgttatgacctgtgtacagcaatgtgatcgtttcattgagtcgtttcgttcgctagagaacaacacaaaaggagagcctgaaaacgttgttgcattagctaaatggaggatgttgaatagattgcatgaccgtaatgagactttgtactaccgagttcttattgataacatcaaagattttgcccccattatatacactcctacggttggacttgtttgtcagaactattctggtttgtatagaagaccaagaggaatgtacttcagcgccaaagacaaaggagagatgatgtctatgatttataactggcctgctccgcaggtagatatgattgtcatcactgatggtagccgtattttgggcttaggagaccttggagtacagggaattgggattcctattggaaagctcgacatgtatgtcgctgctgcaggaatcaatccacagagagttttgccaattatgttggatgtaggcacaaataatgaaaagctcctacagaatgatctctatttaggagtcagacaacctaggttggaaggagaggagtaccttgagattattgatgaatttatggaagctgcatttacacgttggccaaaggccgtcgtacagttcgaagatttccaagcgaaatgggctttcggaacattggaaagatatcggaagaaattttgcatgttcaatgatgatgtccagggaactgctggtgttgcactggctggactattgggaactgtaagagctcaaggtcggccgatatccgactttgtgaaccaaaagattgttgtggtgggagctggaagtgctgggcttggtgtaactaagatggcagtacaggcagttgccagaatggcaggtatcagcgagagtgaagcaacaaaaaacttttacctgatagataaagatggtcttgtcaccacggagaggacaaaacttgacccaggagctgtactttttgccaaaaatccagctgagatacgcgagggagcaagtatcgttgaagtggtgaagaaagtgaggccacatgttcttcttggtttatctggagttggtggtatctttaatgaagaagttctcaaggcgatgcgagaatctgactcatgcaagcctgccatttttgccatgtcgaatcccactttgaatgccgagtgcactgctgctgatgctttcaaacacgccggaggaaacattgtctttgcaagtggaagtccatttgagaacgttgaacttgagaatggtaaagtaggacatgtgaatcaggctaacaacatgtatttattcccggggatcgggctagggactcttctctctggtgcacgtatcgtaactgatggaatgctacaagcagcttctgaatgccttgcgtcctacatgaccgatgaagaagtccaaaaaggcatcctttacccttcaatcaacaacatccgacacataacagctgaagtcggggcagctgttctacgagctgcggtgactgatgacattgcagaaggacatggtgatgttggtcccaaagatctcagccacatgtctaaggaggatacagtgaattacattacacgcaacatgtggttccctgtttacagccctctcgttcacgagaaatag

SEQ ID NO: 24 - DNA, 1273 bp, Arabidopsis thaliana
ttaattaaatgtcaggagctaccaccgcttcctccggagaccacaacaacctccgtctcccaactccgacgcttgacgccgaatcgcaaactctgctgcaatcgatttctgctgaagggggttacgcttatgctcgcatggcggtgttagcggtggccggtgaccaaagcgcggcggaggcggcgcgtgatatggcttgggagcaacttcactctggtccgtggcactcggttctccccgtttggcgcgacgcttactcaatggcttgtctccacgtagctaaaatccatttcgccgccggcgagtttggtgaggcgcttggtgcgcttgatatgggtcttatcatgggaggtatgcttctccgcaaggatcttcatgattctgttttgttggtctcctctgaagctcgtaagatgacgaagagtcttgaagaagcttctggagatttcaaaggtgagagattggtcccggaagttcccgtcgacgtcaatgaggtccttaagattctaccttgcaggtctttaacttgtaaaagagtagagaagaggtctggtttatctttggaggggtttctgcgtgattattatctgccaggtacaccagttgttataaccaattctatggctcattggccagccaggaccaagtggaatcacttggactacctcaatgctgttgctggtaaccgcaccgttcccgtggaggtggggaaaaactatttgtgttctgattggaagcaagagcttgtgacattttctaagttccttgaacggatgcggaccaataaatcgtctccaatggagcctacttatcttgcccagcatcctttgtttgatcagataaatgaactgagagatgatatatgtattcctgattactgttttgtcggtggtggggaactccaatcacttaatgcatggtttggcccggctgggacagttactccgttacaccatgatccacatcataatatacttgctcaggttgttggcaagaagtatataaggctttacccatccttcctgcaagacgaactttacccttactctgagacaatgctctgcaactctagtcaggttgatctagacaatatcgacgaaaccgagttcccaaaggccatggagttggagtttatggattgtattctagaagaaggtgaaatgttgtacatccctcccaaatggtggcactatgtcaggtccttaacaatgagtctctcggttagcttctggtggagcaatgaagcagaatcttctagctcgtagggcgcgcc

SEQ ID NO: 25 - DNA, 1617 bp, Arabidopsis thaliana
ttaattaaatgatcatgatacttttcttatgcttaataatattgttcatcataaccattctcttcttcaaaaaacataagacagtgaacaaaatcatcaactttccatccccaccgagacttccgttgatcggaaatcttcatcagcttagccaacatcctcaccgatcactctgctatctcagccaccgttacggtccactcatgctcctccacttcggaagtgtccccgttattgtagcctctacagcagaagcagctcgagacgttttaaagacgcatgatcgcgtttttgctagccgtccacggtcaaaaatcttcgaaaagcttctttacaagagccgtaatatggcctcagctccttatggagagtattggcgacaaatgaagagtgttagtgttctccatctcctcagcaacaaaatggtacggtcctttcaagacgtgagacaagaagagatcactctgatgatggaaacgatccgtaaatcgagttctaaaccggtaaatcttagcaagatcttgtcgagtttaactaacgatgttatatgtagagtagctttgggacggaaatatggtgttggaacagattttaaagagttaatagacaggctcatgaggcaacttggtacgtttactatcgggagttatgtaccgtggcttgcgtggactgattgggtcagcggtttggaggctcgactggaaaagaccgctaatgattttgataagctattggagagaattgtgcaggatcatgaagatggagacggcgacaagactgattttgtggatgtattgctcgcagctcagagagacaagagtttcgggttcgatattgaccggttaagcataaaagcaatcgtcttggtaagggaaaaaatatatatcaaattcaaatccaatgttttagactattagtgtagaaccatgcattaattgtttatgtctataaccattatttgtttaagtatataaccattaattgttttggtcttgatttcacttttcaggatgcttttgtgggtggtacagacacatcctccacgcttgtggaatgggaaatgacagagcttctacgacacccaacgtgtctaaaaaaacttcaagaggaagtccgtacgatttgtaagggaaaatcaagtgtgtctgaagatgacattcaaggaatggaatacttaaaagctgtggtcaaagaggcactcaggctacatccaccagttccattgatggttcctcatcaatcaacacaagatgttaggttaagagataaccatatacctgccggtacgcaggttatagtcaatctttgggccgtcgggagagaggctgcgacgtggggaccagatgcgaatgagtttagaccggagaggcatttagagtcgccttctgatttccggggtcaggattttgagctgattccttttggagcagggagaaggatgtgtccaggaatatcatttgctgtggtgctgaatgaggtagtcttggctaacttagtgcatgggtttgattggcaatctatagacgatgagaccgatgttgctgaatcaatcggtagtgtgattcgccgcatgcaccctctttacgtcattccatcatctactacttgaggcgcgcc

SEQ ID NO: 26 - DNA, 1972 bp, Arabidopsis thaliana
ttaattaaatggattctaagggagtggtgtcactaccgttgatccataaccatcaaatgatgccttggaatgacctgaggaaaggtgattgttgtggtcactttgaagctatcagcgatggctactattgcaaaagatgtgattttttcgtccacaagacatgtggtgacggtgtctccgaatatatcgagcatccatctcaccccaatcacactcttgagctttgtagtaacttacgttttcactgtgatttatgtggaaggcgcaccaattacctatcctattattgtgagatctgtggctttatcgtggatctacactgtgccatgtacccaccgccagagtttattgaaaattccgagaggcatcaccacaagctcacccttctcaaggagcggatcgcggcgttcgattgtgatgctaaatgtggaaagattagtggtaatgaatttgcttacaaatgtcaagagtgtgatttaaccttccatgtggattgcgtatggcatccgtcagaggtatatcaccctttagaggtaaaccactcttaccacccctcgcaccctcttaagctccacacaggtcaacgaccggactattctgatggagcatgtcgtctttgcgcaagaaagattgatgatagatatttttatcattgttcttcttgcaacttcaccttggatatgcgttgtgttctacatccaccacaacaatctcttctgaatttgaaagctcatgatcaccaactcacccttctcccaagacttgattcttttacatgtaatgcttgcgggctgaagggagatcgaagcccttacgtgtgttttcaatgtggtttcatgatccatcaagactgtctttcccttccacgcctcataaacattaatcggcatgatcaccgtgtttcgcgaacttctgttcttggtgttgtgaattctgtgtgtgaagtttgtcaccggaaggtggattggacttgtggaggtttttcttgtcagaggtgctccggctacgtcgttcattcaaaatgtgctaccaacaaagatgtgtggaacgggaaagaactcgaaggagtacctgaagaaacagaagatatcaaaccatttgtggtaatagacaacaacacaatacaacatttcagccacaaaaaacattacctaagactccacgttaatggtgttctttgtgacgacaagaagcggtgcagagcatgcactcatcccatatgtctccaatctttctacggctgtatggattgtgacttcattctccaccaaaactgcgctggatttcctagaaagagatggcatgtgctacacaatgaacgtcttactctagtttcatacgagtatgatttctttcagtgtcaagcttgtaatagattttccaatggtttcagttaccagtattcgggcattacattcgatgttgggtgcggttcaatctctgagccgtttgtccatccaagtcatcccgatcatcccttatattacactttactagatgaagagactaagagtagttgcaatggctgcaataagagttcttattctgtgctaaggtgcattgaagacgattgcagatttgccatatgcttcaaatgcgccacttttccacaagtggtaaagcatagagttgacgatcatcctctctcactatgctttgacaaagaggctagtggtaaatactggtgtgacatttgtgaaaaagaaaccaatccagagacatggttctacacatgtaaagattaccgggctagtttgcatataaagtgtgtgctcggagacttttcatggctcatgccaggaagcacgatagatcttagcgaattatctaaggtggtactcaataatagtatatcgcgtccattttgcagcgggtgtaagatgcattgcatttttcctatcatcttgaagatagttggaacctcagataagtacttttgctctattgaatgcgcctttggatagggcgcgcc

SEQ ID NO: 27 - DNA, 1868 bp, Saccharomyces cerevisiae
ttcatttatttgtcagctttcaaactctttgtttcttgtttgttgattaacccttaattaagatgagttccgtcaataaagatactattcatgttgctgaaagaagtcttcataaagaacaccttaccgaaggtggtaacatggccttccacaaccatttgaatgattttgctcatattgaagatcctctggaaagaagaagattggctttggagtccatcgatgacgaaggtttcggttggcaacaagttaagaccatctccattgctggtgttggtttcttgacagattcttatgatatttttgccattaatttgggtatcactatgatgtcctacgtttactggcacggtagtatgccaggtccaagtcaaaccttgttgaaggtttccacttctgttggtactgttattggtcaatttggttttggtactttagctgatattgttggtcgtaagagaatttatggtatggaacttattatcatgattgtctgtaccattctgcaaaccactgttgctcattctcctgctattaacttcgttgctgttttaacattctaccgtattgtcatgggtattggtatcggtggtgactacccactatcttctattattacttctgaatttgccactaccaaatggagaggtgccatcatgggtgctgtctttgctaaccaagcttggggtcaaatctccggtggtatcatcgctcttatcttggttgctgcttacaagggcgaactagaatacgcaaactctggtgctgaatgtgatgctagatgtcaaaaggcttgtgaccaaatgtggagaatccttattgggttgggtaccgttctagggttggcatgtttgtatttcagattaactattccagaatctcctagatatcaattggatgttaacgctaagttggaacttgctgctgccgcacaagaacaagatggcgaaaagaaaattcacgacaccagtgatgaagacatggcaattaacggtttggaaagagcttctactgccgtcgaatctcttgacaatcatcctccaaaggcttcgttcaaagatttctgcagacattttggtcaatggaagtacggtaagattttgctaggtactgctggttcatggtttaccttagatgttgctttctacgggttgagtttaaacagtgctgttattctgcaaaccatcggttatgccggttccaaaaacgtttacaagaaactgtatgatactgctgtcggtaatctgattttgatttgtgctggttcattacctggttactgggtatccgtcttcactgtcgatataatcggtagaaaaccaattcaattagccggtttcatcatcttgaccgctttgttctgtgtcatcggtttcgcataccataaacttggtgaccatggtctgttggctctttacgtcatttgtcaattcttccaaaacttcggtccaaacacaaccacctttattgttcctggtgagtgtttcccaactcgttacagatctactgctcatggtatttctgctgcatctggtaaggtcggtgccattattgcacaaaccgctttgggtactctaatcgaccataactgtgctagagacggtaagccaaccaactgttggttacctcacgtcatggaaattttcgccttattcatgttgttgggtatcttcacaaccttgttgatcccagaaactaagagaaagactctagaagaaattaacgagctataccacgatgaaatcgatcctgctacgctaaacttcagaaacaagaataatgacattgaatcttccagcccatctcaacttcaacatgaagcataaatttaaatacccagcaaattggagctctgcagagctttcgtt

SEQ ID NO: 28 - DNA, 1844 bp, Saccharomyces cerevisiae
ttcatttatttgtcagctttcaaactctttgtttcttgtttgttgattaacccttaattaagatgagtatgtcaagcaaaaacgagaataagatatcagtagaacaaagaatatccactgatatcggtcaggcttaccagttacaaggccttgggtctaacctaaggtcgattcgctccaagactggtgccggtgaagtgaactatatcgatgctgctaaatctgtaaatgataaccaactgcttgcagagatcggttataaacaagaattaaaaagacaattttcaacattacaagttttcggtattgcgttctccattatgggtctattgccctccattgcatctgtgatgggtggtgggctcggtggtggtccagcaacattagtgtggggttggttcgttgctgcgtttttcattttactggtgggtattaccatggctgaacatgcaagttccattcctaccgctggtggtttgtactactggacgtattactatgctccggaaggttataaagagattatttcttttattattggttgctcaaactccctagcgttggcagccggtgtgtgttccattgattacggtttggctgaggaaattgctgctgctgtcacattaaccaaagatggaaattttgaagtaacgagtgggaaactttacggtatatttgctggagcagtggtggttatgtgtatttgtacatgtgttgcttctggggccattgctcgtctgcagacgctaagtatatttgccaatcttttcattattgttttattgttcattgcgctaccgattggtaccaagcatagaatgggaggtttcaatgatggtgactttatatttgggaaatatgaaaacttaagtgactggaataatggttggcaattttgtcttgctggtttcatgcctgctgtctggactattggttcctttgattcatgtgtccatcaatctgaagaagccaaagatgccaagaaatcagtccccattggtataatctcatctattgctgtttgttggattttaggttggttgattattatttgtttaatggcctgtatcaaccctgatattgacagcgttttggactccaagtacggctttgctttggctcaaataatttatgattcgttaggaaaaaaatgggccattgcatttatgtcattgatcgcattctgtcaatttctaatgggtgcttccattaccacagctgtttctagacaagtctgggcattttcccgtgataacggtttgcccctatcaaagtatattaaaagagtggattctaaatactcggtcccttttttcgctattttggctgcctgtgtaggttccttgattttaggattgttatgtttgattgatgatgccgccactgatgcattatttagtctggctgttgcaggaaacaatttggcatggagtacccctacagttttccgtttaacatcaggtagagatttatttagacctggtccattttatttgggtaaaatctggtctccaattgttgcttggacaggtgttgctttccaattgttcattattattttggttatgttcccctctcaacaacatggtattactaaatccacaatgaattatgcatgcgttattggtcccggtatctggatccttgcaggtatctactacaaagtttacaagaagaaatactaccacggtccagcaaccaatttgtcggatgatgattatactgaagccgttggtgctgatgttatcgacacaattatgtccaaacaggaaccataaatttaaatacccagcaaattggagctctgcagagctttcgttcgtatcatcggtttcgacaacgtt

SEQ ID NO: 29 - DNA, 1990 bp, Saccharomyces cerevisiae
cagctttcaaactctttgtttcttgtttgttgattaacccttaattaagatgaatgacgacagccaggataaaataatacatgatatacgtattcagctacgaaaggctgccacagaattatcacgatggaagctatacggctcctcaaagtgggcagcagaggcgctagcaggtcttgcagaagctattgatgttgatcaaacacactctttagccgatgaatcgccactaagaaataaacaaggtgtaccgaaacagatgtttgaaataccacaaaacgggtttggcctatcagagactgagtatgacctgtacctccttggttctacgttgtttgatgctaaagagtttgatcgatgcgttttttttctaaaagatgtcactaatccataccttaagttcttaaaattatacagtaaatttctatcgtgggataagaaaagccaggaaagtatggaaaatatcttaactacagggaagtttacggacgaaatgtacagagctaacaaagatggggatggtagtgggaatgaggatataaatcaaagtgggcaccaacgcgccaatttaaaaatggtcagcaatgagcatgagtcacaatcgaacatatcatctattttgaaggaaattaacacatttctggagtcttatgaaataaagatagacgatgatgaggccgatttagggttagcactgttgtattatttacgaggggtcatcttaaagcaagagaagaatatttctaaggcaatgtcgtcattcttgaaatctctgagttgctactcctttaactggtcctgctggctggagttaatggactgtttacaaaaggttgacgatgcattgcttttaaataattatctatatcaaaatttccaattcaaattttctgaaaatcttggtagtcaacgaacgatagaatttaatataatgatcaaatttttcaagctaaaagtgtttgaggagcttaatggccagttagaggactactttgaagatttagagtttttgttacaagttttccccaatttcacttttttaaaggcttacaatgctactattagttacaacaatttggattatgttaccgcagaaagccgatttgatgacatcgttaaacaagatccgtaccgtctcaacgatttggaaacctactccaatattctatacgtcatgcagaagaattcaaaattagcctatttggcgcaattcgtctcccaaatagatagatttagaccggaaacatgttgtatcatagcgaactattacagtgcccgacaggaacatgaaaaatctatcatgtatttccgtcgagcactaactttggataaaaaaacaacaaacgcatggactttgatgggtcacgaatttgttgaactaagcaattcacatgccgcaatagaatgctatcgtcgggccgtagatatatgccctcgagacttcaaagcatggtttggtttgggccaggcttatgctctcctggacatgcatttatattctctttactacttccagaaagcttgcactttgaaaccttgggatcgtcggatttggcaagtattgggagaatgttatagtaagacgggaaataaggtagaagctataaaatgctacaaaagatccataaaagcttcacaaacggtcgatcaaaatacttcaatatattaccggttagcgcaactatatgaagaacttgaagacttgcaagaatgtaagaagttcatgatgaaatgtgtagatgtggaagaacttctggaaggtatagtaacagatgaaaccgtgaaggctaggctttggctggcaatatttgagattaaggcaggaaactaccaattggcttatgattatgccatgggggtatctagtggaacgtctcaagagattgaagaggctcgtatgctggctcgggagtgcagaaggcatatgtagatttaaatacccagcaaattggagctctgcagagctttcgttcgtatcatcggtttcgac

SEQ ID NO: 30 - DNA, 1124 bp, Synechocystis sp. PCC 6803
gctttcaaactctttgtttcttgtttgttgattaacccttaattaatccgggcgcgcctgatttatcacaagtttgtacaaaaaagcaggctcctgcaggaccatggctgaggttgtctgttttggagaaatgctcttcgactgtttggcagaccagttgggagtccccttggaacaagttaaatcctggactaactacgccggtggtgcccctgccaatgtggcctgtgccctagtcaaacaaggtgttagcgccgcttttgttggtcgtttgggggcagaccaggccggacaagaacttaaaaatgttctacagcaatgtcaagttaataccgatgggctccaaatcgatccccaccggcccacccgtttggtttatgtgacccggacaggggacggcgatcgccattttgctgggtttggggaatatcacaccggggattttgccgacacagcgatgcagggagaaaccattcccgaatccctattcacctcagctcaatatttggtgatgggcaccattgccctggcctatgcccccagtcgcactgccacggagcggttagtggcattggcgaaaaagcaccaggtaaaaatatttttagatgtcaactggcgatcggttttttgggacgatgaagcacaggcaaaggaaagaattcccgccctgattacccatgcccaaattttaaaatgtaccgacgaggaagcagtgtggctgtttggtcaccaagatccggtcaccatccaccagaaactaccccacctccagggagtattggtcaccgccggggacaagggttgttcctactccttaggcaaaaaccatggggaagtccctgcttttaaagttaatgtgcgggatactaccggggctggggacagttttgtggccggatttttggcccaggccctgacccacggagagaatttattcatagaccctcatctcagttgccaggcagtgacctatgccagtgccataggagccttgaccactctccacccaggggcgatcgccagataggaaaaaagagcagaagaaatggctccgactaccaacctcgagacccagctttcttgtacaaagtggtgataaattggagctctgcagagctttcgtt

SEQ ID NO: 31 - DNA, 1307 bp, Bacillus subtilis subsp. subtilis str. 168
tttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtatgccagcataatgatgagcttgaagccttagtgaaaaaggcgaaaaaagtaacggacaagggggaggtagccagctatattcccgccttggcaaaagctgataaacacgacctgtcagtggcgatttattattccaataatgtttgtctgtcagcaggtgacgtagaaaaaacatttacgcttcaaagtatatcgaaagtcctttcccttgctttggtgttaatggaatacggcaaagataaggtcttcagttatgttggacaggagccgaccggtgatccgtttaattcaattatcaagctcgaaacagtgaatccgagcaagccgttaaaccctatgattaatgccggggcattggtagtgacaagtctgataaggggaagaacggtaaaagagagacttgattatttgctttcttttatcagaaggctgacaaacaaccaagagattacatactgccgggaagtggctgaatctgaatacagcacttcaatgattaatcgggcgatgtgttattatatgaagcagtacggcatttttgaagatgatgtagaggcagtaatggatttatatacgaagcaatgcgcgattgagatgaacagcttggatttagcgaaaatcggatctgtattcgcattgaacggcagacatccagagactggggagcaggtcatctcaaaagatgtcgctagaatttgcaaaacgtttatggtgacgtgcggaatgtacaatgcaagcggggaattcgcaattaaggtcggaattcctgcgaaaagcggcgtatccggcgggataatgggcatttcgccttacgatttcgggatcggcatattcggccccgcattagacgaaaaagggaacagcattgcaggtgtaaagcttttggaaataatgtctgagatgtacaggctgagtattttttaactcgagacccagctttcttgtacaaagttggcattataagaaagcattgcttatcccccaaatacccagcaaattggagc

SEQ ID NO: 32 - DNA, 1271 bp, Agrobacterium tumefaciens str. C58
caaactctttgtttcttgtttgttgattaacccttaattaatccgggcgcgcctgatttatcacaagtttgtacaaaaaagcaggctcctgcaggaccatgacagtccgttcgcttttcctgctgcccggtgatggtatcggccctgaagccatgactgaggtccgcaagctgatcgaatatatgaacagcgcgcacaatgccggctttaccgtttctgagggcctcgtcggcggttccgcttacgacgcgcatggcgtcgcgatttccgatgcggacatggaaaaggcgcttgccgccgatgcaatcctgttcggtgccgttggcggcccgaaatgggatggcgtgccgtatgagcatcgcccggaagccggactcctgcgcctgcgcaaggatctcgaacttttcgccaatctgcgcccggccatctgctatccggcgctcgctgccgcctcatcgctaaagccggaactggtcgagggtctcgatatcctcatcgttcgcgaactgaccggcggcgtttatttcggtgaaccgaagcagatcatcgatctgggcaacggccagaagcgcggtatcgacacgcagatctacgacaccttcgagatcgagcgcatcgccagcgtcgctttcgaactggcccgcagccgcgacaaccgcgtttgctcgatggaaaagcgcaacgtgatgaaatcgggcgttttgtggaaccaggtcgtcaccgaaacccacgcggccaaatacaaggacgtgcagctagaacatatgctagccgatgccggcggcatgcagctggtgcgcaagcccaagcagttcgacgtgatcgtcaccgacaacctcttcggcgacatgctgtccgacgtggccgccatgctgactggctcgctcggcatgctgccatcggcctcgctcggcgcacctgatgccaagaccggcaagcgcaaggccatgtatgagccggtgcacggttctgcccctgacatcgctggcaagagcattgccaacccgatcgccatgatcgcgtccttcgccatgtgcctgcgctactcgttcaacatggtggacgaagccaccaagctcgaggcggcgatcgccaatgtattggacaagggcatccgcaccgccgacatcatggccgacggttgccgtcaggtcggcacgtctgacatgggtgacgcggttctcgccgaattcaaggcgctttcggcgtaactcgagaccagctttcttgtacaaagtggtgataaattggagctctgcagagctttcgtt

SEQ ID NO: 33 - DNA, 1167 bp, Bacillus subtilis subsp. subtilis str. 168
gctttcaaactctttgtttcttgtttgttgattaacccttaattaatccgggcgcgcctgatttatcacaagtttgtacaaaaaagcaggctcctgcaggaccatgcgtagtcattctgtagtttgtattggggaattgttgattgatttcttttgtaccgatgttgacgttgatttaatggaagggcgccaattcctgaaaagtgccggcggggcaccggcgaatgtgtcggcagcgattgccaagctgggcggagacgccgctttcagcggaaaagtaggaaaggatccgtttgggtattttctgaagcgaacattggacgctgtacatgtcgatacctctatgctggtgatggatgagaaagcgcctacaacgcttgcttttgtttcattaaaacaaaatggagagcgtgactttgtttttaatagaggcgcggacgctttgtttacgctggaggacattgaccaggaaaaactaaacgaagcgaaaatccttcatttcggctctgcgacggcactgttatcggatccgttttgctcagcctatttacggttgatgtcgattgcgaaagacaatggacagtttatttcgtttgaccctaactaccgtgaagatttatggaggggaagagtctcagagtttgtaagtgttgcgaaaaaagcgatcgctgtaagtgattttgtgaaagtcagtgacgaggaacttgagattatcagcggtgtgaaggatcatgaaaagggagttgcgatccttcatgagatcggagccaacattgtcgctgtgacacttgggaaaagcggaacgcttctttccaatggaaaagaccgtgaaatcattccaagcattccggtgacatcaattgactcaacaggggcgggagatgcttttgtcggtgcggctttatatcaattggcaaacacggatcagattcaatctgtagatgctgattttgtgaaactgcgtgagattgtggcgtttgccaataaggtcggagctcttgtgtgcactaaaattggagcgattgatgcactgccgagtttggatgagattggagtttctttgtaaatcattgaagatgtttcttgaaagtctttggacttttgggctcgagacccagctttcttgtacaaagtggtgataaattggagctctgcagagctttcgtt

SEQ ID NO: 34 - DNA, 472 bp, Arabidopsis thaliana
ttaattaacagagaccattaaacacacgaaaaattaaaaaaggttaaggaaacgaaaatatgatgatgaagtcgttgatctgtctctctctcatcctcctcccacttgtctccgtcgtggaaggtctcggtggtggtggtggtcttggtagccggaagccgatcaagaatgtatctgatccggatgttgttgcggtcgccaagtatgccatcgaggaacataacaaggagtcgaaggagaagttggttttcgtcaaggttgtggagggaacgacgcaagtggtctccggtacaaagtacgatctgaaaattgcggcgaaggatggtggtggtaagatcaagaactatgaggctgttgttgttgaaaagctttggcttcattctaagagccttgagtctttcaaggcgttatagatctttaattggattttttgtagatcgatctctctctcgggtatatctatcggcgcgcc

SEQ ID NO: 35 - DNA, 1846 bp, Xenorhabdus nematophilus
tcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctcgttttggcttacaaaagctttatatccacggcacttacgttaatagcgttaatcccgataaaaatacttttgatgcgatcaatccagctaatggtgaggtcatcgctcaattacaatctgcaacagagcaggatgttgagctggccgtcaaaagtgctcagaaagggcagaaaatctgggcaacgatgactgccatagaacgttcacggatcttactcaaagcggttaatatcctgcgcgaacgcaatgatgaactggctgagttagaaacactggataccggcaagccactgtctgaaactcaatatgttgatattgtcactggtgcggatgtgctggaatattacgctggcttgatccattctctcgaaggtcagcaaattccattgcgcgaatcttccttcgtctatacgcgccgtgagccactcggtgtcgttgccggtatcggggcctggaactatccaattcaaattgccctctggaaatcagcgccagcattggcggccggtaatgctatgattttcaaacccagtgaagtcacgtcactcaccgccctgaaattagccgaaatttatactgaagcaggtgtgccagatggggtgtttaacgttctgactggcgcgggtcatgaagtgggtcacactctgacagtacatccgaaaatcgccaaaatgtcgtttacgggtggcattgtcacaggcaaaaaagtcatggcgaatgcatcaggatcaaacttgaaagaagtcacgatggagctgggtggaaaatccccgctgatcatctttgatgatgccgatctggatcgtgctgccgatatcgccatgatggcaaactttttcagctccggtcaggtctgcaccaatgggacacgagtttttgtcccgaaaggactggctccccaatttgaagccaaaattgttgagcgtgttaaacgcattcgcattggctctcccctcgatccaaataccaactttggccctctggtgagctttccacatatggaatctgtattgcgttacatcgaaagtggtaagtctacccatgcacgactactgtgtggcggtgagcgtctgctggaaggtgaattggcgaaaggcgcattcgttgcaccaacggtatttagcgactgcacagatgatatgctgattgcgcaggaagaaattttcggccctgtcatgtgtatcctgacctatgaaacggaagatgaagtaatcaaccgcgccaataacaccgattatggcctcgcagcaggattagtgacacaagatctatcccgtgcacatcgcgtgatccatcaactggaagcagggatctgctggatcaacacatggggagaatctcaagccgccatgcccgtcggtggctacaaacattctgggattggccgtgaaaatgggctcgtcacactgcaaaattacacacaaaccaaatcaatacaggtggaactgggtaattttgaatccctattttaatccatgactgaaacagaggagataacaatggtatttgactcgagacccagc

SEQ ID NO: 36 - DNA, 2466 bp, Escherichia coli K12
catttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaactcgccgcctgttttctgacactccttcctggcttcgccgttgccgccagctggacttctccggggtttcccgcctttagcgaacaggggacaggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccgcctcaatggcgattgttcagggacggcgaatatacgctgcaaatagacacccgctccggtacgccaacattgatgatttccatccagaacgccgccgaaccggtagcaagcctggtccgtgaatgcccgaaatgggatggattaccgctcacagtggatgtcagcgccactttcccggaaggagccgccgtacgggattattacagccagcaaattgcgatagtgaagaacggtcaaataatgttacaacccgctgccaccagcaacggtttactcctactggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaatcgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctagcctttttgccggatatcaaaaccgaatcaactaccgcttctggtctgccggtgttctataaaaacaaaatggatacccacgccaaagccattgacggctatacgccgcgcgattacttaacccactggttaagtcagtgggtccgcgactatgggattgatggttttcgggtcgataccgccaaacatgttgagttgcccgcctggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgactgtctggcgcagatggatacgacctggcagcaaatggcggagaaattgcagggtttcaacgtgttgagctacctctcgtcgcatgatacccgcctgttccgtgaagggggcgacaaagcagcagagttattactattagcgccaggcgcggtacaaatcttttatggtgatgaatcctcgcgtccgttcggtcctacaggttctgatccgctgcaaggtacacgttcggatatgaactggcaggatgttagcggtaaatctgccgccagcgtcgcgcactggcagaaaatcagccagttccgcgcccgccatcccgcaattggcgcgggcaaacaaacgacacttttgctgaagcagggctacggctttgttcgtgagcatggcgacgataaagtgctggtcgtctgggcagggcaacagtaacttttccggcttcccgttcgtcagtacctcgggaagatttaaatacccagcaaatacccagcaaattggagctctgcagagctttcgttcgtatcatcggtttcgacaa

SEQ ID NO: 37 - DNA, 826 bp, Synechocystis sp.
ctctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgactaattggttagaacatagcgtgcaagtggaagtggatgcccccatcgaattggtgtggcaactgtggtctgacctggagcagatgccccgctggatgaaatggatcgattccgtcaaagtactggaagacaatcccgacctttcccgctggaagttggccagtggcagtttggaattcacctggttgtcccggattactaagttaatttcccaacaaataatccaatgggaatcggtggatggtttacccaaccggggcgcagtgcgtttttatgaccgccatggcaaaagcattgtccgcctcaccattgcctatagcgtcccaggctggttggcattgctaatggataatctcttcctcggtcgggtggtggaatccactattcaagctgacttggaacgatttcgggaatatatcaataatttgcaggcttcctgaatttaaatacccaccaaatacccagcaaattggagctctgcagagctttcgttcgtatcatcggtttcgacaacgttc

SEQ ID NO: 38 - DNA, 1441 bp, Escherichia coli K12
ctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaagaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggcatcatcgaaggtctgatgaccaccgttcacgctactaccgctactcagaaaaccgttgatggcccgtctcacaaagactggcgcggcggccgcggcgcttcccagaacatcatcccgtcctctaccggtgctgctaaagctgtaggtaaagtactgccagaactgaatggcaaactgactggtatggcgttccgcgttccgaccccgaacgtatctgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagctggtatcgctctgaacgacaacttcgtgaaactggtatcctggtacgacaacgaaaccggttactccaacaaagttctggacctgatcgctcacatctccaaataagttgagatgacactgtgatctaaaaagagcgacttcgctcgagacccagctttcttgtacaaagttggcattataagaaagcattgcttatccccaaatacccagcaaattggagctctgcagagctttcgttcgtatcatcg

SEQ ID NO: 39 - DNA, 1413 bp, Arabidopsis thaliana
ttaattaacacaaaatcatacgtttttccacaaatggatcaagaagaggaagagatcgagattcctaattactttatctgcccaatctcactagagatcatgaaagatccagtcacgaccgtttctggcatcacttacgaccgtcaaaacatcgttaaatggctcgaaaaggtcccttcttgtcccgtcacgaagcaacctcttcccttagactccgatcttacacctaaccacatgcttcgccgtcttatccaacactggtgcgtcgagaacgagacacgtggcgttgtcagaatctctacacctcgagttcctcctggaaaacttaacgtcgtcgaagagatcaagaatctcaaaaagttcggccaagaagccttaggaagagaagaaacgttgcagaagcttgaagttttggcaatggacggaaataacagaagattgatgtgtgaatgtggcgtacataagtctttgatcttgttcgtagtcaagtgtactagtgaagacgaagacggacgacgtcgtatcaaaggactagatgagtctcttcgtcttcttcacttgatcggtattccatcaaacgacgcaaaaacaatcttgatggaaaacgatcgagttatggaatcgttgacttgggttttacaccaagaagactttctcagtaaggcttatacaattgtgctattgaggaatctaacggaatacacttcctctcatatcgtagagagattgaatcccgagatttttaaagggatcatagggtttctcaaggatgttgtaaatagtgttaatcggacgagccctaccgtgagagaaacggtacagtcatcatcaaggcctagcttgggaaaaacggaaccatcaaaacttgatcatagtttggtcatcaaacaagcggtgactgccgcgctgatgattcttttagagacttcttcgtggagccgaaaccgatcactccttgtggatctcggtgcggtttctgaactcatcgaactcgaaataagctacactggcgagaaaagaatcacagaacttatgttaggagttttatctcgtttatgttgctgtgcgaacggtagagccgagattcttgctcataggggcggaatcgcggttgtgacaaagcggctattgagggtttcacctgcggcagacgatagagctatctctatcctaactacagtgtcaaaattctcgccggaaaacatggtggtggaagagatggttaatgttgggacggtagagaagctctgttccgttctaggaatggattgtggtttgaacttgaaggagaaagcaaaagagatactaaaagatcattttgatgagtggaagaagtttccatgtattgacataactcttctcactaagctgctaagcatctcacccaaagggccaaagatctaagggcgcgcc

SEQ ID NO: 40 - DNA, 2333 bp, Arabidopsis thaliana
ttaattaatagaataacagttccctctgcgtgtttcctaaaccaatacaaaaaatggcgaaatcagagaaacacaaattagctcaaaccttaatcgattcaataaacgagatcgcttcaatttccgattccgttacaccgatgaagaagcactgcgctaacctctcccggcgattgtcgcttcttcttcctatgttggaagagatcagagacaatcaggaatcatcttcggaagtagtgaatgctttgttatctgttaagcaatcgcttcttcatgctaaggatttgctttctttcgttagccatgttagcaaaatttacctggtgtgtgagtatttcgattctaaacatacttagatctgagtgtagttgaaatcgaaatcgaaatatgaatctgattgattcctgtaggtgttggagagagatcaagtgatggtgaaatttcagaaagtgacttctctattggaacaagctttaagtataatcccttatgagaatctggaaatttcagatgaacttaaagaacaggtactactaaaaccattatctgctctgcttttgttcttgttcatgaaacttcagcttttcagattcatttctggttgttgtaggtggagcttgttttagttcagttaagaagatcgttaggaaaacgcggtggcgatgtgtatgatgatgagttgtataaggatgttctatctctttatagtggtagaggtagtgtaatggagtctgatatggttaggagagtggcggagaagcttcagttgatgactataactgaccttacgcaagagtcattggctttacttgacatggttagttctagtggtggtgatgatcctggtgaaagttttgagaagatgtctatggttcttaagaagattaaggactttgtgcaaacttataatcctaacttggatgatgctccattgagactgaaatcatcgcttccgaagtcgcgagatgatgatcgagatatgctaattccgcctgaagagttccgttgtccaatatctctagaattgatgactgatccagttattgtttcttcagggcaggtactgtaaaagcattattctccctttacttgtctttttaattcattttcaatttttttgattggtgtcgttgaaatcctgtgtagacttatgaacgtgagtgcattaagaagtggcttgaaggaggacacttgacgtgtccaaagacgcaagaaacgctgacaagcgatatcatgacaccaaactatgttctaagaagccttatagctcaatggtgtgagtccaatggcatcgaacctccaaagcgtcccaacatatctcaaccgagtagtaaggcctcatcttcgtcgtcagcccctgatgatgaacataacaagattgaagaacttctacttaagctcacatcgcaacagcctgaagaccgaagatctgctgcaggagaaatccgtcttctagcaaaacaaaacaatcataaccgagtcgccattgctgcctcaggcgcgatccctcttctggtgaatctcctcacgatatctaatgactctcggactcaagaacacgctgtgacatcgattcttaacctctcgatatgtcaagagaacaaagggaagattgtttattcatctggagcagttccaggtattgttcatgtgcttcagaaaggtagcatggaagctagagaaaacgcagcagctacacttttcagcctctcggttatagacgagaacaaagtgacaataggtgccgcaggagcgatcccgcctcttgtgaccttgctgagcgaaggatcacagagaggcaaaaaagacgcggcaactgctctgtttaatctctgcatatttcaaggaaacaaaggaaaagctgtgagagccggtttagttcccgtgctaatgaggttactaacagaacccgaaagcggaatggttgatgaatcactctcgatattagccatactatcgagtcatccggacgggaaatcagaggttggagccgctgatgcagttccagttctggtagattttataagaagcgggtcaccgcggaacaaagaaaactcagctgcggtattagtgcacttgtgttcatggaatcagcaacatttgattgaagctcagaaattagggattatggatcttttaatagaaatggctgagaatggtactgacagaggaaaacgcaaagcggcacagttacttaaccgctttagccgttttaacgaccagcagaaacaacactctggtttaggtttggaagatcaaatctccctaatctgagagtttagtgtttaaggtttgcttatacattttcacattttgctcacttttggcgcgcc

SEQ ID NO: 41 - DNA, 1112 bp, Arabidopsis thaliana
ttaattaaatctaaacccaatgtcgaaatccggcgataatcaaccagttgatagatacctccgccgtcaaatcctcggagaaggaacatacggtgtcgtttacaaagccaccgacacaaagactgggaaaactgtagcagtgaagaagataagattaggaaaccaaaaggaaggagtaaatttcacagctttaagagaaatcaagctactaaaagagctgaatcatccacatatcgttgaactcattgatgctttccctcacgatggaagtttgcatctagtttttgagtatatgcaaacagatttagaagcagtgattcgtgatcgtaatatctttttatctcctggtgatattaagtcttatatgttgatgactttgaagggtttagcttattgtcataagaaatgggttcttcacagggatatgaagccgaataatttgttgattggagagaatggtttgttgaagttggctgattttggtttggcgaggttgtttgggagtccgaatcggaggtttactcatcaggtatttgctacatggtacagagcgcctgagttactgtttgggagtcgacagtatggagcaggagttgatgtttgggctgcaggctgtatttttgctgagttactacttcgtagaccatttcttccgggttctactgagattgatcaacttggaaagatctttcaagcgtttggtactccagtaccttcccaatggtctgacatgatctatctcccagactacatggaattctcctatacacccgctccaccattacgtaccattttccctatggcaagtgatgacgctttggatcttctagcaaaaatgttcatctacgacccacgtcaaaggatcacaatacaacaagctttagaccacaggtatttctcgtcttctccatcaccaactgagccagggaagcttcagattccagcttccaaaggagacgcactcgaaccaaaggcctccgagcaaaaccaacatggaaatagcccagcggtactgtctcctcctggtaaaatgaggagagtgatgggtcctgaaggattcacttgagaagatgatgtttcatttcttttggaaaatatcaatggggcgcgcc

SEQ ID NO: 42 - DNA, 1282 bp, Arabidopsis thaliana
ttaattaacaccaccaccaacctcaaaagctttcatctttaccggtcatggacggtggttcaggtcaaccggcggctgatacagagatgacagaagctcctggaggttttcccgcggcggctccatcgcctcagatgcctgggattgagaatattccggcgactcttagccatggtggtaggtttattcagtataacatatttggaaacatcttcgaggtcaccgctaagtataagcctccgatcatgcctattggcaagggtgcttatggcatcgtttgttcggctatgaattctgaaactaacgagagcgttgcgattaagaaaattgctaacgcttttgacaataagattgatgctaagaggactctccgtgagatcaagctgcttcgtcacatggatcatgaaaatattgttgcaatcagagatattatcccgccaccattaagaaacgctttcaacgatgtttacatcgcgtatgagttaatggacactgatctccatcaaatcattcggtcaaatcaagcattatccgaagaacattgccagtattttctttaccagatcctccgtggattgaaatacattcactctgcaaatgtgcttcacagggatttgaaaccaagtaatctcctcctgaacgcaaactgcgacctaaaaatctgcgattttgggctagctcgagtcacttctgagagtgatttcatgactgaatatgttgtcacgagatggtaccgtgcaccagagcttctcttaaactcttctgattatactgcagctatcgatgtttggtctgtaggctgtattttcatggagttaatggaccgtaagccactcttccctggacgagatcatgtccatcagcttcgcttgctcatggagctcataggaactccatcagaagaagagctcgagttcttgaacgaaaacgcaaagcgatacataagacagcttccaccttatcctcgccaatccatcactgataagttcccgacagtgcatcctttagctatagaccttatcgagaagatgttaacatttgatcctagacggagaatcacagttttagacgcattggcccatccatacctgaactcgttgcacgacataagcgatgagccagagtgtacaatacctttcaactttgattttgaaaaccatgcactctcagaggagcagatgaaggaactaatctaccgcgaggcgcttgctttcaatccagaatatcagcaatagtttgaagaacagcatttgggagatgaagatgagataaggggcgcgcc

SEQ ID NO: 43 - DNA, 1038 bp, Arabidopsis thaliana
ttaattaattcattttccttgttaatgagacgacttggctcgattaaaactcagagaagaacttctatccaaaagggttacgtgcaatttttcgatatcaagaccctcgagaaagcgacaggcggttttaaagaaagtagtgtaatcggacaaggcggtttcggatgcgtttacaagggttgtttggacaataacgttaaagcagcggtcaagaagatcgagaacgttagccaagaagcaaaacgagaatttcagaatgaagttgacttgttgagcaagatccatcactcgaacgttatatcattgttgggctctgcaagcgaaatcaactcgagtttcatcgtttatgagcttatggagaaaggatcattagatgaacagttacatgggccttctcgtggatcagctctaacatggcacatgcgtatgaagattgctcttgatacagctagaggactagagtatctccatgagcattgtcgtccaccagttatccacagagatttgaaatcttcgaatattcttcttgattcttccttcaacgccaagatttcagatttcggtcttgctgtatcgctggatgaacatggcaagaacaacattaaactctctgggacacttggttatgttgccccggaatacctccttgacggaaaactgacggataagagtgatgtttatgcatttggggtagttctgcttgaactcttgttgggtagacgaccagttgaaaaattaactccagctcaatgccaatctcttgtaacttgggcaatgccacaacttaccgatagatccaagcttccaaacattgtggatgccgttataaaagatacaatggatctcaaacacttataccaggtagcagccatggctgtgttgtgcgtgcagccagaaccaagttaccggccgttgataaccgatgttcttcactcacttgttccactggttccggtagagctaggagggactctccggttaacaagatgattcacagaaacacgccaaaagaaatccaaagccatttagaggcgcgcc

SEQ ID NO: 44 - DNA, 1458 bp, Arabidopsis thaliana
atgaagagtttcaacacagaaggacacaaccactccacggcggaatccggcgatgcctacaccgtgtcggacccgacaaagaacgtcgatgaagatggtcgagagaagcgtaccgggacgtggcttacggcgagtgcgcatattatcacggcggtgataggctccggagtgttgtctttagcatgggctatagctcagcttggttggatcgcagggacatcgatcttactcattttctcgttcattacttacttcacctccaccatgcttgccgattgctaccgtgcgccggatcccgtcaccggaaaacggaattacacttacatggacgttgttcgatcttacctcggtggtaggaaagtgcagctctgtggagtggcacaatatgggaatctgattggggtcactgttggttacaccatcactgcttctattagtttggtagcggtagggaaatcgaactgcttccacgataaagggcacactgcggattgtactatatcgaattatccgtatatggcggtttttggcattattcaggttattcttagccagatcccaaatttccacaagctctcttttctttccattatggccgcggtcatgtcctttacttatgcaactattggaatcggtctagccatcgcaaccgtcgcaggtgggaaagtgggtaagacgagtatgacgggcacagcggttggagtagatgtaaccgcagctcaaaagatatggagatcgtttcaagcggttggggacatagcgttcgcctatgcttatgccacggttctcatcgagattcaggatacactaagatctagcccagctgagaacaaagccatgaaaagagcaagtcttgtgggagtatcaaccaccacttttttctacatcttatgtggatgcatcggctatgctgcatttggaaacaatgcccctggagatttcctcacagatttcgggtttttcgagcccttttggctcattgactttgcaaacgcttgcatcgctgtccaccttattggtgcctatcaggtgttcgcgcagccgatattccagtttgttgagaaaaaatgcaacagaaactatccagacaacaagttcatcacttctgaatattcagtaaacgtacctttccttggaaaattcaacattagcctcttcagattggtgtggaggacagcttatgtggttataaccactgttgtagctatgatattccctttcttcaacgcgatcttaggtcttatcggagcagcttccttctggcctttaacggtttatttccctgtggagatgcacattgcacaaaccaagattaagaagtactctgctagatggattgcgctgaaaacgatgtgctatgtttgcttgatcgtctcgctcttagctgcagccggatccatcgcaggacttataagtagtgtcaaaacctacaagcccttccggactatgcatgagtga

SEQ ID NO: 45 - DNA, 1373 bp, Ralstonia metallidurans
ttatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggccgtactcctgcctcgtatcgttgtgctcgcgactggtggcaccatcgccggttcgtccgcaaatcctgccagtagcgcgcactatcaggctgcgacagtgcccgtatcgcaacttgtacaggcagtgcccgcgctggccgatgtggcgcgagtcgaggcggagcaggtggcgcaggtggacagcaaggacatgatgttcgatctctggcggatgcttgccgcgcgaatcgggtattggtccgcgcaggacgatgtcgccgggatcgtgatcacacatggcactgacacgctggaagagacggcgatgttcctgcatctgacacaggcttgcccgttgcctgtcgtgatgacggcggccatgcgcccatcgacgtcgctttccgctgacgggccgctgaacctgctcgatgcggtgcgcgtggcggcaagcccggtggcagttggcaaaggtgcgctcgtggtgctgaatcagcagattcatgccgcgcgtgatgtcgtcaaggcgcatacgtcggctgtcgatgctttccattcgccagttgccggtccgctgggttttgtgcaggacacctatgtccatttctcgcgcaccccgggtcctgatcaggcgccgcgcttgccggtgcccgctgcatggccgttggtggagatcgtcgccagctacgcgcagccggggagggtgggtatcgatgcgatggtggccgccggcgtgctcgggtttgtcgtggccgcggccggcaacggttccgtgcacgaaacgctgacggccgcgctggtcgatgctgcggcatgtggcgttgcggtggctcgaagctcgcgtaccggtgctggtcatgtggcaatccccgcaccgccgcgaccggcaggtggcgtatttgtctcggcgggcgacctcaatccctacaaagcgcgcgtgctgctgctgctggcgttggccggcgacccttcgctggggcgcgatgcggcccggcttcaggcgctcttcgagcggtactgactcgagacccagctttcaaatacccagcaaattggagctctgcagagc

SEQ ID NO: 46 - DNA, 1054 bp, Arabidopsis thaliana
ttaattaaatgtctgggctgctggatggaatccccgaagcagtggctctgagatgcctggctcatgtgcctttacaccttcatcccaatttagaactcgtctctcgctcctggcgagctgctatccgcagtcatgagctcttcagagtccgtaaagagctccgatcttctgagcatctcctctgcgtctgtgctttcgatcctgagaacatctggcaagtctacagtcccaactgtgatcgctggctcaccctccctctccttccttctcgtatccgccaccttgcccatttcggtgctgtcactactgccggcatgctctttgtcttaggcggtggcagcgacgctgtcagccctgttaccggggatcacgacggtacctttgctactgaccaggtctggtcttacgactttgtacagagacagtggactcctcgcgcttcaatgctcgtgcctcgtgctatgttcgcctgctgcgttcttcaagggaagattgttgttgctggcggattcaccacttgcaggaaatccatatctggagcggagatgtatgatcctgagaatgacgtctggacatccatcccagatctccaccagactcataactctgcctgctcgggtctagtggtaaacgggaaagtccacgtcttgcacaaaggcttgtccacggtgcaggttcttgagagcgttaaactcgggtgggatgtcaaagactatggctggccgcaaggtccaatggtggtcgttgaggacgtgctttacgtgatgagccatgggctggtgttcaagcaagaaggtgacacgtggaagatggttgcatcggcctcagagtttaagcggaggatcggaatggcgatgacgagtttgagtgatgaggttttgatcgtaggaggagtgatcggacctgataggctcaattgggacatcaagcccttgtcagatgtcgacgctttgacagttgggaatgatcgtccggcctggaggagtgtggcgccgatgacaaggtgtcgtgggacgatccttggctgcacgcagttgacaatctgaggcgcgcc

SEQ ID NO: 47 - DNA, 1851 bp, Arabidopsis thaliana
ttaattaaatgttctctttgaacatgagaaccgaaatagaaagtttgtgggtatttgctcttgcatcaaaattcaatatttacatgcaacaacattttgcttcccttctcgtcgccattgctatcacttggtttaccataaccatcgtattttggtctactccgggtggaccggcttggggaaaatacttcttcactcgccggtttatttctctcgattacaaccgaaaatacaagaatctcattcccggtcctagagggtttccacttgtgggaagcatgagccttaggtcaagccacgtggctcatcagcgcatagcgtctgtggctgagatgagtaacgccaagcggctcatggcgtttagcctcggtgatactaaggtggtggtgacgtgtcatcctgccgtggcaaaggagatactaaacagttcggtttttgctgaccgaccggttgacgaaaccgcttacggtttgatgtttaaccgagccatgggatttgctcccaatggtacttattggcgtacgctgcgtcggttaggctcgaaccatctttttaacccgaagcaaatcaaacaatcggaggatcagagacgggtgatagcgactcagatggtgaatgcgtttgcacgtaaccctaaatccgcgtgtgcagtgcgtgatttgctcaaaacagcgtcgttgtgtaacatgatgggtttggttttcgggagagagtatgaattggagtcaaataacaacttggaatctgaatgcttaaagggtttggttgaagaagggtacgatcttctaggtacgttaaattggaccgaccatcttccttggttagccggtttagatttccaacaaatccggtttaggtgctcgcagctcgtaccgaaagtaaatctgttattgagccgtatcatacatgaacaacgtgctgccacgggtaactttcttgacatgttactttctcttcaaggttcagaaaaattatcagaatccgacatggttgctgttctttgggtaagttttgtcttttaatcactattcaatccgtatatcatgaatatcaacattagtcaactagataacatctaagaagaatccataaaatttactaattaagtaagtgtattaagtatacaatagattaacaattgtttggttttatatcaaatcatggaaatgattaagaaaaatttctcttacgatattaacttttttggtccgtttaggaaatgatatttaggggaacggacactgttgcggttttggtcgagtgggtgctagcgaggattgtgatgcatcccaaagttcaattaacggtccacgatgagcttgaccgagtcgttggcagatcaagaaccgtggatgagtcagaccttccatcactcacgtatctaacggctatgatcaaagaagtgttgaggctgcatccaccaggtccactgctttcttgggcacgactgtctataacagacacttccgtagatggatatcacgtgccggctgggaccaccgcgatggtcaacatgtgggctatagcacgtgacccacacgtgtgggaggatcctttagagtttaagcctgagaggttcgtggctaaagagggtgaagctgagttctctgttttcgggtcggatctgaggttggcaccgttcgggtcgggtaagagggtttgccctggaaagaatttgggacttacaacggtgtcgttttgggttgcaacgctcttgcatgagtttgagtggcttcctagcgtcgaagctaaccctccagatctctcggaggttttgaggctctcgtgtgagatggcttgtccactcatcgttaacgtaagctcaaggcgtaagataatgtaaggcgcgcc

SEQ ID NO: 48 - DNA, 2832 bp, Ralstonia metallidurans
aactctttgtttcttgtttgttgattaacccttaattaatccgggcgcgcctgatttatcacaagtttgtacaaaaaagcaggctcctgcaggaccatgtatcagcacatcaaggtgccggcaggcgagaagatcaaggtcaacgccgatctttcgctgaacgtgccggataatccgatcattccctacatcgaaggtgacggcacgggtgtcgatatcaccccggtgatgctgaaagtggtggatgccgccgtggccaaggcgtatggcggcaagcgcaagatctcgtggatggagatctacgcgggcgagaagtcgaccaaggtctatggcccggatgtgtggctgccggaagagaccatggaagtggtcaaggaatacgtggtgtcgatcaagggcccgctgaccacgccggtcggtggtggcatccgctcgctgaacgtggcactgcgtcagcagctcgatctctatgtctgcttgcgcccggtgcgttatttcaaaggcgtgccgtccccggtgcgcgagcccgagaagaccgacatggtgatcttccgcgagaactcggaagacatctatgccggcatcgagtgggaagccgaaagcgaaggcgcgaagaagctgatcgccttcctgcagaacgaaatgggcgtgaagaagatccgcttcccggaaacgtccggcatcggcatcaagcccgtctcgaaggaaggcacgcagcgcctggtgcgcaaggcgctccagtacgcgatcgacaacgacaagccgtcggtgacgctcgtgcacaagggcaacatcatgaagttcaccgaaggcggcttccgcgactggggctatgaactcgcgcagcaggaatttggcgcggaactggtcgatggcggcccgtggtgcaagttcaagaatccgaagactggccgcgatatcgtcgtcaaggacgctatcgccgacgcattcctgcagcagattctgctgcgtccagctgaatattcggtgatcgccacgctgaacctgaacggtgactacatctccgacgccctggccgcccaggtgggtggcatcggcatcgcaccgggcgcgaacatgtccgattcggtcgccatgttcgaagccacgcacggcaccgcgccgaagtatgcaggcaaggactacgtgaatccaggttcggaaatcctctccgcggaaatgatgctgcgccacatgggctggaccgaagcggccgacctgatcatccgctcgatggagaagtcgatccagtcgaagaaggtcacgtacgacttcgcccggctgctagaaggtgcgacgcaggtgtcgtgctcggggtttggtcaggtgatgatcgacaatatgtaactcgagacccagctttcttgtacaaagtggtgataaattggagctctgcagagctttcgttcgtatcataactctttgtttcttgtttgttgattaacccttaattaatccgggcgcgcctgatttatcacaagtttgtacaaaaaagcaggctcctgcaggaccatgtatcagcacatcaaggtgccggcaggcgagaagatcaaggtcaacgccgatctttcgctgaacgtgccggataatccgatcattccctacatcgaaggtgacggcacgggtgtcgatatcaccccggtgatgctgaaagtggtggatgccgccgtggccaaggcgtatggcggcaagcgcaagatctcgtggatggagatctacgcgggcgagaagtcgaccaaggtctatggcccggatgtgtggctgccggaagagaccatggaagtggtcaaggaatacgtggtgtcgatcaagggcccgctgaccacgccggtcggtggtggcatccgctcgctgaacgtggcactgcgtcagcagctcgatctctatgtctgcttgcgcccggtgcgttatttcaaaggcgtgccgtccccggtgcgcgagcccgagaagaccgacatggtgatcttccgcgagaactcggaagacatctatgccggcatcgagtgggaagccgaaagcgaaggcgcgaagaagctgatcgccttcctgcagaacgaaatgggcgtgaagaagatccgcttcccggaaacgtccggcatcggcatcaagcccgtctcgaaggaaggcacgcagcgcctggtgcgcaaggcgctccagtacgcgatcgacaacgacaagccgtcggtgacgctcgtgcacaagggcaacatcatgaagttcaccgaaggcggcttccgcgactggggctatgaactcgcgcagcaggaatttggcgcggaactggtcgatggcggcccgtggtgcaagttcaagaatccgaagactggccgcgatatcgtcgtcaaggacgctatcgccgacgcattcctgcagcagattctgctgcgtccagctgaatattcggtgatcgccacgctgaacctgaacggtgactacatctccgacgccctggccgcccaggtgggtggcatcggcatcgcaccgggcgcgaacatgtccgattcggtcgccatgttcgaagccacgcacggcaccgcgccgaagtatgcaggcaaggactacgtgaatccaggttcggaaatcctctccgcggaaatgatgctgcgccacatgggctggaccgaagcggccgacctgatcatccgctcgatggagaagtcgatccagtcgaagaaggtcacgtacgacttcgcccggctgctagaaggtgcgacgcaggtgtcgtgctcggggtttggtcaggtgatgatcgacaatatgtaactcgagacccagctttcttgtacaaagtggtgataaattggagctctgcagagctttcgttcgtatcat

SEQ ID NO: 49 - DNA, 972 bp, Glycine max
  unsure (1)..(972): unsure at all n locations
acgcacaatcccactatctttggcaagacccttcctctatataaggaaagttcatttcatttggagaggacactctagacagaaaaattttgctacattgtttcacaaacttcaaatattattcatttatttgtcagctttcaaactctttgtttcttgtttgttgattaacccttaattaagaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccatttaaatacccagcaaattggagctctgcagagctttcgttcgtatcatcgggttcgacaacgttcgtcaagttcatgcatcagtttcattgcgcacacaccagaaatctactgagtttgagtattatggcattgggaaaactggttttccttgaccatttgttgnggctggaaattaca

SEQ ID NO: 50 - DNA, 1614 bp, Arabidopsis thaliana
atgttggattctctagtgtcgaaactgccttcgttatcgacatctgatcacgcttctgtggttgcgttgaatctctttgttgcacttctttgtgcttgtattgttcttggtcatcttttggaagagaatagatggatgaacgaatccatcaccgccttgttgattgggctaggcactggtgttaccattttgttgattagtaaaggaaaaagctcgcatcttctcgtctttagtgaagatcttttcttcatatatcttttgccacccattatattcaatgcagggtttcaagtaaaaaagaagcagtttttccgcaatttcgtgactattatgctttttggtgctgttgggactattatttcttgcacaatcatatctctaggtgtaacacagttctttaagaagttggacattggaacctttgacttgggtgattatcttgctattggtgccatatttgctgcaacagattcagtatgtacactgcaggttctgaatcaagacgagacacctttgctttacagtcttgtattcggagagggtgttgtgaatgatgcaacgtcagttgtggtcttcaacgcgattcagagctttgatctcactcacctaaaccacgaagctgcttttcatcttcttggaaacttcttgtatttgtttctcctaagtaccttgcttggtgctgcaaccggtctgataagtgcgtatgttatcaagaagctatactttggaaggcactcaactgaccgagaggttgcccttatgatgcttatggcgtatctttcttatatgcttgctgagcttttcgacttgagcggtatcctcactgtgtttttctgtggtattgtgatgtcccattacacatggcacaatgtaacggagagctcaagaataacaacaaagcatacctttgcaactttgtcatttcttgcggagacatttattttcttgtatgttggaatggatgccttggacattgacaagtggagatccgtgagtgacacaccgggaacatcgatcgcagtgagctcaatcctaatgggtctggtcatggttggaagagcagcgttcgtctttccgttatcgtttctatctaacttagccaagaagaatcaaagcgagaaaatcaactttaacatgcaggttgtgatttggtggtctggtctcatgagaggtgctgtatctatggctcttgcatacaacaagtttacaagggccgggcacacagatgtacgcgggaatgcaatcatgatcacgagtacgataactgtctgtctttttagcacagtggtgtttggtatgctgaccaaaccactcataagctacctattaccgcaccagaacgccaccacgagcatgttatctgatgacaacaccccaaaatccatacatatccctttgttggaccaagactcgttcattgagccttcagggaaccacaatgtgcctcggcctgacagtatacgtggcttcttgacacggcccactcgaaccgtgcattactactggagacaatttgatgactccttcatgcgacccgtctttggaggtcgtggctttgtaccctttgttccaggttctccaactgagagaaaccctcctgatcttagtaaggct

SEQ ID NO: 51 - DNA, 1197 bp, Arabidopsis thaliana
atggaagaataccagcatgacaacagcaccactcctcaaagagtaagtttcttgtactctccaatctcttcttccaacaaaaacgataacacaagtgataccaacaacaacaacaacaataataatagtagcaattatggtcctggttacaataatactaacaacaacaatcatcaccaccaacacatgttgtttccacatatgagctctcttctccctcaaacaaccgagaattgcttccgatctgatcatgatcaacccaacaacaacaacaacccatctgttaaatctgaagctagctcctcaagaatcaatcattactccatgttaatgagagccatccacaatactcaagaagctaacaacaacaacaatgacaacgtaagcgatgttgaagccatgaaggctaaaatcattgctcatcctcactactctaccctcctacaagcttacttggactgccaaaagattggagctccacctgatgtggttgatagaattacggcggcacggcaagactttgaggctcgacaacagcggtcaacaccgtctgtctctgcctcctctagagacccggagttagatcaattcatggaagcatactgtgacatgttggttaaatatcgtgaggagctaacaaggcccattcaggaagcaatggagtttatacgtcgtattgaatctcagcttagcatgttgtgtcagagtcccattcacatcctcaacaatcctgatgggaagagtgacaatatgggatcatcagacgaagaacaagagaataacagcggaggggaaacagaattaccggaaatagacccgagggccgaagatcgggaactcaagaaccatttgctgaagaagtatagtggatacttaagcagtttgaagcaagaactatccaagaagaaaaagaaaggtaaacttcctaaagaagcacggcagaagcttctcacgtggtgggagttgcattacaagtggccatatccttctgagtcagagaaggtagcgttggcggaatcaacggggttagatcagaaacaaatcaacaattggttcataaaccaaagaaagcgtcactggaaaccatctgaagacatgcagttcatggtgatggatggtctgcagcacccgcaccacgcagctctgtacatggatggtcattacatgggtgatggaccttatcgtctcggtccataa

SEQ ID NO: 52 - DNA, 2096 bp, Arabidopsis thaliana
  unsure (1)..(2096): unsure at all n locations
ttgtttttgacgaaccagtgtgagtaatttagatcggtattagatccatcttaggtttctctaatttctctcaattcactccaaaattttgattatttcttctttctggcttgtcaattttagtcatttgtaatccttgcttttgcgatcggaatcgtaaaaatccgatctttcttttagattcgttttgtttttgattccaaatcggaaaaatgggtaaagtagctgttggagcgactgttgtttgcacggcggcggtttgtgcggtggctgttttggttgttcgacgacggatgcagagctcagggaagtggggacgtgttttggctatcctcaaggcctttgaagaggattgtgcgactccgatctcgaaactgagacaagtggctgatgctatgaccgttgagatgcatgctggtcttgcatccgacggtggtagcaaactcaagatgcttatcagctacgttgataatcttccttccggggatgaaaagggtctcttttatgcattggacctaggggggacaaacttccgtgtcatgcgtgtgcttcttggcgggaagcaagagcgtgttgttaaacaagaattcgaagaagtttcgattcctcctcatttgatgactggtggttcagatgagttgttcaattttatagctgaagctcttgcgaagtttgtcgctacagaatgcgaagactttcatcttccagaaggtagacagagggaattaggtttcactttctcgtttcctgttaagcagacttctctgtcctctggtagtctcatcaaatggacaaaaggcttttccatcgaagaagcagttggacaagatgttgttggagcacttaataaggctctggaaagagttggtcttgacatgcgaatcgcagcacttgttaatgataccgttggaacactagccggtggtagatactataacccggatgttgttgctgctgttattttaggcactgggacaaacgcagcctatgttgagcgtgcaaccgcgatccctaaatggcatggtctgcttccaaaatcaggagaaatggttataaacatggaatggggaaacttcaggtcatcacatcttccattaaccgagtttgatcacacgctggatttcgagagtctgaatccaggcgaacagattcttgagaaaatcatttccggtatgtacttgggagagattttgcgaagagttcttctaaagatggctgaagatgctgctttctttggcgatacagtcccatctaagctgagaataccattcatcattaggactcctcacatgtcggctatgcacaacgacacttctccagacttgaagattgttgggagcaagattaaggatatattggaggtccctacaacttctctgaaaatgagaaaagttgtgatcagtctctgcaacatcatagcaacccgaggagctcgtctctctgctgctggaatctatggtattctgaagaaactgggaagagatactactaaagacgaggaggtgcagaaatcggttatagccatggatggtggattgtttgagcattacactcagtttagtgagtgtatggagagctcactaaaagagttgcttggagatgaagcttcaggaagcgttgaagtcactcactccaatgatggatcaggcattggagctgcgcttcttgctgcttctcactctctctaccttgaagactcttaaaacctacccaaagagcgccatttttcggtaatttactgaaagcttttcgctatcagaaaacgcctaagccaagttctaaggcgtcataaaagaaagcattccatgtttttactcttccccaagactttctttgtagcaaataagtttccttgggagaaatatttgttttcatgttcttcaaaaataaaagactcagttcttcagattctgggattttattataaccagatatgttgtaaaaactacaaattcaaagctcacttcactggagttctgagtatataaagatttcatttttcctaaaaaaaaaaaaaaaaactaaattactcacactcnnnnnnnnnnnnnnnnnnnnnnnnnnnnnnnnnnnnnnnnnnnnnnnnnnnnctacct

SEQ ID NO: 53 - DNA, 924 bp, Arabidopsis thaliana
atgtcaatgatgagcagaactcgaagcagcatcgccatgggaacaccatctttccttgagttgaagaaacaagcttcatttttcttcaaagagaagcttaaaacggcgcgtttagctctcaccgatgttactcctcttcaactaatgactgaggaagctacggatggtgagtcatgtggaccaaatacacaaaccttagggtccatttcaaaggctgcttttgagtttgaagattacttggcgattgttgaagtcttgcacaaaagattggcaaagttcgataagagaaactggaggatggcttataactcactaatagttgttgagcatttactcactcatggaccagagagtgtttccgatgagtttcaaggtgatatagatgttatctcccaaatgcaaaccttccaacagattgacgagaaagggtttaattggggattagctgttagaaagaaagcagagaaggttttaaagctacttgagaaaggggaattacttaaggaagaaaggaagcgagctcgtgagctgtctcgagggattcaaggtttcggtagctttaaccacaagtcttcatctcattctttgtcagagcatgaagtcttacaagaatctacagtctataggaaatgtaattccaattttaccaagaattacgatgaggatgaccaagagaacactatggtttctcctaatgacgccaacctttttcctcagccgctggtagctgacccgagcgaggaatctaggacgggtatgaaagaaaatatggatcctgaagatgatgagaacacagaggtaaacccacttttgggttttagtaaaaaggagggtcaagaactagccggagaagacgagaaccatccatttacggatggcgagagtaagcatacagtagtcttgcttgatgagaacacagattaa

SEQ ID NO: 54 - DNA, 1101 bp, Arabidopsis thaliana
atgcgtaggtggatctgttgtggggataaaaaaggagattcagatttatcaaatgaagaggtgcatttgaaaagtccatggcaaaattctgaggcaaatcaaaagaatcaaaaaccacaagctgttgtaaagcctgaggcgcagaaagaagctcttcccatcgaagttcctcccttgtctgtggatgaggttaaagaaaagactgacaattttggatctaagtctctgattggtgagggttcttatggaagggtatattatgcaactctaaatgatgggaaagcagttgctttgaagaaactcgatgttgcacctgaagctgaaacaaacaccgagttcctgaatcaggtttccatggtttcaagactaaaacatgagaatctcattcaactggttggttattgtgttgatgaaaacctccgtgttcttgcttatgagtttgcaacaatgggatcactgcacgacattctacatggtaggaagggagttcaaggagcacagccaggtccaacacttgactggttaacgagggtgaagatagctgttgaggcagctaggggtttagaataccttcatgagaaggttcagcctcctgtaatacatagagacataagatctagcaatgttctcctttttgaagactatcaagcaaaagttgcagattttaatctctcaaatcaagctcctgataatgctgctcgtcttcactctacgagagttttaggcacctttggctatcacgctccagaatatgctatgacaggacagttaacgcagaagagtgacgtgtatagctttggggttgttcttctagagcttttgacaggaaggaaacctgtagatcatacaatgccacgcggccaacagagtcttgtaacttgggctacaccgagactcagtgaagataaagtgaagcaatgtgttgatccaaagttaaaaggagaatatcctcctaaatcagtagccaagctagcagcggtggcagcattatgtgtgcaatacgaatctgagtttagaccaaatatgagtatagttgtaaaagctttgcagccacttctcaaaccaccagcaccagccccagccccagtaccggaatcctga

SEQ ID NO: 55 - DNA, 771 bp, Arabidopsis thaliana
atggcttgtacttcatcatctggtgcacacgtgcgttcaacaagctggtccgaagacgttaatcctctgtctcgagccatcgaagatcatcttctgttactaaagaaaagaccagagtccgctcgtcggaaacttggagttttaaagaatctgtacgaggttgtcgaagttttcctccgttttcaaacgactaaaactcaaaagtctttcacaggatttgaagatgtttctgacggattcatcgaggttcttgatatctgcagcacgatcagagacgttctgatggagataaaggaacaagtcagggaactcgaatcaagcttgaggaggagattgatcagaagcaagtcaggagaagatcaagaagctttcgtggcgcgtgagacagacgcgtacgtgtttaagagaagagcactgagcagaaccatcgtcaaacaattgaagaaaacagaggagaagatgaggaagaggaagagagattgtggagatgtcattaatgtaatgaaaagagttgaaaagaccagctttgatgttttggtttctttgttgattgaggtagtgacgaaggatcagagagatcaaaagaaaggatcaaggagaggaattgtgtcgaggatttttaataagaagaatcaagaagttgatgtggatgagctgaagaagttgagagaaacagaacatgagattgaagaaacagagaaagagttggagtgtgtgtataagaaactgttgaagacaagagtttcttttcttaacatgcttactctttga

SEQ ID NO: 56 - DNA, 1035 bp, Arabidopsis thaliana
atgtttggtggaggaagagggcctatgggtggcggcggaggtatgttacgcgccgccggtcgtgcgatgacgaggaccggtgtagccaacggtggtattcaagatccctttgcttcttcatcatcatcgtccacgtcgtctccggctggaaacgcctctgtttcgcatgtccagaaacagagatcttcttcttctgggtcgaataatctgacgtattccgcggcttctgggttgttgttgaatcttccggtggctgcaacctccggatggagcggcggcggtcctttttcctttgttaattctggaggttatgatgattttgagtgggtttctgaggaagaagatgattctctgtttggctctgttccttctgttgatgaagtccaagatgctgtttctgctctccagcaggttttcgatgctagttcatattcccagctggttagagacaaatacgagtgctatccggaaaatggtggtggaaaccagagccctatagccacagggatggttcatcaagttccttcattcgggtcggattcggactggatggagccatcaatgcatttatgccattcaagaacgttaaagcctcatgcttatgatcaggtttacaatgcttttgacctactacgaaccgaaccatctgtccagaaaatggtagtatcattgtcgtctgacaaagcagtttgggaggcggtgatgaacaacgatgtggtgcgagagattagggacttgtacaacaatggcataagtcaagatgaggaaaattcagaagacacccctagggagaataacgcagcaacggatttcataaagtgggtatttgacaacacaatggttaaggccacggaagtgtttgtgaaaataacaaaggtcgtgaccgagctcttcaattgttacaatggtgatggtgttaacaacaaggggaaagatgccaaattcaacaattggctcgaggaaaagctgaccacttcggtcctgctatccatcatcgttatgctggtcgtgatggtatcccgagcctgcaactag

SEQ ID NO: 57 - DNA, 999 bp, Arabidopsis thaliana
atggaccaaaatggtcataacgacgaagcagaaacagtttcatgcggcaacggcaactgcaaaagcaagatcgtgcctggagatgatcacggtggagatgagagtagtggtaccaagagaaggaagaagagaaaaacgcaacaaaagacaatgaaacgacgtgaattaatgtcgtattgtgagctaccggagtacatgaaagacaacgaatacatattgaattattacagagctgattggtccattagagatgctttcttcagcgtatttagtttccacaatgagtccctcaatgtttggacacatttgattggttttatcttctttgtggcactaaccgtcgccaatattattcatcacgacggattcttccccgtggatgcaaagagtccagggaatgtaacaagatggcccttcttcgttttcttaggaggctcaatgttctgcctactcgcaagcagcatttgtcacctcttctgttgccactcaaaagagcttaatgtcttccttctccgaatagactatgccggtatcaccgccatgatcatcacttccttcttcccaccaatcttctacatcttccagtgcactcctcggtggtacttcatctacctcgcaggcatcacatccatgggaatcttcacaatcatcacacttttcaccccatcactttccgctcccaagtaccgagctttccgcgctttgctctttgcctccatggggctgtttgggattgtcccagctgcccacgcgctagtggtcaattggggaaacccgcaaaggaacgtgacgctcgtgtacgagttgcttatggcagtgttctatcttgttggaacaggattctacgtagggagagtgccagaaaggcttaaaccgggatggtttgatcgtgtgggacatagtcatcagatcttccatgtgttcgttttgttgggtgctttgtctcactatgcagctgctctcttgttcttggactggcgtgaccacgttggttgttaa

SEQ ID NO: 58 - DNA, 1884 bp, Arabidopsis thaliana
atgtctgggaggttgctgaagaaggttctccaggaacatgaagattcgaaacttcagaaacatcacgaagaagaagaagaagaggacgaagaagaatcaggagcccgttcttcgattaatccattcgatctcttgaacgatggtgatgaagatcctgaggagattgatgatgagactatagctgagaagaagaacgaagatgcggatcatcagtcaagtgtcgctgatcatgtgcagccggtgtcaaagaataagtcgaagaaaaagaaaaagaagaagaacaaagagagtggctctaatgtgcctaaagctgaaatgactttggatgaaactttggaagcacttggtctcaatgctaactctaagcaagataaggttcaggagacaaaaccaaatgctgattcttccaaaaaggcttcttcacgatttgtgttggaaatagattccaagtatctgaatcttgagaacgagttgaggagaacgtatggttcaaaggctatgcgatcatttgagagtgagagtggctctcaaggtggtagtagctctagacgagggggaaggcgtggagtccatcatatcacaaagacggttctggtatctccaaaagagaattggtctcgatgggatagatctttctcaatggagtttctagagactaaagatggtaacaactacttcagatatacccattcatcctcatatgagcaggctcagagagcatttcaggctgcacaagctatccatgatttgaatggtgtagcaagtgtccttatacacaatccttaccatattgagtcgctcataactatggcggattactttaagtttgtaggtgagaatgatatggctgcagattccattggaaaatgcttgtacggtttggagcgtgcgtggcatcctatgttcactccgttccagggtaactgccggttggagtttaaccacgatgaaaacaagctgttcttcaagacgcttttcactcacatgagaaacatggacaggcgtggctgtcataggtcagcgttggaggtctgcaaactcttgctttccttggacacgagtaatcctgtgggcgctttgttttgtgtggactactttgctttgagagcagaggagtatgcgtggctggagcaattctcggaggagtaccgaaatgataactcattatggctctttccgaatttctcttattcgcttgcaatagcacgagtttatcttgaaaagatggagcctacctcttcctcagaagccactcccagagatacttcgaagcaaagctctttggatctcatgacgcaagctttgaagcttcatccaacagtactcaacaaactagtggaaaaagtacctttaaaagatcaggcatggacaaagatactcaagcattcttacttccgatcagatgaatcaaagatcccgtctttagatcacctcatcaaaatatatgttgagaggaattatcttatatggaggcttccagatgtacagaaattgcttcggagcgctgctgatttagtcattgaatctctggaacaagatggaaccgaagctgagagctggctttgtgtaagattagaagctttctcttctgagaataaccagtactctcatttatcaacccatgatttctctgattcgatgccaactctcccaccagacaatttgcagaactttgtggctgatccaagaatggtgggaggagagcaaatggctgaaggtggcgggagaggtcaacaccaagcaccaccaccacgtccacgtgatttggcaaatcggagtccattagctgtgttgattgagtcaatacttccatgggctaattttggagatggagaggatgagattgcacatgatgctcaccaccaaccagacaacaatggctaa

SEQ ID NO: 59 - DNA, 858 bp, Arabidopsis thaliana
atggctctcttcgacactcataacacatgggcctttgttttcggcttgctcggaaacctcatttcctttgctgttttcctctctcccgtgccaacgttctataggatttgtaagaagaaaaccacagaaggatttcaatctattccctatgtggtggcgctcttcagcgcgatgctttggctctactacgctactcagaagaaagatgtcttccttctcgtcaccatcaacagctttggttgcttcattgaaaccatatacatctccatctttgttgccttcgcatccaagaaagcccgaatgctaacggtgaagctcttgttgctaatgaactttggagggttctgtttgattctcctcctctgccaattcttggcaaaaggaaccacacgtgcgaagatcattggaggtatctgtgtcggattctctgtctgcgtttttgctgcgccgcttagcattatcagaacggtgataaagacgaaaagtgtggagtacatgccgtttagcttatccttgactcttaccatcagtgcggtcatatggctcctttatggtcttgctcttaaggatatctatgttgccttcccaaacgtgattgggtttgttctaggtgcacttcaaatgatactctatgtggtttacaaatactgcaaaacgccgtcggatttggttgagaaagaacttgaggctgcgaaattgccagaagtgagcatcgatatggtgaagttaggtacactcacatctcctgaaccagtagcgatcaccgtcgtccgatcggtgaacacatgtaactgtaacgatcgaaatgctgagattgaaaatggtcagggagttagaaacagtgctgcaactacttga

SEQ ID NO: 60 - DNA, 474 bp, Arabidopsis thaliana
atgggtcttccaacagatttcaaagagcttcagattccaggttacgtactaaaaacactttacgtcatcggtttctttagagacatggtcgatgctctttgtccttacatcggtctaccaagttttcttgaccacaacgagacctctcgatccgacccgacccgactcgctctctccacgtcagcaactcttgccaacgagttaatcccggtggttcgtttctccgatcttttaaccgatccggaagattgctgcacggtttgcttatccgattttgtatccgacgataagattagacagctgccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaa

SEQ ID NO: 61 - DNA, 570 bp, Arabidopsis thaliana
atgaaagtagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaa

SEQ ID NO: 62 - DNA, 2308 bp, Saccharomyces cerevisiae
ttaattaaatgaacgatagccaaaactgcctacgacagagggaagaaaatagtcatctgaatcctggaaatgacttcggccaccaccagggtgcagaatgtacgataaatcataacaacatgccacaccgcaatgcatacacagaatctacgaatgacacggaagcaaagtccatagtgatgtgcgacgatcctaacgcataccaaatttcctacacaaataatgagccggcgggagatggagctatagaaaccacgtccattctactatcgcaaccgctgccgctgcgatcgaatgtgatgtctgtcttggtaggcatatttgttgccgtggggggcttcttgtttgggtatgacactggacttataaacagtatcacggatatgccgtatgttaaaacctacattgctccgaaccattcatatttcaccactagccaaatagccatactcgtatcattcctctccctaggaacatttttcggtgcgttaatcgctccctatatttcagattcatatggtaggaagccaacaattatgtttagtaccgctgttatcttttccatcggaaactcattacaggtggcatccggtggcttggtgctattaatcgtcggaagagtgatctcaggtatcgggatcgggataatctctgctgtggttcctctttatcaagctgaagctgcgcagaagaaccttagaggtgccatcatttccagttatcagtgggctatcactattgggttactcgtgtccagtgcagtatcgcaaggaactcattccaaaaatggcccgtcttcatatagaataccaattggtttgcagtacgtttggtcaagtattttagctgtgggcatgatattccttccagagagtccaagatattacgtcttgaaggatgaactcaataaagctgcaaaatcgttatcctttttaagaggcctcccgatcgaagatccaagactcttagaggagcttgttgaaataaaagccacttacgattatgaagcatcgttcggcccgtcaacacttttagattgtttcaaaacaagtgaaaatagacccaaacagattttacgaatatttactggtatcgccatacaagcttttcaacaggcatctggtatcaattttatattctactatggagttaattttttcaacaacacaggggtggacaactcttacttggtttcttttatcagctatgccgtcaacgtcgccttcagtataccgggtatgtatttagtggatcgaattggtagaagaccagtccttcttgctggaggtgtcataatggcaatagcaaatttagtcattgccatcgttggtgtttccgagggaaaaactgttgttgctagtaaaattatgattgcttttatatgccttttcattgctgcattttcggcgacatggggtggtgtcgtgtgggtggtatctgctgaactgtacccacttggtgtcagatcgaaatgtaccgccatatgcgctgccgcaaattggctagttaatttcacctgtgccctgattacaccttacattgttgatgtcggatcacacacttcttcaatggggcccaaaatattcttcatttggggcggcttaaatgtcgtggccgttatcgttgtttatttcgctgtttatgaaacgaggggattgactttggaagagattgacgagttatttagaaaggccccaaatagcgtcatttctagcaaatggaacaaaaaaataaggaaaaggtgcttagcctttcccatttcacaacaaatagagatgaaaactaatatcaagaacgctggaaagttggacaacaacaacagtccaattgtacaggatgacagccacaacataatcgatgtggatggattcttggagaaccaaatacagtccaatgatcatatgattgcggcggataaaggaagtggctcgttagtaaacatcatcgatactgcccccctaacatctacagagtttaaacccgtggaacatccgccagtaaattacgtcgacttggggaatggtttgggtctgaatacatacaatagaggtcctccttctatcatttctgactctactgatgagttctatgaggaaaatgactcctcttattacaataacaacactgaacgaaatggagctaacagcgtcaatacatatatggctcaactaatcaatagctcatctactacaagcaacgacacatcgttctctccatcacacaatagcaatgcaagaacgtcctctaattggacgagtgacctcgctagtaagcacagccaatacacttccccccaataaatttaaat

SEQ ID NO: 63 - DNA, 1284 bp, Arabidopsis thaliana
atggagatggagcgtgtgcatgaattccctcatactcacatggatcgtcgtcccagaaagagagcgcgtctcggttgggatgtgttgcctcaggcaaccaaggctcaggtaggaatgttttgtgggcaagagattggaaatatatcaagctttgcatcttccggagctccttcagacaatagtagctctctttgtgttaagggtgtggctcgaaatggttctcccccatggcgagaagatgataaggatggacattacatatttgaactgggagatgacttaactccacgctataaaatttatagcaaaatgggggaaggtacttttggtcaagtgctagaatgttgggatagggagaggaaggaaatggtggcagtaaaaattgtccgtggtgtgaagaaataccgtgaggctgctatgattgaaattgaaatgctgcaacagcttggtaaacatgacaaaggtggcaatcgttgtgtacaaattcggaactggtttgactatcgtaaccatatctgtattgtatttgagaagcttggatcgagtttatacgattttcttcggaaaaacaattatcgctcctttcccattgatcttgtccgtgagattggctggcaactcttggaatgtgtagcatttatgcatgacttgcgcatgattcatacggaccttaaaccagaaaatattctgttagtctcctcagactatgtgaagattcccgagtacaaggggtcccgattacaaagggatgtatgctataaaagagtgcctaaatcaagtgcaataaaggtgattgattttggtagcacaacttatgagcgccaggaccaaacctacattgtatcaaccagacattatagggcaccagaagtcattttaggtcttggctggagttatccgtgtgatgtttggagcgttggatgtatcatagtggagttgtgcacgggtgaagcattgttccaaacacatgaaaacctggagcatctagcgatgatggagcgtgttcttgggccgtttcctcaacaaatgctgaagaaagtggaccggcactcagagaaatatgtgagaagaggtcgtttggattggccagatggggcaacctcaagagatagcctgaaggcagtattgaagcttcctcggcttcagaatttaataatgcaacatgtggaccactcagccggggagttaataaatatggtgcaaggacttctgcgatttgatccgtcagagagaataaccgctcgtgaagctctgaggcatccgtttttcgcaaggagaagatag

SEQ ID NO: 64 - DNA, 928 bp, Xanthomonas campestris
ttaattaaatgcactgtagcgggatgacaaacacctccattcccgccgatttgggcgactggatcattgcccaggccatcgccggacacccgcccgagcacacgctgcaaccgctgctggaagcgggctggagcgagcaggacgccatcgatgcggtggaagcgctggtacgcgcgcatgtgcaggcacacgcgcaggcgcacggcctgccggtgccggtgccggtgcgcgtgcccgcaccgctgcaggccgacgcgtcgtcgctgctggatctgggcgatcgccaggtgcaggtactggtcagcctgatgctgccgcgcgtggtggtgctgggcggcctgctcgccgatgacgaatgcgatgcattgatcgcactggcacgcccgcaactggcccgctcgcgcaccgtggacaaccgcgacggcagcgagatcgtgcatgctgcgcgcaccagccacagcatggccctgcaaccgggccaggatgcgttatgtcaacgcatcgaagcgcgcattgcgcagctgctggaatggccggtggagcacggcgaagggctgcaggtactgcgctatgccaccggtgcgcagtacgcgccgcattacgattacttcgaaccggatgcccccggcacgccagtgctgttgcagcacggcgggcaacgcgtcgcctcgctggtgatgtacctcaacacgcccgaacgcggcggcgccacgcgcgttcccgatgtgcatctggacgtagccgcggtgaaaggcaatgcggtgttcttcagctacgaccgcccacatccgatgacacgcaccctgcacgccggcgcaccggtgctggccggcgagaaatgggtggccaccaaatggctgcgcgaacgcccgctgcacgcaccgacctgatcggtgctgcagcgtgcccgcatgcgtgggatttaaat

SEQ ID NO: 65 - DNA, 1254 bp, Arabidopsis thaliana
atggagtggccatggtcggccatcgctgcttcttcttcctcttcttctagttgcttctttgcttctcctaactcttgcttgtctattactagacgaacgaatttgagctgtgttaacacttcggttaaatccttgcgccacagcagattcgactcgaagcataatctcgttaaacgtcgaatcaatggagattccgttgttcggagaagcaccacaagcaataatagcactgaggagacagaatcatcgtcgtcttcttcgtctgtagattgcgttggaatgggatcagacgtggaatgcgtcaataacggggaagatgaggagaatcggagctctggaatcttgagcggcggtgaaggaacgtttcttgaatggacggttctgatttcacccttctttttctggggaacggcgatggtggcgatgaaggaagtgttgcccattactggtcctttcttcgtggccgcgtttcggttaattccggctggtttgttgcttgtcgcctttgcagtttacaaaggcagacctttgcctgaaggaatcaatgcttggttctctatcgctctctttgctcttgtggacgccacttgtttccagggatttcttgctcaagggttacagagaacttctgctggtttaggaagtgtcataattgattctcagccactgactgtagctgtgttagcatctttcttgtttggtgagtcaattggaatagtgagagctggaggtttgcttcttggtgttgctggacttttgcttcttgaggttccatcagtaacttcagatggtaataatttttccttgtggggaagtggagaatggtggatgcttcttgcagctcagagcatggctattggcactgtcatggttcgatgggtctcaaaatactcagatccaattatggcaaccggttggcatatggttatcggtggccttcctcttttggcgatttctgttataaatcatgacccggtttttaatggtagtcttcaagatctatccacaaatgatgttatagcacttctctacacatccatttttggcagcgcagttagctacggtgtttacttctatagcgctactaaaggaagcctaactaaactcagctcactcaccttcttgacaccaatgtttgcatcaatctttgggtatctgtacctcaatgagactttctcctcattgcaactggtcggagcagcagtgactttggtcgctatatacttggtgaactttcccgaaggcaacgactga

SEQ ID NO: 66 - DNA, 1310 bp, Arabidopsis thaliana
ttaattaaatgaaaactctacacaggacttggatagtggatggcccatggatctcaaggaatgtaaagaatgcgtctctgtcttcagctctgcagattaaagactgcggagcttatatcaactgctttaactgctcttaccgcatcgacaacagcaatgtaaagtaacaaatatagaacacatgtaactagagcttatggccctgtttatgtgaatactgagatagtatttttcttattttgctttgtcaggtactgactccatggccaggccttcctaaaggtgtgaaattcgagccaaccgatgaggaagtgattgagcatttggaagctaagtgtggtattgatggcttaaaaccacatcttcttatccaagactttatatgttcagtcactcaagatgttggtatcaactacactcaccctcaaaaccttccaggtaataataagacaaatcgtctgttaatttgatgctaatattgagtaattaatcactcattaatatgtttgtaggtgtgagtaaagatggaactagtgtcttcttctttaacaagacggcacatgcatatcaaaatgggcagagaaagcggagaaggatcacaccaactagtctcaaggatgatacggttcgctggcacaagactggtcaaaccaaaccggtgatgctcaatggaatccagaagggatgcaagaagatcatggtgctctacaagagcgcgagaaagggattcaaacccgagaaatctaactgggttttgcaccagtaccatttgggaactgaagaaggcgagattggggaatatgttgtctctaagatcacatatcagcaaccaaagcaacaggagaaaaccatcgatgagagtgagagttctggggttcgaggtggccctagcacaccgaaaactagtactattacacaagttagacctgtgatttctgttgatgaggatgaaatagcttttgatgatgattctaagatggttcttgattcatatgccgaggttagttcctttctctgcaagtatcaatgacgttcttcttgttgcgtgtatgtttatgtttctggtaaaatcagggactggagaacattcaagaagcttcttctggttcgacatcagacaaaatagctaaagtgggagggaatgtgagtgttattgaagataacttaatgtccaagaaaattgaagcttcgtcgattcctaatcatggaaatgttgactacggatcaggaaacttttcagtttcagatttggagaatgcagaattagggactctccctgatttactttccgtgagaacataaggcgcgcc

SEQ ID NO: 67 - DNA, 1422 bp, Arabidopsis thaliana
ttaattaacatggggaaggaaaatgctgtgtctcggccattcactcgttcccttgcctctgctttgcgcgcttcagaagtgacttctactacacagaatcaacagagagtaaacacaaaaagaccagccttggaggatacaagagccactggacccaacaagaggaagaagcgagcggttctaggggagatcacaaatgttaactccaatacagctatacttgaggccaaaaacagcaagcagataaagaaaggacgcggtcatggattggcgagtacatcccagttggcaacttctgttacttcagaagtcacagatcttcagtccaggaccgatgcaaaagttgaagttgcatcaaatacagcaggaaacctttctgtttctaaaggcacagataacacagctgataactgtattgagatatggaattctagattgcctccaagacctcttgggagatcagcttctacagctgagaaaagtgctgttattggtagttcaactgtaccggatatcccaaaatttgtagacatcgattcagatgacaaggatcctttactgtgctgcctctatgcccctgaaatccactacaatttgcgtgtttcagagcttaaacgcagaccacttccggactttatggagagaatacagaaggatgtcacccagtccatgcggggaattctggttgattggcttgtggaggtctctgaagaatacacacttgcatctgacactctctacctcacagtgtatctcatagactggttcctccatggaaactacgtgcaaagacagcaacttcaactgctcggcatcacttgcatgctaattgcctcgaagtatgaggaaatctctgctccacgcattgaggagttttgcttcattacggataacacctacacaagagatcaggtcctggaaatggagaaccaagtacttaagcattttagctttcaaatatacactcccactccaaaaacgttccttaggagatttctcagagcagctcaagcctctcgcctgagcccaagccttgaagtcgagtttctagccagctatctaacagagttgacattaatagactaccatttcttaaagtttcttccttccgttgttgctgcttcagcggtttttctcgccaagtggacaatggaccaatcaaaccacccatggaatccaacacttgagcattacacaacgtacaaagcatcggatctgaaagcatctgttcatgccttacaagatctgcagcttaacaccaaaggttgccccttgagcgctatacgcatgaagtataggcaagagaaatacaaatctgtggcggttctcacgtctccaaagctacttgacacgctattctgaggcgcgccaaaaataaccgataatagttttgtcacattgatggtccaatttcgttttcat

SEQ ID NO: 68 - DNA, 961 bp, Arabidopsis thaliana
ttaattaaatggaaaaagttttctccgacgaagaaatctccggtaaccatcactggtcggttaatggaatgacgtcgttgaatcgcagtgcttccgaatgggcattcaatcgtttcatacaagaatcctccgccgctgcagacgacggagaatctacgacggcgtgtggtgtttccgtctcctctcctcctaatgttcctgtagattcagaggaatacagagcatttctcaagagtaaacttaatcttgcttgtgctgctgtcgccatgaaaaggggaactttcatcaaacctcaggatacttctggtagatctgacaatggtggagccaatgaatcagaacaagcctctcttgcttcttccaaagctacaccaatgatgagcagtgctataacaagtggatctgagctctctggtgatgaagaagaagctgatggtgaaactaatatgaaccctactaatgttaaacgcgttaaaaggatgctctctaatagagaatcagctagacggtccagaagaagaaagcaagcacacttgagtgagctagagacacaagtttcacagcttcgtgtagagaattcaaaactcatgaagggtctcactgatgtaactcaaacattcaatgatgcatctgtagaaaacagagttttaaaagccaatattgagacactacgagcaaaggtgaaaatggctgaagagacagtgaagagactcactggctttaacccaatgttccacaatatgcctcagattgtttcaactgtctctcttccttcagagacatcaaattctccagacactacaagcagccaagtgactacaccagagatcattagctcggggaacaaaggcaaggccttgatagggtgcaagatgaacagaacagcttcgatgcgtagagttgagagcttggaacatctgcagaaacgtattcgaagcgttggggatcagtagatttaaat

SEQ ID NO: 69 - DNA, 1333 bp, Arabidopsis thaliana
ttaattaaaggattcattcatcatatccagaaatggctctaaagtttaaccctttggtggcatctcagccttacaaattcccttcctcgactcgtccgccaactccttctttcagatctcccaagttcctctgcctcgcttcttcttctccggctctcagctccggccccaaggaggttgagagtttgaagaaaccatttacgccacccagggaagtgcatgttcaagtcttgcactccatgccacctcaaaagatcgagatcttcaaatctatggaaaactgggccgaggagaaccttctgattcacctcaaggatgtggagaagtcttggcaaccccaggatttcttgcctgaccctgcatcagatgggtttgaagatcaggtaagagagttaagagagagggctagagagctccctgatgattactttgttgttttggtgggggacatgatcacagaagaagcacttccgacctatcaaactatgttgaacactttggatggagttagggatgaaacaggtgctagtcctacttcatgggctatttggaccagagcttggactgcagaagaaaaccgacatggcgatcttctgaataaatacctttacttgtctggtcgtgttgacatgaggcagatcgaaaagaccattcagtacttgattggatctggaatggatccgcggacagagaataacccctaccttggcttcatctatacgtcattccaagaaagagcgacattcatctctcacggaaacacagcccgccaagccaaagagcacggggacatcaaactagcccaaatatgtggcacaatagctgcagacgagaagcgtcatgaaacagcatacaccaagatagttgaaaagctctttgagattgatcctgatggtactgtcatggcttttgcagacatgatgagaaagaaaatctcaatgcctgctcacttgatgtatgatgggcgcaacgacaacctctttgacaacttctcttccgtggctcagaggctcggtgtttacaccgccaaagactatgcagacattcttgagtttctggttggtaggtggaaaatccaggacttaaccgggctttcaggtgaaggaaacaaagcacaagactatttatgcgggttggctccaaggatcaagagattggatgagagagctcaagcaagagccaagaaaggacccaagattcctttcagttggatacacgacagagaagtgcagctctaaaaggacaaagacaaaaacaaaaacctatcctcccggttcctcatttcatctgtctgctcttaaaattggtgtagattactatggttttctgataa

SEQ ID NO: 70 - DNA, 1310 bp, Glycine max
ttaattaattcttctgcaaccctaaccctagaattgaagatgcagcctcagaggttaaggcagcaagccatgatgcaaccatctctctaccaccaccctgctctacttactcctcctcagatagagcctatcttgagtggaaatctgccacctggctttgattcgagttcatgccgcagtgtttatgtaggcaacattcatccccaggttacagattcccttcttcaagagcttttttcaactgcaggcgcccttgaaggatgcaagcttattaggaaagagaagtcatcctatgggtttgtggactactttgatcgcagttctgctgcatttgctattgtaactctcaatgggaggaatatttttgggcagcctattaaggttaactgggcttatgctagcagccagaaagaggatacctcaggtcactttaatatttttgtcggtgaccttagtcctgaggttacagatgccacattgtatgcttgcttctctgtatatcctagttgttctgatgcaagggtaatgtgggatcagaagacaggccgttccaggggatttgggtttgtttcttttcggaatcagcaggatgctcaaagtgctataaatgatttgactggaaaatggcttggaagtagacagattcgttgtaattgggcaaccaaaggggccagtgccagtgatgaaaagcagacttcagattcgagaagtgtcgtggagttgaccaatggatcatctgatggccaagaaacaaccaatgatgacactcctgagaagaatcctcaatataccactgtttatgttggcaatcttgctccagaggttacttctgttgatctccatcaacattttcattctcttaatgccggaactattgaagatgttagggtgcaacgagacaaaggttttgggtttgtgagatacagtacccatgctgaagcagctcttgctatacagatgggtaatgctcgaattctatttggcaaacctatcaagtgttcatggggtagcaagcctactcctccagggactgcctcaactcctctcccaccacctacttctgcgaatgtgtcgggattttctcttgctagtcttgcagcttatgaacgccaaatggctttgagtaaaatgggtggtgcacatgcccttatgcatcaacaaggtcaacatgccctaaaacaggtagccatgggaatgggtgctcctggggctggttatgatgcaagattccagaatgttgcgaccacccaacacctaatgtactatcagtaaaatgtgttggtgtgcaactctccgcgataaatttaaat

SEQ ID NO: 71 - DNA, 917 bp, Arabidopsis thaliana
ttcaactctttgtttcttgtttgttgattaacccttaattaaatgggatctatcaatacttcttggcaaaagggtcaacttctgcgacaaggatcgtttggctctgtgtatgaagccatttcagaagatggggacttctttgctgtcaaggaagtttcacttcttgatcagggaagtcaggcacaagaatgcatacaacaacttgagggggaaattgcactacttagtcagcttgagcatcagaatattctgcgatatcgtggcacagacaaggacgggtcaaatttgtatatttttcttgagcttgtaacacaaggatcccttctagaactctaccgaagataccagattcgggactcgctaatctccttgtacacaaaacaaatccttgacggtttgaaatatcttcaccataaaggtttcattcacagggacattaaatgtgcaactatattggtggacgccaatggcaccgtcaaacttgcagattttggattggcaaaggtgtcaaagttaaacgacattaagtcccgcaaggaaactctattttggatggctccagaggttattaaccggaaggataatgatggttacagaagtccagctgatatatggagcctcgggtgcactgtgctggaaatgtgtactggtcagatcccatactctgatctagaacccgttgaagccctgtttaggatcagaaggggtacgcttccggaagtacctgatactttatcactagacgctcggcatttcatacttaagtgtctcaaattgaacccggaagagcgtccaactgcaactgagctactgaaccatccatttgtgagaaggcccttaccatcctcaggctcaggatcaacatctccgctaatccgtagatgaatttaaatacccagcaaattggagctctgcag

SEQ ID NO: 72 - DNA, 1211 bp, Glycine max
ttaattaacgccatagttgttcccttttctctctcgttttttctcaaaaagttgcaagagttaaagcaaaaaccaaagtgagagagaaaatgatgaagccatcgatgctcagatctcttcactctgccgccacccgcggcgcctcccacctctcccgccgtggctacgcctccgagccggtgccggagcgcaaggtggccgttctaggtgccgccggcgggatcgggcaacccctctcccttctcatgaagctcaaccccctcgtttccagcctctccctctacgatatcgccggaactcccggtgtcgccgccgatgtcagccacatcaacaccggatctgaggtagtggggtaccaaggtgacgaagagctcggaaaagctttggagggtgcagatgttgttataattcctgctggtgtgcccagaaagcctggaatgactcgtgatgatctttttaacatcaatgctggcattgttaagacactgtgtactgctattgctaagtactgccctcatgcccttgttaacatgataagcaatcctgtgaactccactgttcctattgctgctgaagttttcaagaaggcaggaacgtatgatgagaagagattgtttggtgttaccacccttgatgttgttagggcaaaaactttctatgctgggaaagccaatgttccagttgctggtgttaatgtacctgttgtgggtggccatgcaggcattactattctgccattattttctcaagccacaccaaaagccaatcttgatgatgatgtcattaaggctcttacaaagaggacacaagatggaggaacagaagttgtagaagctaaggctggaaagggttctgcaactttgtcaatggcctatgctggtgccctatttgctgatgcttgccttaagggcctcaatggagtcccagatgttgtggagtgctcattcgtgcaatccactgttactgaacttccctactttgcttccaaggtgaggcttgggaagaatggagtggaggaagttctgggcttaggacctctctcagattttgagcaacaaggcctcgaaagccttaagcctgaactcaaatcatcaattgagaagggaatcaaatttgccaaccagtaattgaacatgttatcacatacgtgtctggtaggctaatgttaatgttattccttcaagaaccaaatcaaattttgcaatttaaat

SEQ ID NO: 73 - DNA, 1042 bp, Glycine max
ttaattaattcttctgcaggaccaaattgatatacaagatcattgttttagagagagagagagagagagagagagagagagagaggatgtttggttcaaagaaaactcctctgagagatgctaaacctacctctgttgaccatgcccataacccctttgattctgatgaagatacaaaagataacaagtataattcttctaagaagactttgaccaacaccaacccctttgatgatgatcatgttaatgccactggccactcttcatcatcttcttatggcctttcgtctacccatcgaaataggtataagaacgatttccgcgactcaggggggttggagagtcaatctgtgcaggaattggagaactatgctgtttacaaggctgaagagacgacaaattcagtgaacagttgtttaaagatagctgaggaaatgagagaggatgctaccaagactttggtgatgctgcaccaacagggtgagcagattacaaggagtcaccatgttgctgctgatattgatcacgatttgagtcggggagaaaagctgttgggaagtcttggtggcatgttctccaaaacttggaaacctaagaagacaggcacgataactggccctgttgtttttggagaggatccagtgagaaagaagggcaaccacttggagcaaagagagaagttaggattgacttctgcccctaaagggcagtcaaagtcacgtacaacactttctgagccatcaaatgtgcttgaaaaagttgaggttgaaaaagggaagcaagatgatgcactgtcagatttaagtgatctcttgggagaactgaaaggcatggccattgacatgggatctgaaattgggagccaaaaccaagccttggatggttttgacaatgatatggagaagttgatcgtccgcgtgaatggtgctaatcaacgtggtcgtcgtttgcttgggaaataggggtgtatatcatgagatcgatactaatttttaatatgcattagtcaatcaaaggagcttccaatgttccagatttaaat

SEQ ID NO: 74 - DNA, 2307 bp, Saccharomyces cerevisiae
ttaattaataccaataatcgtcgcccacaaagaaagtacaaaacagatgacagaattttattctgacacaatcggtctaccaaagacagatccacgtctttggagactgagaactgatgagctaggccgagaaagctgggaatatttaacccctcagcaagccgcaaacgacccaccatccactttcacgcagtggcttcttcaagatcccaaatttcctcaacctcatccagaaagaaataagcattcaccagatttttcagccttcgatgcgtgtcataatggtgcatcttttttcaaactgcttcaagagcctgactcaggtatttttccgtgtcaatataaaggacccatgttcatgacaatcggttacgtagccgtaaactatatcgccggtattgaaattcctgagcatgagagaatagaattaattagatacatcgtcaatacagcacatccggttgatggtggctggggtctacattctgttgacaaatccaccgtgtttggtacagtattgaactatgtaatcttacgtttattgggtctacccaaggaccacccggtttgcgccaaggcaagaagcacattgttaaggttaggcggtgctattggatcccctcactggggaaaaatttggctaagtgcactaaacttgtataaatgggaaggtgtgaaccctgcccctcctgaaacttggttacttccatattcactgcccatgcatccggggagatggtgggttcatactagaggtgtttacattccggtcagttacctgtcattggtcaaattttcttgcccaatgactcctcttcttgaagaactgaggaatgaaatttacactaaaccgtttgacaagattaacttctccaagaacaggaataccgtatgtggagtagacctatattacccccattctactactttgaatattgcgaacagccttgtagtattttacgaaaaatacctaagaaaccggttcatttactctctatccaagaagaaggtttatgatctaatcaaaacggagttacagaatactgattccttgtgtatagcacctgttaaccaggcgttttgcgcacttgtcactcttattgaagaaggggtagactcggaagcgttccagcgtctccaatataggttcaaggatgcattgttccatggtccacagggtatgaccattatgggaacaaatggtgtgcaaacctgggattgtgcgtttgccattcaatactttttcgtcgcaggcctcgcagaaagacctgaattctataacacaattgtctctgcctataaattcttgtgtcatgctcaatttgacaccgagtgcgttccaggtagttatagggataagagaaagggggcttggggcttctcaacaaaaacacagggctatacagtggcagattgcactgcagaagcaattaaagccatcatcatggtgaaaaactctcccgtctttagtgaagtacaccatatgattagcagtgaacgtttatttgaaggcattgatgtgttattgaacctacaaaacatcggatcttttgaatatggttcctttgcaacctatgaaaaaatcaaggccccactagcaatggaaaccttgaatcctgctgaagtttttggtaacataatggtagaatacccatacgtggaatgtactgattcatccgttctggggttgacatattttcacaagtacttcgactataggaaagaggaaatacgtacacgcatcagaatcgccatcgaattcataaaaaaatctcaattaccagatggaagttggtatggaagctggggtatttgttttacatatgccggtatgtttgcattggaggcattacacaccgtgggggagacctatgagaattcctcaacggtaagaaaaggttgcgacttcttggtcagtaaacagatgaaggatggcggttggggggaatcaatgaagtccagtgaattacatagttatgtggatagtgaaaaatcgctagtcgttcaaaccgcatgggcgctaattgcacttcttttcgctgaatatcctaataaagaagtcatcgaccgcggtattgaccttttaaaaaatagacaagaagaatccggggaatggaaatttgaaagtgtagaaggtgttttcaaccactcttgtgcaattgaatacccaagttatcgattcttattccctattaaggcattaggtatgtacagcagggcatatgaaacacatacgctttaagttttatttataagtgttgttagaggctgcaacaattagaaactagtgatttaaattggagctct

SEQ ID NO: 75 - DNA, 408 bp, Arabidopsis thaliana
ttaattaattaacattttcttctggctaacatgaacaactctttgaagaaagaagaacgcgtagaagaagataacggaaaatctgacggtaacagagggaaaccgtcgacggaagttgttcggacggtaacggaggaagaggtggatgagtttttcaagatattacggagagtacacgtggcgacacgaacggttgcgaaagttaacggcggtgttgctgagggagagttaccgtctaagaagaggaaacggagtcagaatcttgggttgagaaactcgttggattgtaacggcgttcgagacggagaattcgatgagattaatcgggtcgggttacagggtttgggtttggatctgaactgtaaaccggaaccagacagcgttagtttatcgttgtagaggcgcgcc

SEQ ID NO: 76 - DNA, 574 bp, Arabidopsis thaliana
ttaattaatctcggagaaaattctcgtaatcatgaactgtgtttctgcatttgaatttgttccttcaagtgctctatttccatgtgcacaatcatcaatccctgcgaaatttcttcacattttgagctcaaaagcctcgatttctcccagatgtcgtagtttcgcttcttcttcttcttccacaattcggaggaagcctctaactctagtatcttcaaaatcttcagacgcggaggaggtgtcagatacggaggacgaatggctgaagaagctaccagagaagaacaagccactgtattcgcatagcttaccttgtatcgaagcgtggctgaggaaattagggttttaccaaagtaaagacgatagagctgtttggttgattcagaaacctgattggcatgctcaactatctcttgatgtcactgatctctgcattaggtacatgaaaagtgggccgggaaatctagagagagacatggaaagaaggtttagctatgcgttgagtagagaagataccgagaatgccatacttggaggaccttaaagaataaaaagagtttgtttgaggcgcgcc

SEQ ID NO: 77 - DNA, 1022 bp, Arabidopsis thaliana
ttaattaactaagctttcattgaacaaggaatatgaaatcttctccaagatcagaaggaagaaagttcattatcccttctttcttcttcatcatagctctttgtgtactagctttcatcaacgagatcagattcgatagcttattgagttttggaagatgtgctttgtcaaatgttcctatgaataatggttcatcagagactccattgttgtcttcttctcctgttgatgatgagattaggattcttattggaatccttacacttcctgatcagtattcacgtcgccattttctccggatgatctacgggacacaaaatgttccggacggtgttaaggttgatgtgaagtttgtgttctgtaatttgactaaagaagaccagaaagtgcttgttgctttggagattatgcgttatgatgacatcattatactcaactgcaatgagaatatgaacaaaggcaagacttacacatacttctcaagcttaccagacatattcaatgagaccgatgcacaaaaaccaccgtaccattacgtaatgaaagccgacgacgacacatacataagactagaaagtctcgttgcatctttgagaccactccctcgagaagatctttactacggctatgtaattccatgtccaagcatggacccatttgttcattacatgtcaggaatgggttacttagtgtcatgggatattgcggtttggctcaaagactcggaaattcccaagaaacatctagaaggtcctgaagacaaagtgtttggcgattggattcgagaaggaagacgaggaaaaaaccggtttaacgctaagtggtccatgtataatttccctgagccaccgactagatgcacacatgagctttggccagacactattgccgttcatttgttaaagaaccaagagaagtggatacgtacattgaactatttcaatgttactagcaatctcaagccttctaaactataccacataccgtagatagtctttttgtttgcttttaccgggcgcgcc

SEQ ID NO: 78 - DNA, 2416 bp, Saccharomyces cerevisiae
attcatttatttgtcagctttcaaactctttgtttcttgtttgttgattaacccttaattaaggtacttgcattgaccgcgaacgtgtaaacacaagcaaagcagattatgaccacacaaataaggtctccccaaggcttgccgtatccgattcagatcgataaactcattccaagcgtaggttcgtaccttcatgagggtgataggttgcttgtctataagttctggtatttggtggaaagggcctcagacactggtgacgatgataacgagcacgatgtttcccccggcggcagcgccggaagtaatggtgtctctccgccaaccaaacaactgcgtgaatccatagaattcttcgaaagtccctacgagggggacttgattagttggaatgtagacgtaggagatgaagtagccactgctaaccaagtgatttgcgaaataaaaaggccgtgtaaccatgacatcgtgtatggcgggctatgtactcaatgcgggaaagaagtttctgcagatgccttcgatggtgtaccactagacgttgtcggggacgtggatttacagattagcgagacagaagccattagaacaggcaaggcattgaaggagcatttgcgacgggataagaaacttatcttagtggtggatttagatcaaaccatcatccattgtggcgtggaccctacgattgcagagtggaagaacgaccccaataatccgaattttgaaacattaagagacgtcaagagctttacgttggatgaggagttagtactcccacttatgtacatgaatgacgatggttctatgctgagaccgcctcccgtaagaaaatgttggtactacgtgaaggtaaggcccggtttaaaggaatttttcgctaaagtggcgcctctttttgaaatgcatatctacacaatggctacaagggcttatgccttgcaaattgccaaaatcgtggaccctacgggcgaattgtttggcgatagaattctgtcgcgtgatgaaaatgggtctctaacaactaaatcattagctaaacttttccccactgaccagtcaatggttgtagttattgacgacagaggtgatgtttggaattggtgtccaaacttgatcaaagttgttccttataacttcttcgttggtgtaggtgacattaattctaatttcttgcccaaacaatctacaggaatgctacaactagggaggaagacaagacagaagagccaagaatctcaggaactgctgacggatattatggataacgaaaaaaaactacaagaaaagatagataaagaagttaaacgccaagaagaaaaattgaaccatcaactggcgactgctgaggagcctcctgcgaacgaatccaaagaagagttgaccaagaaactagaatattcagcatctttagaagtccaacaacaaaatcgacccttggccaaactacaaaaacacctgcatgatcaaaaactactagttgatgacgatgatgaactatactacttaatgggtacgctatcaaacattcacaaaacttattatgatatgctctcacaacaaaatgagccagaaccaaatctgatggaaatcataccaagtttgaagcaaaaagtcttccaaaattgctattttgttttttcaggattaatacccctcgggaccgatattcaaaggtcggacatagtgatatggacgagtacatttggtgccacttccactccagatatagattacctgacgacacatttaatcaccaagaaccctagcacttataaagcgcgtctagcgaaaaagttcaacccacagattaaaattgttcacccagattggatatttgagtgtttggtaaattggaaaaaggtggatgaaaaaccctacacgttaatcgtggacagccccatctccgacgaggaattacaaaactttcaaacacaattacaaaaaagacaagaatatctggaggagacccaggaacaacagcatatgttgacatcacaagaaaatctaaatttattcgctgctggtacttcatggttaaacaatgacgacgatgaagatattccggacacagctagcgacgacgacgaagatgacgaccacgacgacgaaagtgatgacgaaaacaactcggaaggcattgacagaaagaggagcatcgaggacaatcatgatgatacatcacaaaagaagaccaaggcggaaccttctcaagatggtcctgtacaacataaaggagaaggggatgacaacgaagacagcgattcgcagttggaggaagagttgatggatatgctggatgattagcagctcagatgccgtatctttccacacattttcctcattgatttaaatacccagcaaattggagctctgcagagctttcgttcgtatcatcggtttcgacaacgttcgt

SEQ ID NO: 79 - DNA, 942 bp, Saccharomyces cerevisiae
aaactctttgtttcttgtttgttgattaacccttaattaagatgagggatgaaaaaatttactcaattgaagctctgaagaaaacatcagaacttcttgagaaaaatccggaatttaatgctatttggaattacagaagggatattatagcgagtttggcttctgagttggaaatacctttctgggataaagagttagtttttgtaatgatgctattgaaggattaccccaaagtctattggatatggaatcacagactttgggtcttgaaacattatcctacgagttcccctaaagtgtggcaaactgaacttgctgtcgtgaataagttattggaacaagatgcaagaaattaccacggatggcattaccgcagaatagttgttggtaacatagagagtatcactaataaaagtcttgacaaggaggagtttgaatacacaacaataaagattaacaataacatttcaaattattctgcatggcaccaaagagtacagatcataagcagaatgtttcagaaaggagaggttgggaatcaaaaggagtatattcggactgaaatatcttatatcatcaacgctatgtttaccgacgccgaagaccaatccgtatggttttatatcaagtggttcattaaaaacgacattgtttgtaaaactctggacgaacaagagtaccttaaaatgttgaaagacttgagagaaaacattctgttaataaataatgacgaaattgaattttccgggaagcaaaatatttggtgcttgaaaattttattagttctagaagatattctggaagaaaaggaagctctaacggaaagaagctcggaacaatatttggtccaattaatagatgcggatccgttaagaaagaatagatacctacatctcctggagcagcataagtgaatttaaatacccagcaaattggagctct

SEQ ID NO: 80 - DNA, 1289 bp, Arabidopsis thaliana
ttaattaacttctgggaacttgaggattgtttccatggcggagaataggcaattggtttgtaggattggtggcggagccggtgctgaattggatgatatggatgaaggtgaaatccagaggattggaaatgaagacgaagacgacgatgaattcatacaagtccatgctaataattcctctgctgcttcgcctgagagatgggatgttttgggtctcggccaagccatggtagatttctctggagttgtggatgatgagtttctaaagaaacttggtttagaaaagggaacaaggaaactgattaatcacgaggagaggggtaaattattacaagcaatggatggttgtagctataaggcggcagctggaggctcattgtccaacactttagttgctctcgcaagattaggttctcaatccatctgtgaccggcctttgaatgtggcaatggctggcagtattggaggtgaccctctcggtagcttttacgggactaaactacgacgagcaaatgtaaattttctttctgctccaatcaaggacggaacaacaggaacagtgatagttctcacaactcctgatgcacaacgtactatgcttgcatatcagggaacatcctctgtcgttaattatgattcttgtttggctagtttgatagccaagacaaatgtctttgttgtggaaggctatttgtttgagcttcctgatactataagaaccataacaaaagcctgcgaagaagcccacagaaacggggcacttgttgctgtgacagcatcagatgtgtcctgcatagagaggcattatgatgatttctgggacattgtggggaactatgcggatattgtatttgcaaatagcgatgaagcaagagcgttttgtcacttttccgcagaggaaagtccaatttcagcgacaagatacatgagccactttgttccgtttgtttctgttaccgatggaatcaacgggtcatatattggagtaaaaggagaggccatctacattcctccgtccccatgcgtgccagttgatacatgtggtgctggagatgcatatgcttcagggatcttatacggtatcttgaggggtgtctctgacttgaaaggaatgggagatatggctgcaacgattgcagcaactgtggtgggtcaacaaggaaccaggcttagggttcaggacgcggttgagctggctcgatcacatgccttccgtctcaatggttctggtgttcgaacagatgttgggtcttgatgaaacctctttagcttgtgatttttggcgcgcc

SEQ ID NO: 81 - DNA, 1083 bp, Glycine max
ttcttgtttgttgattaacccttaattaatccgggcgcgcctgatttatcacaagtttgtacaaaaaagcaggctcctgcaggaccatgggagaagtggcagtaatgcactctgagcctctgcagtttgagtgcaatgacattagtgtgaatatgactgagaaggaagtgtatcctccagaatcaaatgtggagcgcttacctggagaagaatcgagtcaatcaacagaccacaaaaatatcaatgacttgcaagagagaggatatatggagtatggatgtcagcattaccggagaagatgccgtatcagggccccatgttgcaatgagatttttgattgccgccattgtcataatgaggcaaaaaatgatatcaacattgatcagaagcatagacatgatattccacgacaccaagtcaaacaggtgatttgttcactttgtgggactgaacaagaggttcagcaaaactgtataaattgtggtgtttgtatgggcaagtacttctgtggaacatgcaagctttttgatgatgatatatctaagcagcagtaccattgcagtggctgtggaatttgcagaactggaggaagcgaaaatttcttccattgctacaagtgtggttgttgctactcaactcttctgaaaaacagtcacccttgtgtagaaggagcaatgcatcatgattgcccggtttgttttgagtatttgtttgaatcaagaaatgatgtcactgttatgccttgtggacatacaatccataagagctgcctgaatgaaatgagagaacatttccagtattcgtgccctctctgcttgaaatcagtctgtgacatgtcaaaggtttgggagaaatttgatatagagattgctgctacaccaatgcctgagcaatatcaaaataaaatggtttggatcctgtgcaacgattgtggtaaaacttctcacgttcagttccattttgtggctcaaaagtgtccgaactgcaaatcctacaatacacgacaaacatgactcgagacccagctttcttgtacaaagtggtgataaattggagctctgcagagctttcgttcgtatcatc

SEQ ID NO: 82 - DNA, 948 bp, Glycine max
ttcttgtttgttgattaacccttaattaatccgggcgcgcctgatttatcacaagtttgtacaaaaaagcaggctcctgcaggaccatggatagacacaaatgcaagctttgttcaaggtctttcagcaatggcagagcccttggtgggcacatgaaggctcaccttgcttctctccctctccctctccctccaaagcttcactcttgcttctcttcctctgactcagaacaagaacaatctttaagggagaatcctaagaaaaccttgaggattctggatcctgaagacagagagagcgagacagagtctaataagaacccgactcgtcaacgatccaagcgcaactggaaatctaccatgcccaagctcagcctcggacaccccgaagccgaacctctcagctccgtctccgacacctcccccgaagaagacctcgccatgtgcctcatgatgctctcccgcgacacgtggcaggaacacaaactcgccaatgcaggtccacccaagactcgctgcagcagcggatcagagatcaagctcaagagcaaagtccgctccaagcacctctgccacgcttgtcacaaatcctttcgatcctctcgcgctcttgggagccacagaaccctgtgctctccccgtcaggaagcccaaaataacagcatcattagtaataacaacattaaggtttttgaatgccccttctgttacaagctgtttggttctggccaagcgctcggtggacacaagagatctcacctaattccttcttcctcttcaaccgttaatcattctgtcaagttgaaacagagcttcatagatctcaacttgcctgctccggccgaagacgacgatcttagcgttgtttctgatgcctaactcgagacccagctttcttgtacaaagtggtgataaattggagctctgcagagctttcgttcgtatcatc

SEQ ID NO: 83 - DNA, 1068 bp, Bacillus subtilis subsp. subtilis str. 168
gctttcaaactctttgtttcttgtttgttgattaacccttaattaatccgggcgcgcctgatttatcacaagtttgtacaaaaaagcaggctcctgcaggaccatgaaaatcggattaatcggcttagggaaaatgggcataaacataggaaagcaattcattgaccgcaatcatcaagtggttggatatgatgtaaatcaagcggctgttgatgaactgaaagcatacggggctgaggggacaacaaatcttaaagagttcatttctttattacacccgccgcgcatcctatgggttatggtaccgcatggcattgtcgatgctgttttgcgtgatgtatcacctttattaagtaaaggcgatatgattatcgaagctggaaactctcattataaagaatcaattcgccgctacaatcaaatgaaagaagcgggtatccattatctcgatgccggaacgtcgggcggaatggaaggcgcacggcatggagcctgttttatggtggggggcgatcatgaagcatgggagattgtggaaccgctttttcgtgatactgccgtcgaaaatggttatctatacgctggtgaagcgggaagcggacattttttaaaaatgatccataatggaattgagtatggaatgatggccgcgattggtgaaggattcgaagtgcttgaaaacagccaatttgattttgactacgagaaggttgccagagtgtggaatcatggttctgtcattcgttcttggcttatgggactgactgagcgagctttcgctaaggatgcgaaactggatcagatcaagggcattatgcattcctcaggtgaaggaaaatggacggtggaaaccgcgcttgatctgcagacggcaacgccggtcatcgccatgtcactaatgatgagataccgttctttaacagacgatacgtttacaggaaaggtggttgctgcgcttcgaaatgaatttggaggccatgcgacagaaaaaaagtaactcgagacccagctttcttgtacaaagtggtgataaattggagctctgcagagctttcgttcgtatcatcg

SEQ ID NO: 84 - DNA, 349 bp, Arabidopsis thaliana
ttaattaaatggcgaagcatcaccctgatttgatcatgtgccggaaacaacccggaattgctattggacgactgtgtgagaaatgcgatgggaaatgcgtgatttgtgattcttatgtgcgtccgtgtactctagtacgtatttgtgatgaatgcaactacgggtcattccaaggtcggtgtgttatatgcggtggcgttggaatctcagatgcttattactgcaaagagtgtacacagcaggagaaagacagagatggttgccccaagattgttaaccttggcagtgcgaaaaccgatctcttctatgaacgcaagaaatacggattcaaaaaacgatgaggcgcgcc

SEQ ID NO: 85 - DNA, 1453 bp, Arabidopsis thaliana
ttaattaaatggcggcggaatcaaccagaaactcttctccgccgtctacttctcagtcttcaagccctataatcaatttacccgatgaccatctcttaaccatcttgcttcttcttcccgtagattcaatcctctccttctcaatgacctgcaagcgatacaagtctctagcttgctccgacagtctctgggaagctctgtgtgaacgagaatggggaccaacatctgtagatgctttaaagttgtcatctttacgagatgggttttcatggatgttgatgtttcagcgagtttataagatggattctgtttgctgtcacaagatctcagacccagatgatgatgatgaagaatcttcttcgtttccgatccctagagcttctcattctctcaacttcgttaatgatcatcttgttctctttggtggtggttgtcaaggaggacgccatcttgatgatacatggacatcatatgttgataagagcaatcaaagcatattgaaatggaagaaagttaaatcagggactccaagtgggagattcggacacacctgcatcgttataggcgagtatctactcttatttggaggtataaatgaccgtggagagaggctaaatgacacatggattggtcaagtcttttgccacgagggactctcttggaaactcctcaatgttgggtctttgcagcggcctcgtcctcctcctcgtggtgctcattccgcctgttgtattgctgagaagaagatggttgtacatggaggaatcgggctgaatggagtcaggcttggagatacatggattcttgaactttctgaagatttcagctctgggacatggcacatggtggagtctccacaattaccgccaccgcgctcagggcatactttgacctgcattagagaaaaccaagtggttctatttggaggcagaggattaggatatgatgtgcttgatgatgtttggatcttggatattcaagaaccgtgtgaagaaaaatggatacagatattctacgatttccaggatgttcccgaatacgcatcgttgcctcgggttggtcactcggcgactcttgtattgggaggtcgaatcttgatttatggcggtgaagattcttataggcataggaaagatgatttctgggtgttggatgttaaaaccattccttcatcaggtttgaaaccacaagggcttagcttaaacggatcatcagtgtggaaaaagcttgatcgaatctcatatggaccaaaaagtcggtcttttcaccgtgcctgcgctgattgttcagggagatttttatatgtgtttggcggaatggttgatggtcttcttcagcctgcagcatcgtctggtctaaggtttgatggagagcttttcatggtggagcttgttcttggcttctctgacctagaccatcaacaaagacccggaaaaagcatgtaaggcgcgcc

SEQ ID NO: 86 - DNA, 648 bp, Arabidopsis thaliana
atgaagaatccttcagtgatctcttttctcatcattctcctgtttgctgcaactatttgcacccacggaaatgaaccggtgaaggatacagccggaaatccacttaacacccgcgaacaatacttcatccagccggttaagaccgagagtaaaaacggaggtggtcttgtcccagccgccattacagtacttcccttttgtccacttggcatcacccaaacacttcttccctaccaacccggcctaccggttagcttcgtattagcacttggcgtaggatcaaccgttatgacatcttcggctgtaaacatcgagttcaagtccaacatctggccgttttgcaaggagttttccaagttttgggaagttgatgattcctcatcagctcccaaggagccttcaattctcatcggtggtaaaatgggggaccgaaatagctcgtttaagattgagaaagctggagaaggagctagagcaaacgtttataagttgaccaccttttacggaaccgttggagccatcccaggggtttggttaagcgcaccacaactaattatcaccaaggatacggctaagaccttactcgtcaaattcaaaaaggttgatgatgctactacggctactagcaacttatacttcccgggttga

SEQ ID NO: 87 - DNA, 864 bp, Arabidopsis thaliana
atggctttaacggaggacaaatcagattccgatggtcgacgttggggcaaattcaaacttccatttcgaaactctaattcccaagctccttcagcctcctcgtcctcttccatggctacttcttcttcttctgtaacatcttctcatctaaatcaaaattacattcatcaatctcgccattttcaatatcacggtcctcctgtcgtcgaaggattgggtcaaaaccatcatcaatccgccgccacgatcccttctatgtcatctgtcgcgagatcgcttcttccaacaaaacgccgattaaagcttgatccttcagcaaaactttacttcccttatgagcctgggaagcaagtcaggagtgccattaagattaagaatacgagcaagtcacatgtagcgtttaagtttcaaacaacagtaccaaagagttgcttcatgcgcccggctggtgctattcttgctcccggggaagaaattatcgcaactgttttcaagtttgttgagcctcctgagaataatgaaaagccaatggaacaaaagagcggggttaagtttaaaatcatgagcttgaagatgaaagttccaacagactatatgcctgagctgtttgaggagcaaaaagatcatgtctctgaggagcaagtaatgcgtgtggtattcttggatcccgaaaaccctaactccatgatggagaaattgaagagtcaattggctgaagcggatgctgcagatgaagcacggaaaaaagcatcagagggtattgttggtccaaagccaattggagaagggcttgtgatcgatgaatggaagcaacgccgagagagatatcttgcacaacaacaaggaggagtagacgctgcttga

SEQ ID NO: 88 - DNA, 1199 bp, Glycine max
ttaattaattgaatcttgttctctctaatctctctcactacaatggagactccatcatccacagcaagaagaatcacaagatcccaaatcgcctccaacaacaacatccccgtttcaagaaaaaagaacgaggactgctcagaaaagagcgtttcaaaaacgcggcagagaagcagcgtgcaacagcaggaacggtgtgcgctggtcgacatatcgaacgattcaccgatcgcggggctggcgaacgggaaggacatcattgagacgccgttgtcgtcgatggcgaagaagaagagggtgaagaagacgatgaagactccggggtcgggagaggctctgctgaggggccaggtgaagaccctcttgcagagggtggaggaagaggctgtgatttcgaagctatcgatggaaattgttgcaccctttctgaaacttgcgaattcttctccaatgtcgcttcttgcgcccactcccgcaaacacaccacaagtccccaatctttctgaagtggctttggtgtctccaccttctagtgtggttgaagaacaattgatctctcgggtggtgaatgaaatatttgaagggaagaagaacgagaatgctgaatgtgagaagagtgtgataaccaggtccttgctgttggacttctcggacaaatccgaggtttcagaatgctcttctgaggtgacatatcaggaagtgacacaaggaagtgttggtagccgtgggtccaccgaggatgatggtgcttccatttggtccattcaggtgaatgcgagcacgcatgacgaagatgaggacgatgaggaaatgggtgaagaggaagaagaagaagaagaagattattgcgaggatgctgaagagtgttatgattatgttggagggttgtcacttgaagagctatgtgctgggatgaataacattagtgtgaatgagaacaagggttgtgggaagcacacgaggtttgtgtacgatagtgaggatgagattgtggagaaagtgatagaatgttgtgctgagtctgatgtgatgcgtttgaagggtttgccaacacccaaaggaaagcaccttcgctttcctcaggaggaagaaaattcctctgacttgtgatttttgataattggtgctgctgcggtttggtttggtattgtctttcttgacaccactgttttggttaatggtgtgattgggatttaaat

SEQ ID NO: 89 - DNA, 1205 bp, Glycine max
ttaattaacagtgcatcatcgcattgattgagttggaagatgggtagcaaaggcaaacgcaaagagcaagaatcaataataacgagggttatggctcacggaggtagatacgtgcaatacaacgtgtacggaaacttgttcgaggtctcctccaagtatgtccctcccattcgccctgtcggtagaggcgcatacggcatcgtttgtgctgctgttaattgcgatacgcacgaggaagttgccataaagaagattggtaacgcctttgacaacatcattgacgctaaacgaactttgagggaaatcaagctccttcgccacatggaccatgaaaatataattgccattagggatatcatacgacctcccagaaaggatgccttcaatgatgtttacattgtttatgaattgatggacactgatcttcatcagattattcgttctgaccaacctcttaacgatgaccactgtcagtactttttatatcagctgttacgggggctgaaatatgtgcattctgctaatatcttgcaccgtgatcttaagcccagtaatttgcttctcaattcaaactgtgaccttaaaattgcggactttggtctggcaaggacaacatctgaaacggatttcatgacggagtatgttgtcacacgatggtaccgagccccagaattgcttcttaattgttcagagtacacctccgcgattgatgtttggtctgttggttgcatatttggtgaaattatgaccagagaacccttgtttcctggaaaagattatgttcatcaactgaggcttataacagagttattaggttcacctgatgatgccagccttggatttctccgaagtggaaatgccaaaagatatgttcgacagcttccacaatataggaagcaaaatttctccgctagattcccaaatatgtctcctgaggcattggatctactagaaaagatgcttatctttgatcccaacaaacgcattacagttgatgaagcactatgtcatccatatctttcatcacttcatgacatcaatgatgaaccggttggtcctgggcaattcaattttgattttgagcagccaacatgcactgaagagcacatcaaggagctcatctggagggaatcggtgaagtacaatccagatccacccagtcagtaattctttcttgaatgatgattcccttattacatttaaat

SEQ ID NO: 90 - DNA, 764 bp, Glycine max
ttaattaagttcggaaggatctgattgttagggtttggtatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattgatccatatacaggatgtgtgtgtttcacaatatttaaat

SEQ ID NO: 91 - DNA, 1001 bp, Glycine max
ttaattaaagaagatcaaatcgaagaaggcttaaaaaaaatgaagggttcgaacaaccggttcttcacggtggcgctggtggcggcgtggtactcctcaaacattggggtgcttctcctgaacaagtacttgctcagcaactacggcttcaagtacccaatcttcctcaccatgtgccacatgacggcgtgctccttgctcagttacgtcgccatagcgtggatgaaggtcgtgcctttgcagagcattcgatccagggtgcaattcttcaagatctctgctctcagcctcgttttctgcgtctccgtcgtgttcgggaacatttccttgcgctacctccccgtgtcgtttaaccaggctattggcgccaccacgcccttcttcaccgccgttttcgcttaccttatgaccttcaagagggaggcttggctcacttacctcacccttgttcctgttgttactggagtcatcattgccagtgggggggaaccgagtttccatctgtttggatttattatatgtgttgcggctacagctgcaagggctctgaaatcagtgctacaagggattttgctttcttctgaaggagagaagctgaattctatgaaccttctcctttacatgtctccaatggctgtggttttccttcttcctgcaacacttataatggaagagaatgtggttggcatcacgttggctcttgccagagatgattccaagatcatttggtatctgctgtttaattcagcacttgcatattttgtcaacctgaccaactttttggtcacgaaacataccagtgctctaacccttcaggtactaggaaatgctaaaggggcggtagcagtagtagtttctattctaatattcagaaacccagtgtcagtcactggaatgatgggttactcactcacagtctttggagttatactctacagtgaagccaaaaagagaagcaagtgatactataatgcatcatcattcatgctctcgatttaaat

SEQ ID NO: 92 - DNA, 824 bp, Glycine max
ttaattaattgttgataataattaggtagaaaaaatattatggggaggggaagagtggaactgaaaaggatagagaacaagataaacaggcaggtaacgtttgcaaagaggagaaatgggcttctcaagaaagcctatgagctttctgttctctgtgatgctgaggttgccctcatcatcttctccacccgtggcaagctttatgaattctgcagcaccaacagcatgctcaaaacacttgaaaggtaccaaaagtgcagctatggtgcagtggaagtcagcaaacctggcaaagagcttgagagcagctaccgtgagtacttgaagctgaaagcaagatttgaatctcttcaaaggacccaaaggaaccttcttggtgaagacttgggcccattaaataccaaagatcttgagcagcttgagcgccaactggattcatctcttaagcaagtgaggtcaacaaagactcagttcatgctggaccagttagctgatcttcagaataaggagcatatgttggtggaagcaaacagatctttgaccatgaagctggaagaaatcaattcaagaaaccagtataggcaaacatgggaagctggtgagcaaagtatgccatatggaacccaaaatgctcactctcaaggcttcttccagcctttggagtgcacccccacattgcagataggttctgactacaggtacatccctgaagcctcagagcagcagctagctgccacaactcaagctcaacaagtcaatggatttattcctggatggatgctttgacctaagatctcagtattttagatggctacaatttaaat

SEQ ID NO: 93 - DNA, 1144 bp, Glycine max
ttaattaagctccctcttcagtttttggtaaactaaacttcttcaattcaagggggtatcaaaatctgctggttggtttcatcaatctgatggaggaaaatctgcctcccggatttaggttccaccctacagatgaagagctcatcacatgttatcttacaaggaaggtttctgattctagcttcacatccaaagctatagcagttgttgatctcaacaagtgtgaaccttgggacctcccaggtaaggcatcaatgggaaagaaagagtggtacttttttagcttaagagatcgaaagtatccaacgggacttcgaacaaaccgagccactgaatcagggtactggaaaaccacagggaaagacaaggaaatttttcgtgctggggttttggttggaatgaagaaaaccctagtcttttataggggtagagctccaaggggcgagaaaagcaattgggtcatgcacgaatatagactagaaaacaagcatcactttggaccttcgaaggacgaatgggtggtttgcagggttttccagaagagcttgcaagtgaaaagaccacagcaaacaccctcctcacaaccagagtccccatgtgacacagcctcaatggtcaatgaatttggtgatgttgagcttcctaatctaataaataacattgcaaattcatcaggtggactcactaacaacatttcaggacaaacctgcttcaatgctgatcttattaatagtgttaacacaaatatgaacttggccatgaattggccagttgcaagtgaggtaattcaggttcccactcttccatcactcccatggccttctgggttgttaaatccaagtatttctgtaaattctttgcttctcaaggcattgcaactcaggagttatcaacaaagagaagcagcaacagatcatttaatagcatcatatgtgcctcaaggagtgtcccatgttggaactgacctaagttcaaatctcactgcctcttcttctaaagttttagaatgtatgccacagcagcaacagctggagcaaccattcaacttggactccatttggtgaatctgtttagaacatgaagctaggcattgtgtaattacatcaacaaccctccagctcccataaataaaatggatttaaat

SEQ ID NO: 94 - DNA, 1447 bp, Glycine max
ttaattaatgttcgtataattgttgttgttgtggcggcagtggtagtatttggaaattgaggattgagtggggtgtgtgaaaaatggctgccaggagtgatcaccaaacggttcctctttcggtgctcctgaggcgcgaattggcgaacgagaaaattgagaagcctgagattgctcatggtcaagcgtgccagagcaagaaaggcgaggatttgacgctgctcaagacggaatgccagagggtggtgggcgatggggtctctacatactcagtttttgggctatttgatggacacaatggatctgctgctgctatttattctaaggagaatcttctaaataatgttttaagcgcgattcctccagatcttaacagagatgagtggatagcagccttgcccagggctttggttgctggttttgtaaaaactgataaagattttcaagagaaaggccaaaaatctggaacaactgtcacctttgtcattatagaaggatgggttgtaacagttgcatcagttggtgattcccgttgcgtccttgaatcttctgatggtgagctttattacttgtctgcagatcacaggctagaaacgaatgaagaagagagggtgcggatcacctctagcggtggtgaagttggtcggctaaatacagggggaggtgcagaggttggtcctttgagatgttggcctggtggtttgtgtctctcacgatctattggagatatggatattggtgaatttattgtacctgtcccgtatgtaaagcaagtgaagatgtccactgctggaggccggcttgttatctgcagtgatggtgtttgggattctctacctgcagaagtagcccttgattgttgtcgtggaatgccagccgatgctgctgcaccacatattgttaaagaagctgtacaagcaaagggacttagagatgatacaacctgcattgtagttgatatattacctcaggagaaaccacctgtttctgcgccacaaacaaagaggccagtaaagggaatgctcaagtccatgtttcgtaaaaaatcttctgaatcatcttcttatattgacaaagagtacatggagccagatgtagtagaagaattgtacgaggaaggatctgccatgctttcagagaggttagatactaaatatccagtctgcaacatgttcaagttgtttatgtgtgcagtatgtcaagtagagataaaacctggagagggtatttcaatacacgagggtgcacccgactctcgaaaatttcgtccctgggacggacctttcctgtgctcaagttgccaagagaagaaagaagccatggaagggaaaagatcatcaggtagaattagcagtggaagtgatgaatgaactctcgtgtaaatttgcattttgagagtgataaaaattgttcatatgatgggaaagtcaaacaattcaatttaaat

SEQ ID NO: 95 - DNA, 393 bp, Arabidopsis thaliana
ttaattaaatggatacgaacaataccagaactgtgaaatttgcagctcttgcaatagttttagccgccttggtgttgatggaagaacctacgagcattaccgcatgtaacatcaacgcaaaccatctggaaaaatgtcgtccagccgtaattggagacaacccgccatctccaatcaaagagtgttgtgaactcctccaagccgctaatctgaaatgcatctgcagattcaagtctgttctccccgttttagcggtttacccatctaaagtccaggctcttctgagcaaatgtggcctgacaacaatccctcctgcttgccaagctttgaggaactgagatggagacagaccgttctagcagacttcactcgaacttgtcctgcaggcgcgcc

SEQ ID NO: 96 - DNA, 634 bp, Arabidopsis thaliana
ttaattaagaagcacacttctctgtttcaggagaacaatggcttcgacggctacgaacactgatttcttcaagactttgctttctcctttctcaaatgggaatgcggcgcaacgaagtagtagacagaacattgtttggttaaatcggaagcaatctggaaataataacagatctcttcgtgttaatggattattcggaggcggaaaaaaggacaataaagaggatggacaatcaaaggcaggaattctaggtaacatgcagaatttgtatgagacagtgaagaaagctcaaatggttgttcaagtagaggctgttagagtgcagaaggagcttgctgttgctgaatttgatggttattgtcaaggcgagcttgtcaaggttacattatcaggtaaccagcaaccaattcgcactgatatcactgatgcagcaatggagttaggttctgaaaaactttcactgctggtcacagaagcatacaaagacgcacattcaaagagtgtactggctatgaaagaaagaatgagtgatcttgcgcagagcttagggatgccaccaggccttgatggattaaagtaacaaaacttaatcttttttgtatttctttcaacttataggtatgagaggcgcgcc

SEQ ID NO: 97 - DNA, 1201 bp, Glycine max
ttaattaacaccttttggacacctgatttcagttctttttcttctcaataattattatttgtatttgtaaacacacactatcaaagcaaatggggtgctcattctccgggttgaacgcactttacgactccgtgaacggcggaggtgatgtttggatcaacgagaaccgtttccgcatcgtgcgccagctcggagaaggtggcttcgcctacgtctacctcgtcaaggaggctcccgacgactccgccgccgctggcctcgccaagaagctcaaaggctcctctcatctctccgatgatggaacttatgctatgaaaaaggtcctcattcagaacaatgaacagctggagttggtcagggaggagatccgtgtttcatcactgttcaatcatcccaatctgctcccgcttcttgagcatgcaatcatttctgtcaagcctacccatgaaacatcttggaaccatgaagcatatttattgtttccagttcatttggatggaacattgctagacaatgccaaaataatgaaagccaagaaagaattctattccacctcagatgtgcttcaaatatttcgtcagctttgtgcaggactcaagcacatgcacagttttgatcctccttatgcacataatgatgtcaaacctggtaatgttctcataacacacagaaaaggacaaccacctcttgccatactgatggattttggcagtgctcgtcctgcaaggaagcaaattagctccaggtcagaggcccttcagttgcaggaatgggcatctgaacattgctctgctcctttccgagctcctgagctgtgggattgcccaagccaagctgatatagatgagaggactgacatttggtcgctaggatgcacattatatgcaataatgtatggggtatctccatttgaatatgcacttggagagtctggtggaagcctgcaattggctattgtaaatgcacaggtcaaatggccagcaggacccaagcctccatatccagaagctcttcatcagttcgtgtcatggatgcttcagccaacggcttccatgcggcccaggatagatgatatcattatccatgttgacaagttagttgcgaagttctctcaatgagttactatggaagtgagaagtggggcttgagatttttatgttgcagtcgtttaaaaaaattcgtgtgcatttgccatttaaat

SEQ ID NO: 98 - DNA, 804 bp, Arabidopsis thaliana
ttaattaaagttttctttctctagcctccctcatctttctctctctgtcggcgatgcagaggatatcgttagactcatcagcttcgaagctccatagctatggaggacgaaaggacgatacctacgatattgatgacttgaaaccagcttcctcttctccttcttcgtcgtcatccgcagtagattacgacgatcacgagctcaaagactttaagccgcgacggttatcatcgttgcaatctccttttgttacgacgaatcagaaacaagagaagcttgttcacttcattccgattctcactctcatctgctttatcatcctttacctcacttcttacgctccgtctcaatcaggttggcttctcctattcaaaatccgacgatccacctgtttttgattgattgattgatcttctcgtgtttattgattttgatcggtttttcgattttgaatttttctcagatttggctcagtttaatggattcatgcgtccttcgaaacatctaggtacattgcagattcgattcccatttcgaattttatttctgttggtaacacattgaatttgagttcctgatttgattgttttgatctccactagaatcatccgacgaaaatggcgacgaaatttctggatttatcagagccgatactctatccatccgtagtagtgtacgaaacctacaagagacggaaagcttcacgacgaaatcacttccccgtcgccggacttctcaccggaaaaccgccgacttctagcaatcgcaatcttaatttttattcgtcgcatcgcatggcgcgcc

SEQ ID NO: 99 - DNA, 1179 bp, Arabidopsis thaliana
attattcatttatttgtcagctttcaaactctttgtttcttgtttgttgattaacccttaattaacgtaaactcaaccacaagagaaaccttatcttcttcttcttcttcatcatcaatctctcaagacatgctctcttttttctctaaccagatcgaccggcaaaaagatgtgtctaatgaggaaaaaaccctaaccaatctcgaaaaatctgacggttcacaattccctggcgatgactaccgtccgtccgatcggaaaaactggatggctggtcttacgttggagaaactaactctaaacaagatcgtgtggccaggaacgcatgattcagccaccaacgatatcggaatacctctgatctctcgtcctttagctgaatgccaatcgctctctatctacgagcagctcgtcctcgggacacgtgtcctcgatatccgtgtgcaagaggatcgccaaatctgccacgggattctgacgtcatacgaaattgatgttgtcattgatgacgttatcagattcttgtcggagactcactcggagattgtaatcctggagataaggactgagtttggacacaaagatcctccggggttcgagacttacttggcagacaagttaggtcaattcttgatacatcaagatgatagcttgttcaacaagccggtatcagagattttgccgaaaagggttatatgcatctggaaacctagagagtctccaaagccgagccgtggtggaattctctggaactcagattatctaaaagataattggatcgatacggatcttccatggacgaaatttcagagcaatttgaagcatctgagtgagcagcagccgacatcttctagaaaattcttttaccgggttgagaacacggtcacgccgcaagcagataatccggttgtgtgggttaaaccggtgactgatcggatccgaaaacacgccagactatttatttctcagtgtgtttccaagggatgtggagataagttgcagattttgtccactgatttcatcgaaggagatttcgttgatgcctgtgtcggccttactcacgcaagaatcgaaggaaaggtttgatagaactctggaacgatcgatggttgatctcaagcattggaaccaagattatttgcttttgggttgcgtgggcgcgccaaaaattggagctct

SEQ ID NO: 100 - DNA, 818 bp, Arabidopsis thaliana
ttaattaatactctactctgcaggcaaaaatagttatggcgacttcttcgatcactatcccgaccattagaactccgattcatcgatcaaaatttctaggccaaacacatcaattttcaactgtaaaccggtcggttttcccgcctccaaaacagcagtcaaaactgtatcaagtaaaggccatgggtaaattcaatctatgggaagtgatgggaggaagaggattatgcaacggagagaaaggtattgagaaggagctccagaggaacattgaagacgagcaagagacatcaaaggctgagaacaacgagacagagagagagagcgatgacagtaacttgtcttttaaagtacctgaagatggtttcgagaaagagatgatgggtctcacaggaggatttcccggtggcgaaaagggtttaaaaacgtttatcgaaaaaaatccaccacctcctccaccaccaccacctgcaaaacaaggaagcgatgcatccgcggttgctacagataagaagccgaaagcgcccaagctaccccttctcatgccggggatgattgctatagtcaagaaccagaacagtccgtatcacatgtattgtggaattgtgcagaggatcactgatggaaaagctggtgtcttgttcgaaggaggaaactgggaccgtctcattactttcaggcttgaagagcttgaacgaagagaaaaaggtccaccgggtaagaatccaaagtcttgtattctcgagcctcttatcgaacagatgcaaaaggaagaggcagcaccataagtgatcttctcttctctgtatgggcgcgcc

SEQ ID NO: 101 - DNA, 1389 bp, Arabidopsis thaliana
cccttaattaaatgttgaaacaagagagtaacgacataggtagtggagagaacaacagggcacgaccctgtgacacatgccggtcaaacgcctgcaccgtgtattgccatgcagattctgcctacttgtgcatgagctgtgatgctcaagttcactctgccaatcgcgttgcttcccgccataaacgtgtccgggtctgcgagtcatgtgagcgtgctccggctgcttttttgtgtgaggcagatgatgcctctctatgcacagcctgtgattcagaggttcattctgcaaacccacttgctagacgccatcagcgagttccaattctaccaatttctggaaactctttcagctccatgaccactactcaccaccaaagcgagaaaacaatgaccgatccagagaagagactggtggtggatcaagaggaaggtgaagaaggtgataaggatgccaaggaggttgcttcgtggctgttccctaattcagacaaaaataacaataaccaaaacaatgggttattgtttagtgatgagtatctaaaccttgtggattacaactcgagtatggactacaaattcacaggtgaatacagtcaacaccaacaaaactgcagcgtaccacagacgagctacgggggagatagagttgttccgcttaaacttgaagaatcaaggggccaccagtgccataaccaacagaattttcagttcaatatcaaatatggctcctcagggactcactacaacgacaatggttccattaaccataacgtaaggcttttgtatatttgttaccccttcaatttagcatcttcccataacgcagcagggtgaattctttcatcatacacacaaatccactgatccactgccaacagttgatctatagcacatagaaatttcaccagaagtctataataaaaacaatatatgcttccttttgcatcgactctctttagtcctcttaccagggggattgagaatgtctttgtttctgtcattaggcatacatttcatccatggaaactggtgttgtgccggagtcaacagcatgtgtcacaacagcttcacacccaagaacgcccaaagggacagtagagcaacaacctgaccctgcaagccagatgataacagtaacacaactcagtccaatggacagagaagccagggtcctgagatacagagagaagaggaagacaaggaaatttgagaagacaataaggtatgcttcgaggaaggcatatgcagagataagaccgcgggtcaatggccggttcgcaaagagagaaatcgaagccgaggagcaagggttcaacacgatgctaatgtacaacacaggatatgggattgttccttcattctgaatttaaattggagctctgcagag

SEQ ID NO: 102 - DNA, 1630 bp, Pseudomonas syringae pv. tomato str. DC3000
gctttcaaactctttgtttcttgtttgttgattaacccttaattaatccgggcgcgcctgatttatcacaagtttgtacaaaaaagcaggctcctgcaggaccatggcgaagtcggttcaactcatcaaagatcatgacgttaagtggattgatctgcgcttcacggacactaaaggtacgcagcaccacgtgaccatgccagctcgcgatgcgctggaagacgacttcttcgaagtcggcaagatgttcgacggctcctccatctctggctggaaaggcatcgaagcctccgacatgatcctgctgccggacgacgaaaccgcagttctggatccgttcaccgaagagccgaccctgattctggtgtgcgacatcatcgaaccgtcgaccatgcaaggttacgaccgtgacccacgcgccattgctcgtcgcgccgaggaatacctgaagtccaccggtatcggtgacaccgtattcgcaggtccggagccagaattcttcatcttcgacgaagtgaaattcaaatccgacatctccggttccatgttcaagatctactctgaacaaggttcgtggatgtccgaccaggatgtggaaggcggcaacaaaggccaccgccctggcatcaaaggtggttacttcccggttccgccgtttgaccatgaccacgaaatccgtaccgccatgtgcaatgctctggaagaaatgggccagaccgttgaagttcaccaccacgaagtggcgaccgctggccagaacgaaatcggcgtgaagttcaatacgctggtcaagaaggctgacgaagttcagaccctgaagtacgttgttcacaacgttgctgacgcttatggccgcactgcgaccttcatgccaaagcctctgtacggtgacaacggttcgggcatgcacgtgcacatgtccatcgccaaagatggcaaaaacaccttcgcaggtgaaggctatgccggcctgtccgacatcgcgctgtacttcatcggcggcatcatcaagcacggtaaagccctgaacggcttcaccaacccggcaaccaactcctacaagcgtctggttccaggcttcgaagccccggtcatgctggcctactcggcacgtaaccgctctgcctcgatccgtattccttacgtcaacagcccacgcggccgtcgtatcgaagcacgcttcccggatccggcagccaacccgtacctggccttcgcggctctgttgatggctggcctggacggcatccagaacaagatccaccctggcgacgcagctgacaaaaacctgtatgacctgccgcctgaagaggccaaagagatcccacaggtttgcggcagcctgaaagaagcgctggaagaactggacaagggccgtgcgttcctgaccaaaggcggcgtattcagcgacgacttcatcgacgcttacatcgcactgaaaagcgaagaagaaatccgcgttcgcaccttcgtgcacccactggaatacgagctttactacagctgctgatccagccgcgccagcattgatggcgtaacaagagacctccttcgcagacctcgagacccagctttcttgtacaaagtggtgataaattggagctctgcagagctttcgttcgtatcatcg

SEQ ID NO: 103 - DNA, 1380 bp, Bacillus halodurans
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaaaaagttttagttatacacacaggtggaacgattgcgatgcatgaagatgaaaaagggggcgtacagcctaaagagacaaatcccctgtttgccaccgtcgaatcgttaacatcgattgcctcgatcgaagtcgatgattttctcaatattccttccccccatatgacacctgagctcatgtttcagttggctgagcgactaaagagccgagtaggtaatgaatcgtttgatggggtcgtgattacacatgggacggatacgttagaagaaacagcctaccttctagatttgttactcgattgggaagtccctgtcgttgtcacaggggcgatgcgttccagtaatgagctcggagcggacggaccacacaattttatttctgctgtcaaaacggctgctacagatgaagcaaaaggaaaaggagttctcgtcgtatttaacgacgaaattcatacagcaaaaaacgtcacgaaaactcatacgagtaacgtcgccacgttccaaagtccacagtatgggccgattgggattgtcacgaaacgaggcgttaccttccaccacgccccttcatacaaagagagctatacggtctcaagcatcgatcatcgagttgtgctattaaaggcctacgcaggcatggatgggtccgttgttgatgcgattgccgacacgggaattgacggcctagtcattgaggctttcggacaaggaaacttaccaccagctgtcgtcccaagcatcaaacgtcttcatcaagccaacattccagtggtactcgtgtcaagaagcgttagtggtatcgttcaggaaacgtacgcttacgaggggggcgggcgtcacctaaaagatttaggggttatttttacgaacggtttaaatggacaaaaagcacgattaaagctactcgtcgcccttgaattgacgaccgatcgtaagaaattacaagaaatctttttcaaataactcgagacccagctttcttgtacaaagttggcattataagaaagcattgcttatcccccaaatacccagcaaattggagctctgcagagctttcgttcgtatcat

SEQ ID NO: 104 - DNA, 880 bp, Arabidopsis thaliana
ttaattaaatgtatagagacagaggaacggtgaattcgagacctgaagttgtggatcgtaaacggatcaacgacgctcttgaacgtccttctccttcaacctctcgtcaagttaacggcaaaggcaaaggaaccgttacggcggcgacgacgacggcgaacttgattgggaagcagcagtcgaataacatcaaccatagagattctcgttctgcttctctctcgaagaacaatacggtttctgatgatgaatcagacacagatagtgaagaatcagatgtgagtggttctgatggagaggacacttcatggatatcttggttttgtaatctaagaggaaacgagttcttttgtgaagttgatgatgattacattcaagatgacttcaacttgtgtggactcagcagtctagttccctactacgagtacgctcttgatttgattttggatgttgaatcttctcaaggagagatgtttacagaggaacagaatgaattgatcgagtcagcagctgagatgttgtatggactgattcatgctcgttacatattgactagcaaaggattggcagcaatgttagacaaatacaaaaactatgactttggaagatgtccaagagtttattgctgtggccaaccttgtcttccggttggtcaatcagacttaccgcgatctagcactgtgaagatatattgcccgaaatgcgaagacatttattacccacgatcaaagtatcaaggcaacattgatggagcttactttgggacaacgtttccacatctgttcctgatgacttatgggcatctcaagccagcgaaggcaacacaaaactatgttcaaagagtgtttgggttcaaattacacaaaccgtgaggcgcgcc

SEQ ID NO: 105 - DNA, 540 bp, Arabidopsis thaliana
ttaattaagaaagcaaacacaacacaactaacaatggatttaggaaggtttccaataatctcaatcctcgaagacatgcttgaagtccccgaagaccacaacaacgagaagacccgcaacaacccttcacgagtttacatgcgagacgctaaggcaatggctgctacacctgctgacgtcatcgagcaccctaacgcatatgcattcgtcgtggacatgcctggaatcaaaggagatgagatcaaggttcaggtcgagaacgacaatgtgcttgtggtgagtggagagaggcagagagagaacaaagaaaacgaaggtgtgaagtatgtgaggatggagagaagaatgggtaagttcatgaggaagtttcagttgcctgaaaatgcagatttggacaagatctctgctgtttgtcatgacggtgtgttgaaggttactgttcagaaacttcctcctccggaaccaaagaaaccaaagacaattcaagttcaagttgcttgagtttgttttgtgattgtgtgttggatttatcggcgcgcc

SEQ ID NO: 106 - DNA, 1068 bp, Arabidopsis thaliana
tttatttgtcagctttcaaactctttgtttcttgtttgttgattaacccttaattaaatgaggaactataagttaagattgtcagttatgagcccaagtgaatggttccacaagctcaagaacatgacaaaacctagaaaaaagcattctcttcctctttactccataaacactaccaagaagagaaaaccttcctctgagtcaaagtctcttccttactcttcaacttcttacttcttcaataggtcacgctcacgcacatcctttgaatctaggatccttcaaatttcaccaagaaactctcttcacaacatacagagcaaaagaaagactgtttacaagccttctcctccttcctcttctattgtatctgcaggttttaacaaaacatttcatcaaagccatgattctctctctgcctcttccaacttgaaagtcatttcttctgaagatgatattatcatcgacatgaataatagagatttcaagaagaaaactttcaaagagatcacgaagtttgattcaacggagaaagcctgtcgtgcaagtaaccgaaccaaggaaacacatatacctcatcatctctctgtgaaggtcagtaaagagaaagaagatgaagaggaagatgcatgtcgaaccaagaagaaacatcagaaaacattagtttctagtggaagaagatcatcagctaaatctccaaggataaagctcagagcgagatctcctagaattcaagtctcgcctcgtagaagcaaatcaagatcacagaacaaacaaattcttgacagttttgcagtaatcaagagttctatcgatccgagcaaggatttcagagaatcaatggtggagatgatagcagagaacaacatcagaacctctaacgacatggaggatcttctagtatgttaccttaccttgaatcccaaggagtatcatgatctcattatcaaggttttcgttcaagtctggcttgaagtcataaactctacatttgcatcgaagtagggcgcgccaaaaattggagctctgcagagctttcgttcgtatcatcggtttcgacaacgttcg

SEQ ID NO: 107 - DNA, 496 bp, Arabidopsis thaliana
ttaattaacaatttcgatttggaggatagagacgaagaagaagacagctccgatggctgatcctgaactagaagctattagacagaggagaatgcaagagctcatggctcgacaaggcatgggtaagcagggcaatcagcagaatccagagcaagagaaacagcaggaagatgctaaaagggaagctgatgaacgtaggcaaatgatgcttagtcaagtattgtcttctcaagcccgagagagaattgctcgaattgctctggtgaaacctgagaaagctagaggtgtggaggatgttattttgagggctgctcagatgggacagatagttgagaaggtttctgaggaacggcttataacactgttggaacaaataaacagccaaactaccaagcaaacgaaagtcacgtaccaacggcgccgtggggtggacgacgattaggaaggaagaagaatattatgatgtgctttgtatatctatggagatcggcgcgcc

SEQ ID NO: 108 - DNA, 703 bp, Arabidopsis thaliana
ttaattaaatgatattttcatctctcccctctcggttagtcatgaaagatttgttcatggaaggagaaagagaaacttcatcgatgacttgcttgacgcccaaggattctgttcaaagccctaacatgttggttagacaaccaaaaaaggagacaacaacacaaacccctaaaacgacacgaggaagacagaagatagagatcaagaaaatcgaggaagagaccaagagacaagtaacgttctcgaaacgccgtcgtgggctgttcaagaaatccgctgaattgagcgttctcacgggcgcaaaaatcgccgtcataacgttctctaaatgcgataggatctacagatttggccatgtagacgcattgatagacaagtatcttcgtaagagtccggtgaagttggagggatattccggtgataacgcggcggatgaggaaagtaggagaccgtggtgggagcgtccggtggagagtgtgccagaagaggagcttgaggagtacatggcagcattgagtatgttgagagaaaatatagggaaaaagattgtggcgatgggtaacgatcggacggttgatatggttccggcatggccaatcaatgtgatgggatggaaaccaacgatggatatgcaaaaattggaaaatctgacggatggggttaatcgatgccgtgtaggtcaaaacggtgattgaggcgcgcc

SEQ ID NO: 109 - DNA, 793 bp, Arabidopsis thaliana
ttaattaagcaatatctctcttctatcttttcatttcctactcttttctcactatggccaaagacggtggcgtttcttgtctacgaaggtcggagatgatcggtataggaatcggagaacttgaatctccgccgctagattctgatcaagtccacgttctcgccgttgatgacagcctagttgatcgaatagtcatcgaaagattgcttcgaatcacatcctgcaaagtcacggcggttgatagcggatggcgtgctctcgaattcttaggattagacgacgacaaagccgccgtcgaattcgatagattgaaggtggatttgatcatcactgattactgtatgcctggaatgactggatacgagcttctgaaaaagattaaggaatcgacaagttttaaggaagttcctgttgtaattatgtcgtcggagaatgtaatgactcgtatcgacagatgtcttgaagaaggtgcggaggattttttactaaaaccggtgaaactcgccgacgtgaaacgtctgaggagttacttgacgagagacgttaaagtcgccgccgaaggaaacaaacggaagctgaccactccaccgccgccgcctccgctctcagccacatcctcgatggaatcttcggactctacggtggaatcgcctctgtctatggttgacgatgaagattcgttgacaatgtcgccggagtctgcaacttcgcttgtggattcgccgatgaggagtcccggattagcttagagagatccgtgtgataacgatctccgttaactttttatttaaat

SEQ ID NO: 110 - DNA, 936 bp, Arabidopsis thaliana
atgcaaagcaagaacatgatcgtggcttcatctcatcagcagcaacaacaacagcaaccgcagcagccacaaccgcaacttaaatgccctcgttgcgattcttccaacacaaagttctgctactacaacaactacagcctctctcaaccacggcacttttgcaaggcttgcaagaggtactggacgagaggtgggactctcaggaacgttcccgtagggggtagctaccggaagaacaaacgtgtaaagcggccatcaaccgcaaccacaaccactgcctccaccgtctcgacgactaattcttcatcccctaataaccctcatcagatctctcatttctcttccatgaatcatcatcctttgttctatggtttatcagatcatatgagcagttgtaataataatcttccaatgatcccaagccgtttcagtgattcttcaaagacttgttcatcaagtggtttagagagtgagtttctctcatctggttttagcagtcttagtgctcttggattagggcttccgcatcagatgagtcatgaccacaccattaatggtagcttcatcaacaactccacaacaaacaaaccctttcttctatcgggtctattcggatcctcgatgtcttcttcttctactcttctccagcacccacataaacccatgaacaatggtggtgacatgttgggacaatcccatctccaaaccctagcatcacttcaagatttgcatgttggaggtaacaatgaagatatgaagtacaaagaaggaaagcttgatcagatctctgggaacatcaatgggttcatgtcatcatcatcatctttggatccttcaaactacaacaacatgtggaataatgcaagtgttgtcaatggagcatggcttgatccaacaaataataacgttggatcctccctcacctctttgatataa

SEQ ID NO: 111 - DNA, 1151 bp, Arabidopsis thaliana
atttgtcagctttcaaactctttgtttcttgtttgttgattaacccttaattaacggttcctctttcgatcaaatcggagaatttcacggcatggctacggctgttggtggcggaagcgatgtggaggttggatttgcgaagcttcaaggtgaggatttcgagtactatatgcagtcttactccattatactcggccggaattctaagaaagccaccgtcgacgttgatctctcatccctcggcggtgggatgaacatctcgcgcaaccacgctcggatcttctatgacttcactagacgacgcttctctctcgaggtccttggcaaaaatggctgcctcgttgaaggtgttcttcatctccctgggaatcctaacgtcaagctcgattcacaagaccttttgcagatcggagacaaagagttctactttctcctaccggttcggagcatcttaggcgggccgttgggacctaggcaccacgtctctgggcaaacaagtgttgttccataccataattatcagtcgggtccaggttctgggtcgggtaagaagggcgtcaggagtagagagttgtatgagtacgatgatgaagatgatgatgacgacgacgatgaggaggacgatatgagaggaagtggaaagaagacaaggagagatggacatgaagtagtatatgcttccggagagaagaagagagagggaagatcaaaggtagatcgtgaagctgatgatcaacaatttttgcagctggaggaaaaagatgttgtatcgtctgttgccactgtgctttccgatttgtgtggtccgggagagtggatgcctatggaaaaacttcattcggtgatattaaaggagtatggaaacgtatggcatcacagtcgagtaagaagatacctatcacaagaagactgggctatccctgaagcaaaaggtaaaccatggtacggtttgctgatgctgctgagaaaatacccggagcatttcgtcatcaacacgagatcaaagggaagagttacccttgaattcgtttccctcgttaccctactctcatgagaactttaccttagtgactcggattaaaatttaagaagctggcgcgccaaaaattggagctctgcagagctttcgttcgtatcatcggtttcgacaa

SEQ ID NO: 112 - DNA, 1081 bp, Arabidopsis thaliana
ttaacccttaattaaatggcggcttttacaaccaaacagtctctgttgttgttgtctcttctgctcttgatcagcctctccgcaggaagtttctacgacaatttcgatatcacttggggaaatggtcgtgccaatatagtagagagtggacagcttttgacttgcactctcgacaaaatctccggttcaggttttcaatcaaagaaggagtatttgttcggaaagatcgatatgaagatgaaactagtcgccggaaactcagcaggaaccgtcactgcttactacgtacgtaaaaatttatctatctccactacttcatttttttgtggcattgattgtttgaatctgatattaagaatgttttcacagctttcatctaaaggtgagacatgggatgaaatcgacttcgagttcttgggtaatgttaccggacagccttatgtacttcatacaaatgtgttcaccggaggcaaaggtaaccgtgaaatgcagttctatctctggtttgatcccactgctgatttccacacctacaccgtcctgtggaatcctctcaacatcatgtaagtatttgatcagtccaatacactattgaaaacatcattaagcgctaattcttactttattgttgttctcttattttactttgtgctttgtttttttgttggatctcaaaagctttctcgtggatggaatcccaatccgagtgttcaagaacaacgaggctaatggcgtggcctacccgaagagccagccaatgaagatttattcaagtctttgggaagctgatgattgggctacacaaggcgggaaagtcaagacagattggaccaatgctccattcagcgcttcctacaaaagtttcaacgatgtggactgctgcagccggacctcgttgttgaattgggtaacatgtaatgcgaatagcaactcgtggatgtggactacccttaactcaaatcagtatggacagatgaagtgggtgcaagatgattatatgatctataactattgtacggattttaagaggttccctcaaggtttgcctacggaatgcaatctcaactgatcggcaaattgg

SEQ ID NO: 113 - DNA, 502 bp, Arabidopsis thaliana
ttaattaactctctctctctaattgcctgctatgatgcaagaattaggcttacaacgtttctcaaacgacgtcgttcgcttagacctcactcctccttctcaaacctcatctacttctctttccatcgacgaagaggaatcaacggaagccaagatccgacggctgatatcggagcatcctgtgatcatcttcagtagatcttcatgttgcatgtgccacgtcatgaagagactcttagcaacgatcggcgtaatccccaccgtcatcgagctcgatgatcacgaggtttcctctcttcccacggctctacaagatgaatattccggtggcgtctccgtcgttggtcctccgccggcggttttcattggccgtgagtgcgtcggaggtcttgagtcccttgtcgctcttcacttaagtggtcaacttgttcctaagcttgtccaagttggagctctttgggtatgattgtaattttcatcgtcttcttactgtgggcgcgcc

SEQ ID NO: 114 - DNA, 856 bp, Arabidopsis thaliana
ttaattaaatggtttcgtttcgcttccctttctcgttttctcagcccccgcgtgccaccacgtcattctccggattctccatttccgctgtcgctgtctccgtcaccgttggcgccgcagccgccggagctgcgatcgcggcgtcccggaatcccagccatccgattctagagtgggccttctcctctcaccgttcgtctctttcaccatggggatctataactctagcagacgaatccgttgtcgaacctaagaccggtttctcgtttcccgcttcaatcggagattcccggcgattactcggcgtcggcctgaggaagaagagcttactgggattgaagaacatcgatgtctacgccttcggcgtgtatgctgattgtgatgatgtgaagaaacttgtgggagacaagtacgcaaatcttccagcttcagagatcaggggaaacaagtcattcatggatgatctcatggaagccgatattaagatgacgataaggctacagattgtctacggcaaactcaacatccgatccgtgcgtaatgctttccaagagtctgttggaaacagactcaagaagttcggtggctcagacaatgacgagttgcttcaaagcttcactagcctcttcaaagatgagtataagattccaagaaactccaccattgatttgacaaaagatccgggccatgtactcagcgttgcaattgaggggaaccatgtcgggagtgtgaagagccatctcttgtgtagatcaatcttagacttgtacattggtgaagaaccgtttgataagaatgcaagagaagattttctagacaatgcagcttctctagccttcgacaactagggcgcgcc

SEQ ID NO: 115 - DNA, 894 bp, Synechocystis sp. PCC 6803
tttgtttcttgtttgttgattaacccttaattaatccgggcgcgcctgatttatcacaagtttgtacaaaaaagcaggctcctgcaggaccatgagaaaaatcattattgcgggcaattggaaaatgcataagacgcaggcggaggcccaagcgtttttgcaggggtttaaacctttaatcgaagatgcggcggaaagtcgtgaggtggtgttgtgtgttcctttcaccgatttgagcggcatgtcccaacaactccatggcggtagggtccgcctaggggcacaaaatgtccattgggaagcgagtggggcctacacaggggaaatttcagcggctatgttgacggaaatcggtattcattatgtggttatcggccacagtgaacgacggcaatattttggggaaacggacgaaactgccaatttgagagtattggcggcccaaaaggcgggcttaattcccattctgtgtgtgggggaaagtaaggcgcaacgggatgccggagaaacggaacaggttatcgttgaccaagtgaaaaaaggcttggtgaatgtggatcaatctaacctagtcatcgcctacgagccgatttgggccattggtacaggggacacctgtgcggcaacggaagccaatcgggttattgggctgattcgggaacagttaactaattcccaggtcaccatccagtatggcggttcggtcaatgccaacaatgtggatgaaattatggcccaaccggaaattgatggagccttggtgggaggagctagtctggaaccccagagctttgcccgcattgttaattttcagccctgactcgagacccagctttcttgtacaaagtggtgataaattggagctctgcagagctttcgttcgtatcatcggtt

SEQ ID NO: 116 - DNA, 1217 bp, Arabidopsis thaliana
ttaattaaaatggttgaacagactcagcaccccacgattcttcagaaggtttctggccaactcttgagctcgagtgtttctcaggacattcgtggttatgcttcggcttccaaaaggcctgctacataccagaaacatgcagcttacggaaactactccaatgctgcatttcaatatcctcttgtggctgcatctcagattgcaactactacttctcctgtgtttgtccaagctccaggagagaagggatttactaactttgctattgatttcatgatgggtggtgtttctgctgctgtgtcaaagactgctgctgctcccattgagcgtgtcaagcttttgattcaaaaccaggatgagatgcttaaggctggaaggcttactgagccatacaagggtattcgtgactgtttcggcaggacaattagggatgaaggtattggttcgttgtggagaggaaacaccgctaatgttatccgttacttccccactcaggccttgaactttgcattcaaagattacttcaagaggcttttcaacttcaagaaagacaaggatggctactggaagtggtttgctggtaacttggcatctggaggtgctgctggtgcctcttcccttctctttgtgtactctcttgactatgcacgtacccgtcttgccaatgactccaagtctgccaagaagggaggaggtgaaaggcagttcaatggtcttgttgatgtctacaagaagaccctcaagtcagatggtattgctggactttaccgtggtttcaacatctcgtgtgctggtatcattgtctaccgtggtctctactttggactgtacgactctgtgaagcctgtcctcctcactggagacctgcaggacagtttcttcgctagttttgctcttggatggctcatcaccaatggtgcgggtcttgcgtcgtacccgattgacacggttagaagaagaatgatgatgacatcaggtgaagcggtgaagtacaagagctcatttgatgcgttctcacagatcgtgaagaaggaaggagccaagtctctgttcaagggtgcgggtgccaacatcctgcgtgccgttgcaggtgctggtgtgcttgctggctacgacaagctgcagttaatcgtcttcggcaagaagtatggatctggaggtgcctaagtaccaccaaatcccgcagtcattaagcttcggcttttgtttggcgcgcc

SEQ ID NO: 117 - DNA, 868 bp, Arabidopsis thaliana
ttaattaaatgcccaagatctgctgctctcgttccgctacacaagttgtggtagcacaaaaatcaaactcgggtaaaggaagaaacggtgaaggaggaatcaagtatggatttagtttgataaaagggaaatctaaccattcaatggaggattatcatgttgctaagtttaccaatttcaatggcaatgaattggggctttttgcaatctttgatggtcataaaggtgatcatgttgctgcttatctgcagaaacatctcttctctaatatccttaaagatggagagttcttggttgatcctcgaagagcaattgcgaaagcttatgagaatacagatcaaaagattttagcagataatagaacggatttagagagtggtggttcgactgctgtgactgcgattttgatcaatgggaaagctttgtggatagctaatgttggtgattcacgagctattgtttctagtcgaggtaaagcaaaacagatgagtgttgatcatgatcctgatgatgatactgagaggagtatgattgagagtaaaggtggatttgtgaccaacagaccaggtgatgttcctcgagtgaacggtttgttagcggtctctcgtgtctttggagataaaaaccttaaagcatatttgaactcagagcctgagattaaggacgtaaccattgatagtcacacagattttcttattctggctagtgacggtatttcgaaggtgatgtcaaaccaagaagcagttgatgtagctaagaagttgaaagatccaaaggaagcggcgaggcaagtagttgctgaagcattgaaaagaaacagcaaggatgacatatcttgcattgttgtccggtttagatgaggcgcgcc

SEQ ID NO: 118 - DNA, 1549 bp, Arabidopsis thaliana
ttaattaaatggactccaaaacaacttttctcacatttctcctctgtattttcattttctctcatttttcaccctcaacttccaaatctctgacagaaaagcccttatctttctcaccgtcggcgagtttgccgactctcacggcggagagacttatcaaaggattcaatttgatgcctacacgcgacgtcaatgtcatcgatgaagaaggttctgaggctccgagactggtcgagagagcattcgatttgccggcggcggttgaccgtcgtggctccggtggttctccgtcggttcaagattttggtcaccatgctggttactacaaactccctaactcaaaagcagcaaggatgttctactttttcttcgagtcaaggacgaacaaagccgatccagtggtgatttggctaaccggtggaccaggttgcagtagtgaactggctctgttctacgagaacggaccgttcaccgtctctaacaactcatctctttcttggaacgaatttggttgggacaaggcatcaaatctaatctacgtggaccaaccggtaggaactggtttcagttacacatcggaccaaagcgatcttcgtcatgacgaggatggtgtcagtaatgacctttatgacttcttacaggcgtttttcaaagagcatccacaatttgtgaagaatgatttttacattaccggtgaatcctacgctggacattacattccggcattggcttcacgtgttcaccgtggaaacaagaacaaagaaggaactcacattaaccttaagggttttgcgatcggtaacggtttaaccaacccggagattcaatatggtgcgtatgcggattacgcgctagacatgaatttaatcacacagtctgatcatgataacctcaaccgttattacgcaacttgtcaacaatctatcaaagaatgcagcgcggatggtggtgaaggggatgcgtgtgcttcttcttacactgtctgcaacaacattttccaaaagataatggatattgctggaaacgtaaactattatgacgtgaggaaacaatgtgaaggaagcttatgctatgatttctcgaacatggagaatttcttgaaccagaaatcggtgcggaaggcattaggtgtgggagatatcgagtttgtgtcttgcagtacagcggtctacgaagcaatgcagatggactggatgcggaatcttgaggtcgggattccagctcttcttcaagatggaattaagctccttgtttatgccggagaatacgatctcatctgcaattggctcggaaactcaaagtgggttcacgaaatggaatggtcaggccagaaagagtttgtagcagcagcgacagttccattccacgtagacaacaaagaagcgggtttaatgaagaactacggttcactcactttcctaaaggtccatgatgctggacacatggttccgatggatcagccaaaggcagcattgcaaatgcttcagaactggatgcaaggaaagctcagtacacccactggtcggaccgctcatcagtaaggcgcgcc

SEQ ID NO: 119 - DNA, 753 bp, Arabidopsis thaliana
ttaattaaatttggttgataaacaaaggcttcaagaattctaccggaatcaatggaggttctggtaggttctacgtttagggatcgtagcagcgtcacgacgcatgatcaggccgtaccggcgtctctgtctagccggattggtttgaggagatgtggtagatctcctccgccggagagttcgtcgtccgttggagaaaccagcgaaaacgaggaagatgaagacgacgccgtttcgtcatcacaaggaagatggctcaattcgtttagttcatctttggaagattctcttccgattaagagaggattatcaaaccattacatagggaaatcgaaatcgtttgggaatttaatggaagcgagtaacacaaacgatttggtgaaagtggagagtccattgaacaagagaagaagattgcttattgctaataagctaagaagaagatcgtccttgtcttctttcagcatctacactaaaattaaccctaattctatgccgttgcttgcattgcaagaatctgacaacgaggatcataaactcaatgatgatgatgatgatgatgatagtagcagtgatgatgaaactagtaagctgaaagagaagaggatgaagatgacgaaccatagagattttatggttcctcagactaagagctgttttagcttaactagttttcaagatgatgatgatcgatgatcgatgatcattcttcttcttttgtccaagagtagataaagtttcgttgggcgcgcc

SEQ ID NO: 120 - DNA, 1057 bp, Arabidopsis thaliana
ttaattaagaaaatgctgactctactcttcttctctctcggagcgcttcttcttatcgttctgctcttcaaatttgcattcgccgatggagattttaccttgatttcgaagaagcatgtgaagcgtgaggccatacaaggcaaggtcgtctggatcacaggggctagccgtggaattggtgaaattcttgctaaacagtttgcaagtttagatgccaagcttattctctctgctaggaataaagctgaactggatcgggttaagagtgagcttaaaggtaaatttgcaccagaagatgtcaaggttttgcctttagatttagctagcggcgaagagtcactcaaacatgttgtagagcaagcagtgtcgcttttccctggagctggtgttgattatttggttcacaatgctgcctttgagcgtccgaaatccaaggcatcggatgcaagtgaggaaactctcaagactacattcgatgttaatgtctttgggacgatatctctgacaaagttggtagctcctcatatgctaaaacaaggagggggtcattttgttgtgataagcagtgctgcaggaaaggtaccatcacctggacaggctatatattctgcttcaaaacatgctcttcatggctacttccacagcttgcgttctgagttctgtcagaagggaatcaaggttaccgtcgtttgtcctggtccaatagaaacctggaatggtacaggaacatcaacttcggaagacagcaagtctcctgagaaacgtgtgtcatctgaacgatgtgcagagctgactataatcgctgcatctcataacttgaaggaagcttggatttcatatcagccagtactactcgtgatgtatctagtgcagtacatgccttcccttggcttctggctcatggacaaggttggaggaaagcgtgtggaggtcgcggaaaagaaaggcaacacatactcgtgggatttactgttcgggaagaagactaaaacaaactgaagctgattctctagaagatacacatagatgtggttggttgagccttagtcggcgcgcc

SEQ ID NO: 121 - DNA, 733 bp, Arabidopsis thaliana
cttgtttgttgattaacccttaattaaatgagtgacgcgtttgatggatatgagcgacaatactgtgagctctcggcgagtctttcaaagaagtgttcctctgctatttcgcttgatggagaacaaaagaagcagaagttgtctgaaataaaatccgggctggaaaatgcagaagtattgattaggaaaatggatctcgaggcaaggacccttccacctaatcttaagtccagcctccttgtcaaattaagagaattcaagtctgatctgaacaatttcaaaactgaagtgaagagaatcacatctggacagttgaacgctgctgctcgtgatgagttgctagaagctggtatggctgacacaaagacggcttcagctgatcagagagcaagattgatgatgtcaactgagcgtctgggccgaaccactgacagagtcaaggacagtcgtagaacaatgatggagactgaagaaatcggtgtttcaatcctccaagacttgcacggtcagagacagtctctcttacgtgcccacgaaacgcttcatggagtagacgataacattggaaagagcaagaagatcttgacagacatgacgaggaggatgaacaagaacaaatggaccattggagccatcatcatcgcattgattgccgccattttcatcatcttgtacttcaaactcaccaagtaagcctctgggcgcgccaaaaattggagctctgcagagcttt

SEQ ID NO: 122 - DNA, 2211 bp, Arabidopsis thaliana
atttatttgtcagctttcaaactctttgtttcttgtttgttgattaacccttaattaagcatggtctctccactcacactctttctcatcctcttcttcttcttcctttcttctgcactgtcttcctcctcctcagagctcgacattctcctcgatatcaaatcctctctcgaccctgaaaaacgtttcctcacttcatggactcccgacgccgacccttgctcctctggctccttcgacggtgtcgcgtgcgacggaaaccgccgtgttgctaacatctctcttcaaggaatgggtctcactggaactatccctccttcaatcggtcttctcacaagcttaaccggtttataccttcacttcaactccttgaccggtcatattcctaaagatatctcaaatctgcctctcctcaccgatttatacctcaatgtcaacaatctctccggtgaaatccctcctctaatcgggaacttagacaatcttcaagttatacagttatgttacaacaagttaagtggaagtataccgacacagtttggttctcttaagaagataactgtcttggctttacagtataaccaactctccggcgccattccggcgagtttaggcgatattgatacgttaacgaggcttgatttgagcttcaacaacctctttggtcctgttccggtgaaactcgccggtgctcctttgcttgaagttctcgacattcgtaataactccttctccggcttcgttccctctgctttgaagaggctaaacaatggattccagtattcaaacaatcacggtttatgcggagatggtttcactgatttgaaagcttgcaccggcttaaacggtccgaaccctaaccgaccagacccaacaaacccaacgaatttcacaacagttgacgtgaaaccagaatcagcagatttacaacgaagcaattgcagtaacaacaatggcgggtgttcatcaaaatccttaaagtcttcacctttaggaatcgtcatgggtctaataggatcaatcctcgcagttgcaatctttggcggttcaacattcacatggtacagacgaaggaaacagaagattggaagcagtcttgatgcaatggacggtaggattagtactgagtacaacttcaaagaagtttctagaagaaaaagctcttctccattgatcagcttagagtacgcaagtggttgggatccgttaggacgaggacagagcagtaacaacaacagtgcattgtctcaagaagtctttgagagctttatgttcaatcttgaggagattgagagagctactcagagcttctctgagattaacttgttggggaagagtaatgtctcttcagtttataaaggtatccttagagatggttctgttgcagctatcaaatgtatagctaaatcgagctgtaaatccgatgaatccgagtttctcaaagggttgaagatgctgacactgttgaagcatgagaatttagcgaggttgagaggattctgctgctcgaaaggacgtggagaatgtttccttatctatgagtttgttcccaatggtaatcttttgcagtatcttgatgtgaaggatgagactggagaggttcttgaatgggcaactcgagtttccatcataaacggaatcgccagagggattgtgtacttgcatggagaaaatgggaacaaacctgcaatagttcaccagaatctatctgcagagaagattctcattgatcactggtataatccttctcttgcagattccggtcttcacaagcttttcacagatgatatcgttttctcgaagctcaaagcaagtgcggcaatgggatacttagctcctgagtacataactacagggaggttcactgataagagcgatgtttatgcatttggtatgattctgttgcagatactgagtggtaaaagcaaaatcagccatttgatgatcttacaagctgtagagtcaggaagactgaatgaagacttcatggatccaaatcttcgaaagaacttcccggaagtagaagcggctcagctcgctagacttggtcttctctgcactcatgaatcctcaaaccaaagaccatccatggaagatgttatccaagaactgaataatctcgccgcggattattagtttcccgtttaacatgattcttgaaatacccagcaaattggagctctgcagagctttcgttcgtatcatcggttt

SEQ ID NO: 123 - DNA, 586 bp, Arabidopsis thaliana
ttaattaaaaaaagcaatgggaggtggtaaagacaagcatcatgatgagcaagagaaaggatttcatggttttccaggaggtggacattacccacctgctcaaggaggttaccctcctcaaggttacccaccacaacaagggtatcctccagctggaggctacccacctgccggatatcctcctggtgcttaccctgctgcgcccggtggttatcctcctgcacctggaggttaccctcctgctggctatcctgcacctggagctcaccattcaggacattctggtggtggactcggaggcatgatagcaggtgcagctggtgcagccgcagcagcttatggagctcaccatgttggtcacgcctctcacaacccttacgggcatgctgtaggacatggagggtatggccatgcccctgctcatggctttggccatggtggtcatggtaaattcaagcacggaaagcatggaggcaaattcaagcacggaaagcatggaaagcacgggaaacatggcatgtttggaggaggaggcaaattcaagaagtggaagtaatctcaaaaaccccacctttgatggcgcgcc

SEQ ID NO: 124 - DNA, 930 bp, Arabidopsis thaliana
atggaaggaaccggcgttgtggcggtgtacggtaacggtgcgataacggaggcgaagaaatctcccttctccgtgaaggtcggtttggctcagatgctccgtggtggtgttatcatggatgtcgtcaacgccgagcaagctcgtatcgccgaggaggctggtgcttgcgccgtcatggctttggagcgtgttcctgctgatatccgcgctcaaggaggcgtcgctcgtatgagcgatccacaaatgattaaagaaatcaaacaagccgttacgattccggtgatggctaaggctaggattggtcatttcgttgaagctcagatccttgaagcaattggaatcgattacatcgatgagagcgaggttttgactcttgctgatgaagatcatcacatcaacaagcataatttccggatcccgttcgtttgcggttgccggaatctcggcgaggctctgaggaggatccgtgaaggtgcggcgatgattaggaccaaaggtgaagctggaaccggtaacattattgaagctgtgaggcatgtgaggtctgttaatggtgacattagggttttgcgaaacatggatgatgatgaggttttcactttcgctaagaaattagccgctccgtacgatctcgtgatgcagactaagcagcttggtcgtcttcctgtagtccaattcgccgccggtggagtggctactccggctgatgcagctctcatgatgcagcttggatgtgatggtgtctttgttggttctggtatcttcaagagcggtgacccagctcgtcgtgcacgtgccattgttcaggctgtgactcattacagtgaccctgagatgcttgtggaggtgagctgtgggcttggagaagccatggttgggatcaatctcaacgatgagaaggttgagaggttcgctaatcgctccgagtga

SEQ ID NO: 125 - DNA, 1533 bp, Arabidopsis thaliana
atgttcatcgagagcttcaaagtagagagtccaaatgtcaaatacacagagaatgagatcaattcggtgtacgattacgaaacaacagaggtcgtccacgagaatcgtaacggtacatatcaatgggtcgtgaagccaaagactgtcaaatacgatttcaaaacagacactcgtgtccccaaattaggggttatgcttgttggttggggaggaaacaatggatcaacactaaccgctggtgtcattgctaacaaagaaggaatatcgtgggcgactaaagacaaagtgcaacaagctaattactttggttcacttactcaagcttcatcgattcgtgttggctcttacaatggtgaagagatctatgctcctttcaagagtcttcttccaatggtgaatccagaggatgttgtgtttggtggttgggatataagtgacatgaatttagcagacgctatggctagagctagagttcttgatattgatctgcagaaacaacttagaccttacatggagaacatgatcccacttcctggtatctatgaccctgatttcatcgctgctaatcaaggttcacgtgctaatagcgtgatcaaaggtaccaagaaggaacaagttgatcacatcatcaaggacatgagggagtttaaggagaagaacaaagtggataagttggttgtgttatggactgcaaacacagagcgttatagcaatgtgattgtaggacttaacgatacgacggagaatctattggcttctgttgaaaaggacgagtctgagatctcgccgtctacgttgtatgcgattgcttgtgttcttgaaggcattcctttcatcaatgggagtcctcagaatacttttgtccccggtcttatcgaattggctatatcgaagaattgtttgattggtggggatgatttcaagagtggtcagactaagatgaaatccgttttggttgatttccttgttggagctggcattaagcctacttcgattgtgagctataatcatttgggaaacaacgacgggatgaacctctcagcgccacagactttccgctctaaggagatttcaaagagcaatgttgtagacgacatggtagctagtaatggcatcctctttgagcctggtgaacaccctgaccatgtcgttgtcatcaagtatgtgccatatgttgcggatagtaaaagagcaatggatgagtacacgtctgagatattcatgggagggaggaacactatagtgttgcataacacttgtgaggactctctcttggctgcaccaattatcttggatcttgtccttctcgctgaactcagcaccagaatccaatttaaagctgaaggagaggggaagtttcactctttccacccggtagctaccatactcagttacctcacaaaggcacctcttgtaccgcccggaacaccggtggttaacgctctgtcgaagcagcgggcaatgctggaaaacattcttagggcatgtgttgggcttgcgccagagaacaacatgatcatggagtacaagtga

SEQ ID NO: 126 - DNA, 900 bp, Glycine max
ttaattaagtaagaaaaatagagcaatttcacaacacaacacaactcttataattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgtttatttttgatttaaat

SEQ ID NO: 127 - DNA, 1973 bp, Arabidopsis thaliana
ttcttgtttgttgattaacccttaattaagagatgggacttgttacagtcggagaattgaagccagctttcacaggaaagagagggtttcgtctgaattcaaccatcagacatgcctctgaatggccgatatccgatgtctctagtgatctgacagttcaagttggatcttcgagtttctgtcttcataagtttcctcttgtgtctcggagtggaaaaatccgaaagcttctcgcggatccaaaaatatcgaatgtttgtctctcaaatgctcctggaggatcagaggcttttgagctcgcagctaagttctgttatggaatcaacattgaaatcaaccttcttaatatagctaagctccgttgtgcatctcattatctagagatgacagaggatttctcagaggagaatctcgcttccaaaacagaacatttcttgaaagagacaatcttccccagtattttgaattccatcatcgttctacatcattgcgaaaccttaatcccagtctctgaagatctcaacttggttaatcggttaatcatagctgttgccaacaatgcctgcaaagaacagctaacatcgggtcttttaaagctcgattattcgttctcgggtacaaatatcgaaccacaaactccattagactggtgggggaagtcactagctgttctgaacctcgatttctttcagagggttatctctgcggttaagtctaaagggttaatacaagacgtgatcagcaagattctgataagctacacgaataagtctcttcaagggctcattgttcgcgatccgaaactggagaaagaaagggttcttgattcagaaggtaagaagaaacagcgattgattgtggaaacaattgtgaggttacttcctacacaaggaagaagaagctctgttccaatggcgtttctttcaagtcttctcaaaatggtcatcgcaacatcgtcatctgcttctacaggatcatgtagatcagatctagaacgaagaatcggtctgcaattagaccaagccatcctcgaagatgtcttgattccgataaatctcaatggaacaaacaacaccatgtacgacatcgattcaatcttgagaatcttctctatattcttgaacctcgatgaagacgacgaagaagaagaacatcatcatcttcaatttagagatgaaacagagatgatctacgattttgacagccccgggtctccaaaacagagctctatcttgaaagtatcgaagctaatggataactatctagctgagatagctatggatccgaatctcacaacctcaaagttcatagctttagcagaactcttaccagatcatgctcgtatcatcagtgatggactctatcgagccgttgacatttacctcaaagttcatccgaatataaaggattcagagcgttatcgtctctgtaagacgatagactcacaaaaactatcacaagaagcttgtagccacgcagctcaaaacgagagattacctgtgcaaatggccgtacaagtgttgtactttgagcagatcagactcagaaacgcaatgagcagtagcataggtcctactcagtttctattcaacagtaactgtcatcagtttcctcaacggtcaggaagtggagcaggaagtggagcaatatctcctagagataactatgcgtcagtgaggagagaaaacagagagctaaagcttgaggttgcgaggatgaggatgagattaactgatctagagaaagatcatatctcgattaaacaagaactcgtgaaatctaatccagggactaagcttttcaagtcatttgctaaaaagataagcaaactcaattctcttttcagtttcagtagtcttaaaccttccttgagtggcaaggcaagttctgaaagccgtttcttgtttcagagaaaaagacgacactctgtttcttgatctttaaatttaaatacccagcaaattggagctctg

SEQ ID NO: 128 - DNA, 1591 bp, Arabidopsis thaliana
ttaattaaaaactctattgagtagaaaatgagtgctgcagcacacaggactcctaaatcagggaggcaatctctgctatttcaagatttagcttctcctgtttcagcacgtagagggaaattctcgagtccgggacaggcagctgcggtatctgcactatggcgtgagaatttcggaggatctgatcttccaccacctccaatgtatactttggatgaccggtccgatttctctcctgagtctggtattgcagactactctgcgtctccagatgctaagtctgacagaagaacaccattccagagttctggaaagaatattgtaactcctggtaaaggaaagttggaagcaagcccttctttttctctactgaatgcacaacagagtcagcaagtttcagggagtccgagttggtggtcgcagtcaaaggcaggtagtagtaccgagcaggatgataaagggaagggatctcctgtagaaggggtggttcagccaggtgcattggtcactcttccgccgccaagagaagttgctaggccagaggttcagaggcagattatacctacaggaaaccttgatgaggaagagtgggtcactgtctatgggtaaggccatttaagctttattgctctcgtttttctcactttactgttgcaaatgttcttgatttgtcaacattctcgtgtctctgaaattctaggtacatggatgataacagttatattggtactgggtagtgttattaagtgccttaacttgtgtctgtctcccatgtttcaatcttagagaactgttcataataaatgctgttctttaccatcatgatgctcaaatatcagcctttgattgtgattttatgttttgatcattgtgaattctgactctttacatggataataactggtagtgttattaagtgccttatcttgtgtttatctcccatcttttcaatcttaagaactgatcataataactgccttcagattttctccaggtgatacaaatttagtactacgggagtttgaaaaatgtggtatggtcttgaaacatgttcctggtccaagaaatgccaactggatgcacatcctctaccaggttactgttcttcccttcaaacctgtttgatgcatgttgataagcattcatagttcttctagacgagtcatcatacatgatagtctaatcaaatcttttatataaaggaaacaacgaactgacaatggtctgtgtatttgatacagaaccggtctgatgcacataaggcgctgaacaaagcagggatgatgataaacggagttgtaatagtaggagtgaagccagtagacccaatacagaagcaagcgttaaacgagagactcaacaaccaaggattcatgcctttacctccaccatcatccactagaaacactgctcgacccctgtctcgtcctcagtacttgcaaaacggcagcgctttctctcctcaaccaagtggtggcgctatggcctctccgtcaaagtcaatggtctcaaagttctttgacttgatgttcggtgtttaaaagctacttcaatggcatttcccgaatgattcttctttacacggcgcgcc

SEQ ID NO: 129 - DNA, 1031 bp, Arabidopsis thaliana
ttaattaacaatttcattctctcttctctctccaatttcacaacaatgggagtcaaaagtttcgttgaaggtgggattgcctctgtaatcgccggttgctctactcaccctctcgatctaatcaaggttcgtcttcagcttcacggtgaagcaccttccaccaccaccgtcactctcctccgtccagctctcgctttccccaattcttctcctgcagctttcctggaaacgacttcttcagtccccaaagtaggaccgatctcactcggaatcaacatagtcaaatcggaaggcgccgccgcgttattctcaggagtctccgctacacttctccgtcagacgttatattccaccaccaggatgggtctatacgaagtgcttaagaacaaatggactgatcctgagtcagggaagttgaatctgagtaggaagatcggtgcagggctagtcgctggtggaatcggagccgccgttggaaatccagctgacgtggcgatggttaggatgcaagctgacgggaggttacctttagcgcaacgtcgtaactacgccggagtaggagacgcaatcaggagcatggttaagggagaaggcgtaacgagcttgtggcgaggctcggcgttgacgattaaccgagcgatgattgtgacggcggctcagctagcgtcttacgatcagttcaaggaagggatattggagaatggtgtgatgaatgatgggctagggactcacgtggtagcgagttttgcggcggggtttgttgcttcggttgcgtctaatccggtggatgtgataaagacgagagtgatgaatatgaaggtgggagcgtacgacggcgcgtgggattgtgcggtgaagacggttaaagcggaaggagccatggctctttataaaggctttgttcctacagtttgtaggcaaggtcctttcactgttgttctcttcgttacgttggagcaagttaggaagctgcttcgagatttttgataccattcttttattgatgatgatgatggcgactatggcgcgcc

SEQ ID NO: 130 - DNA, 1036 bp, Arabidopsis thaliana
ttaattaaatgaattggactagaggaaaaactttaggccgtggctcaacggccaccgtttccgccgccacttgtcacgaatccggcgaaacactcgccgtaaaatccgccgagtttcaccggtcggagttcttgcaaagagaagccaagattctctcctcattaaactctccgtacgtcatcggatacagaggatgcgaaattacgagagagcccttccacaacaacggagaagctacgacttacagtcttcttatggagtacgcgccgtacggaacgttgaccgacgtagcgaccaagaacggcggcttcattgacgaggctcgggtcgtgaagtacacgcgccagatacttcttgggttggagtacattcataactcaaagggaattgcgcattgcgacattaagggaagcaacgtgttggtcggagagaacggagaagccaagatcgctgatttcgggtgtgcgaaatgggttgaaccggaaataaccgaaccggttagaggaacgccggcgttcatggctccagaagcggcgcgtggagagagacaagggaaagagagtgatatatgggcggtgggttgtacggtgatagagatggttaccgggtctcagccgtggattggggcggattttaccgacccggtttcggttctttaccgggtcggatatttaggtgagttaccagagctgccttgctcgcttacggaacaagcaaaggattttttaggaaagtgtttgaaaaaagaagcgacggagagatggacagcgagtcaactactaaaccatccgttcttggttaataaagaaccggaattggtaaccggtttggttacgaactcaccgacaagtgtgacggatcaaatgttctggagatcagtggaagaggaggtgtcagaggaccgttcaagctggtgggaatgtcacgaggatgagagaattggagtgctaagctggattggtcatgttgtggtggagtccacatgggacttggacggtgaggattggatcacggttcgacggaattagggcgcgcc

SEQ ID NO: 131 - DNA, 670 bp, Arabidopsis thaliana
ttaattaaatggcgagaagaccggacgaagaatacgactacttgtttaaagtggttttgatcggagactccggtgtcggcaagtctaatctcctctctagattcactcgcaacgagttctgcttagaatccaaatccaccattggtgtcgaattcgctactcgtactctccaagtggaaggaaggactgtgaaagctcagatatgggacacggctgggcaagaacgatacagagccataactagcgcctattacagaggtgcacttggagctcttttggtctatgatgtcaccaagccaacaacgtttgagaatgtaagcaggtggttaaaagaactaagagaccatgcagattccaatatagtgatcatgttgattgggaacaagacagatctgaagcatctcagagcagttgccacagaggatgctcagagctatgcagagaaagaaggcttatctttcatcgagacatcggctctcgaggcattaaacgtagaaaaggcttttcagacgattctctcggaggtttataggatcatcagcaagaagtcgatatcttcagaccagacaactgcaaatgccaacatcaaggaaggccaaacaattgatgtggctgctacttctgaatcaaacgctaagaagccttgttgctcatcgtcttgaggcgcgcc

SEQ ID NO: 132 - DNA, 695 bp, Glycine max
ttcttgtttgttgattaacccttaattaatccgggcgcgcctgatttatcacaagtttgtacaaaaaagcaggctcctgcaggaccatggctagcgatggcagcgaagagttcaggctagtgtcaccggcgttcaaaaacggggggaagttaccgaggcactacaccgacgatggtcagggtacgaagaagaacatatcccctccattggagtggtataacctcccggaggggacgaagactcttgccctcgtggtggaggatattgatgcgaccgattctggtgggcccatggtgccatggactcactgggtcgtcgcaaacatcttggccacggtgaagggcttgccggagggattttccggcaagtcggccgagatggggggcgactacgcggcgatcaaggaggggaacaatgacctgaaggtgcctgggtggaatgggcccaggctgcccacgcctggacacaggattcagtttaggctctatgctttggatgatgagctcaagcttggtaacaagttgacgaaggagaagttgttggaagataccattgaaggacatgtgttaggagaagcgaccttgatggctatattctaatgtaacaacatattgtgggtgcattgtctttggctttatacatgtaccattttaaaagtgttaggagaagcgaccttgatggctatattctaatgt

SEQ ID NO: 133 - DNA, 385 bp, Arabidopsis thaliana
ttaattaaatgggtaacggagacaaagtcatgagccactggagcttccacatcccacgtctccatcatcatgagcatgatcatgaaaaggtaccaaaagggtgtttggcagtgaaggtaggacaaggagaagagcaagagagatttgtgattcccgttatgtactttaatcatcctttgtttggacaactcttgaaggaagctgaagaagagtttggttttgctcaaaaagggacaatcacgatcccttgtcacgttgaggagtttaggtatgttcaaggattgatcgatcgagaaaacactagatttctcggtactaatctccttgatcatcaccatcatcatcacaaccatctcatccggtgttttagggtttgaggcgcgcc

SEQ ID NO: 134 - DNA, 1984 bp, Xanthomonas campestris
ttaattaacctggtggcggttctagggcagggccgacaatgacggtcacctgcgaaatggacgcgctgggacgggcgccggatatcggccgcgaacgcggcttgttggggcgttcgctggtgtctgccggcgtcatcaccgacgagcaactacgcgccgcgcttgccttgcagcaacgctggaattcgcgcctgggcgatgtgatcctggcccagcgcggcgtgccggcgcagcggttctacgccatcgtggccgcgcacttcgggctgcagttcgtcgacctggtgcaacagccgccggaccccgagctgctcaccgccaccgatctggatgtgtatgcgcagcggctgatcctgccgtggcggcgcgaggatggtgtgctggtgctggccgtggccgacccggacccggcgctgttcgcctgggcgcgcgagcattacggtgcgcaagtccgcttcgtcggcactgccaagttcgacatcatctggagcctgcagcgctacgccgacgagcagctcaccgacaatgcgctgaacctgctggccgcacacgcgcctacctattccgcacgccaggtggtcacccgcgggcagaagttcaccttgtgggcgattgccgcggtgctggtggcggcaatcgccgcattccccatcatcacgctgatcaccatcaatgtgctggtagcgctgggctttctggcgaccttcggcctgaagttgctgctggtgtggttcggctcgcgccaccgcatcgacatcaaggtcaccgaagacgaagtggccgcgctgcgcgatgacgacctgccggtctataccgtgctggtgccgatgtacaaggagccggaagtcctgccgatcctggccaacgcgctgcgcaagctggattacccgatcagcaagctcgacgtgaaactggtgctggaagccgacgatttcgacaccatcgaagcggccaagaaactcggcctggaagcgttcttcgaaatcatccgggtaccgccgtcgcagcccaagaccaagcccaaggcctgcaactacgcgctgcatttcgcgcgcggcgaactgctcaccatctacgacgccgaagacaagcccgagccggatcagctcaagcgcgtggtggctgcgttccgcaaggcggaaaaagacgtggtgtgcatccaggcgcgcttgaactactacaacgccgacgaaaactggctgacgcggatgttcacgctggagtacacgctctggttcgacttctacctgccggcgctggaatacctgcgcattccgattccgctgggcggcacctccaatcacttccggctggacgtgttgcggcaggtgcgcgcgtgggacccgtacaacgtcaccgaagacgctgaccttggcgtgcggctgatccagaacggctaccgcgtcaacgtggtgaactccaccacgttcgaagaagccaacgtcagcattcccaactggatccggcagcgttcgcgctggctcaagggctacatgcagacctggctggtgcacatgcgcgacccggtgcatctgtaccgcagcaccgggttcaaggggttttggggctttcagttcttcattggcggtaattttttcatcgcactgggcgtgccggtgatgtggacgctgtgcctgatcagcatgctgagcggtgcacgcatatttgatgcgacctttccaccgtggctggccacgatctcgctggtcaatctgctgttggccaacgcgttcttcgtctacgtcacgctggtggccgcgttcaagcgcgactacttcaagctcgcgccgtatgcgctgacggtgccgttctattggttgctgcagtcgatcgcggcctacaagggtctgtggcagttgatccgcaatccgttctactgggagaagaccacgcatggcatcagcaagcattccgaacaagagcgccgcgccgcactcgaagagtgagccgggcgccgcgcgccgcgacagcgggttatttaaat

SEQ ID NO: 135 - DNA, 3326 bp, Arabidopsis thaliana
cccttaattaaccttttgtctctttgtactttcagatactatcgttgacttcgaagtaagaaaagaaaatggagattttgacgagcatagctattacagtagcaacaacgatcttcatcgttttgtgtttcactatctatcttatgatcagaatctttaccgggaaatcaagaaacgacaagagatatgctccagtgcatgccacggtctttgatcttctcttccacagcgacgagttatacgattacgagacagagatcgcgagagagaagccgacttacaggtttttgagtccaggacagagcgagatattaactgcagatcctcgtaacgtggagcatattctcaagacaagattcgataactatagtaaaggacacagtagtagagagaatatggcggatcttctaggacatgggatctttgctgttgatggagagaaatggagacaacagaggaagctttcgagctttgagttctctactagagttttaagagattttagctgctctgtttttaggagaaatgcatctaagcttgttggttttgtctcggagtttgctctctctggaaaagcttttgatgctcaagatttgttgatgagatgtacactggactccatctttaaagttgggtttggtgtggagttaaaatgtttggatgggtttagcaaagaagggcaagagtttatggaagcttttgatgaaggtaacgttgcaactagttccagattcatcgatcctctttggaagctgaaatggtttttcaacattggatcacaatctaagctcaagaagagcattgctactatagataaatttgtctatagtctcattaccactaaaaggaaagagcttgctaaggaacagaacactgttgttagagaggacatactatcgagattcctagtggagagtgagaaagatccggagaacatgaatgataagtacctgagggatataattctgaacttcatgattgctggtaaggacacaaccgctgcactactctcttggttcttgtacatgctctgcaaaaacccacttgttcaggagaaaatcgtacaagaaatcagagatgtgacatttagtcacgagaaaacgaccgatgtaaatggtttcgttgaaagtattaacgaagaggctcttgatgagatgcactacctccatgcagccttgtctgagaccttgaggctctaccctcctgtgcctgtggacatgaggtgtgcagaaaatgatgacgttcttccagatggacatagagtgagcaaaggggataatatctactacatagcctatgcaatgggtaggatgacttacatttggggtcaagatgctgaagaattcaagccagagagatggctcaaggacggcttattccaacccgaatcaccattcaaattcataagctttcatgctggtccaagaatctgtcttggcaaggatttcgcataccggcagatgaagatagtatcaatggcacttcttcacttctttcgcttcaaaatggctgatgagaacagcaaggtgtattacaagagaatgcttactcttcatgtcgatggaggactccatctctgtgcaatcccgaggacaagcacttgagtacttaaccagaatactttccatacttttatagtgcctccatgagttttgatttaaatcccttaattaaccttttgtctctttgtactttcagatactatcgttgacttcgaagtaagaaaagaaaatggagattttgacgagcatagctattacagtagcaacaacgatcttcatcgttttgtgtttcactatctatcttatgatcagaatctttaccgggaaatcaagaaacgacaagagatatgctccagtgcatgccacggtctttgatcttctcttccacagcgacgagttatacgattacgagacagagatcgcgagagagaagccgacttacaggtttttgagtccaggacagagcgagatattaactgcagatcctcgtaacgtggagcatattctcaagacaagattcgataactatagtaaaggacacagtagtagagagaatatggcggatcttctaggacatgggatctttgctgttgatggagagaaatggagacaacagaggaagctttcgagctttgagttctctactagagttttaagagattttagctgctctgtttttaggagaaatgcatctaagcttgttggttttgtctcggagtttgctctctctggaaaagcttttgatgctcaagatttgttgatgagatgtacactggactccatctttaaagttgggtttggtgtggagttaaaatgtttggatgggtttagcaaagaagggcaagagtttatggaagcttttgatgaaggtaacgttgcaactagttccagattcatcgatcctctttggaagctgaaatggtttttcaacattggatcacaatctaagctcaagaagagcattgctactatagataaatttgtctatagtctcattaccactaaaaggaaagagcttgctaaggaacagaacactgttgttagagaggacatactatcgagattcctagtggagagtgagaaagatccggagaacatgaatgataagtacctgagggatataattctgaacttcatgattgctggtaaggacacaaccgctgcactactctcttggttcttgtacatgctctgcaaaaacccacttgttcaggagaaaatcgtacaagaaatcagagatgtgacatttagtcacgagaaaacgaccgatgtaaatggtttcgttgaaagtattaacgaagaggctcttgatgagatgcactacctccatgcagccttgtctgagaccttgaggctctaccctcctgtgcctgtggacatgaggtgtgcagaaaatgatgacgttcttccagatggacatagagtgagcaaaggggataatatctactacatagcctatgcaatgggtaggatgacttacatttggggtcaagatgctgaagaattcaagccagagagatggctcaaggacggcttattccaacccgaatcaccattcaaattcataagctttcatgctggtccaagaatctgtcttggcaaggatttcgcataccggcagatgaagatagtatcaatggcacttcttcacttctttcgcttcaaaatggctgatgagaacagcaaggtgtattacaagagaatgcttactcttcatgtcgatggaggactccatctctgtgcaatcccgaggacaagcacttgagtacttaaccagaatactttccatacttttatagtgcctccatgagttttgatttaaat

SEQ ID NO: 136 - DNA, 165 bp, Arabidopsis thaliana
atggtgaacaacgttgtctctatcgaaaagatgaaagcactctggcactccgaggttcatgatgaacaaaaatgggcggtgaacatgaaacttctgcgagcacttggtatgtttgcaggaggagtcgtcctcatgcgtagctatggggatctcatgggagtttga

SEQ ID NO: 137 - DNA, 1249 bp, Arabidopsis thaliana
ttaattaagactgtctggattgctgatagatttatatgattcagagaagaactcaccgatgagtatggatttttcacctttgttaacggttcttgagggagatttcaacaaggataatacttcttctgcaacagaaattgatactttagagaacttagatgacactaggcagataagtaaaggaaaacctccgaggcacctcacaagcagtgctactaggctgcagcttgcagccaatgcggatgtggatgtttgtaacttggttatgaagtcacttgatgacaaatcagagtttctacctgtataccgatcaggaagttgtgctgagcaaggggcaaaacagttcatggaagatgaacacatttgcatcgatgatcttgttaatcatcttggtgcagctattcaatgctcttctcttggagccttctatggggtatttgatggccacggtggcacagatgcagcacactttgttagaaagaacattctgagattcattgtagaggactcctccttcccactatgcgtaaagaaagcaattaagagtgctttcttaaaagctgattatgaatttgcagatgattcttctcttgacatctcttctgggaccactgcgcttacagcttttatttttggacggaggttgataattgcaaatgctggtgattgccgagcagtactggggagaagaggtagggcaattgagttgtccaaagatcacaaaccaaactgcacagccgagaaagtaagaatagaaaagttaggtggagttgtgtatgacggttacctcaacgggcaactatcagttgcacgtgccattggagactggcacatgaaaggtcccaaaggctctgcttgtccgctaagcccagagccagagttgcaagagacagacctgagtgaagacgacgagttcttgataatgggatgtgatggtctgtgggatgtgatgagcagccagtgcgctgtgacaatagctaggaaggaactgatgattcataatgatccagagagatgctctagagagcttgtgagggaggcccttaaacggaatacatgtgacaatttgacagtgattgttgtgtgcttctctccggatcctccacagaggatagagatccgaatgcagtcacgggtgaggcggagcatatctgcggaagggttaaacctactcaaaggcgtgctcgatggctatccgtgagcatgttatgttgtacgttactttgtgagactattgccaaggcgcgcc

SEQ ID NO: 138 - DNA, 531 bp, Arabidopsis thaliana
tttatttgtcagctttcaaactctttgtttcttgtttgttgattaacccttaattaagaaatgaaagagagtggacttagacttagccttaattaagaaatgaaagagagtggacttagacttagagagataacagataaaatggcgacggggacggcgacggagaaaccgaagatcgtgtggaacgaaggaagacatagattcgagactgatgatcacgaagccttcatagagtacaagatgaagaatgacggtaaagtcatggatctggttcgaaccttcgtaccgccgtcaaaagcaggacttggtttagcttcgcatctatgcgtcgccgctttcgaacacgcctctgaacactctttctccatcatccccacttgctcctacgtttccgtatacatctcttctttcctcaaaaaattgagatgaatcagattcttatgaaaatatgtcgtgttttgcaggggcgcgccaaaaattggagctctgcagagctttcgttcgtatcatcggtttcgacaacgttcgtca

SEQ ID NO: 139 - DNA, 1678 bp, Arabidopsis thaliana
ttgtttgttgattaacccttaattaaatgacagacatttccagtctctttagaaaccgaagtcgcaaggaccaacttgactatggtttaactgtgatagttatatcaactctttgttggtgtctttggctctacgccaaatgcaaacggcggtctccaccgttgccgccgggaccttggggccttcccattatcggaaaccttccattcctccaaccggagcttcacacctacttccaagggctggctaaaaagcacggtcccattttcaaactctggctcggggccaagctcacaatcgtggtcacctcttctgaagtagcgcaagagattctcaaaacgaatgacatcatcttcgcgaaccacgatgtccctgctgtgggccctgttaacacgtatggtggtacggagatcatttggtcgccgtatggaccaaagtggcggatgctgaggaagctatgtgttaataggatactgagaaacgccatgttggattcctccactgacctccgtcgccgagagactcggcaaaccgtccggtatttggcggaccaggctcgggtcggttcaccagttaacctgggagaacaaatattcttgatgatgttgaatgttgtgacgcagatgctatggggaacaacggttaaggaagaagagagggaggttgttggagccgagttcttagaggtgattagagagatgaacgacctcctgctagtgcccaatatctccgactttttcccggtattgagccggtttgatcttcagggtttggctaagcgtatgcgaagaccggctcaaagaatggatcagatgttcgaccggatcattaaccaacggttggggatggatagggacagtagtgacgggagagctgtggattttctagacgtcttgttgaaagtcaaggatgaagaagctgaaaagacgaagttgaccatgaacgatgtcaaggccgtactcatggtaagttaaaaataattgtccctcgtaacgcaaatagatttgttatatatggctgtttttgtatttttctaggacatggtgctcggtggtacagacacatcactgcacgtaatagaattcgcgatggccgagctattacacaaccccgatatcatgaagagagctcaacaagaggttgacaaagttgtgggaaaagaaaaagttgtggaagaatctcacatctctaaacttccatacattctcgccattatgaaagaaactctaaggcttcacacggttgctccactccttgttcctcggcgcccgtcacaaaccaccgtggtgggcggcttcaccatccctaaagattcaaagattttcatcaacgcgtgggcaatccataggaacccgaatgtatgggagaatccactgaagtttgatcccgacaggtttctggatatgtcttatgacttcaaaggaaatgacttcaattatctaccgtttgggtctggtcgtaggatatgcgtgggaatggctatgggcgagagggttgttctttacaatctcgctacgtttttgcattcttttgattggaaaattccgcaaggagagagagtggaggtcgaggagaagtttgggatcgtgttggagctaaagaatccacttgttgccacgcccgttctaaggttgtccgatccaaatctttatctctaggggcgcgccaaaaattggag

SEQ ID NO: 140 - DNA, 876 bp, Saccharomyces cerevisiae
aactctttgtttcttgtttgttgattaacccttaattaagatgggttccagaagatacgattccaggacaacaattttctcccctgagggacgtctatatcaggttgaatacgcgctagaatccatttcacatgcaggtaccgcaattgggattatggcatctgatgggattgttcttgcagcagaacgcaaagtcacaagtactttactagaacaagacacctctaccgaaaaactttataagttaaacgataaaattgcggttgccgttgctggactgactgcagatgcagaaattctaataaatacggctagaattcacgctcaaaattaccttaaaacctataatgaagatataccagtagaaattttggtgagaaggctaagtgatataaaacaaggttacacgcaacatggtggtttaagaccatttggtgtgtcctttatctacgccggttatgacgatagatacggttaccaattgtatacatctaatccatcgggaaactatacagggtggaaggctattagtgttggcgctaacacatcagcagcacaaaccctacttcaaatggactacaaggatgatatgaaagtcgatgatgccattgaactggctttaaaaacgttatccaaaactaccgacagtagcgcgctgacttatgacaggttggaatttgctactatcagaaagggtgctaatgacggagaagtgtatcagaagattttcaagcctcaagagataaaggatatattggtaaagactggtattaccaagaaggatgaagacgaagaagctgatgaagatatgaaataaatttaaatacccagcaaattggagctctgcagagctttcgttcgtatcatcggtttcga

SEQ ID NO: 141 - DNA, 2145 bp, Arabidopsis thaliana
ttcatttatttgtcagctttcaaactctttgtttcttgtttgttgattaacccttaattaagcggaaataaatggaaggtcagggttgttgtggcggcggcggcggaaagacggagatgataccgacggaggaagctctgagaatagtattcggcgtctctaagcgtctgcctccggtaatcgtatcgctgtatgaagcacttgggaaagtgttggcggaagatattcgagctcctgatcctttacctccatatcctgcttccgtcaaggatgggtacgcagttgttgcttcagatggtcctggagaatatccggtgattactgaatcaagagctgggaatgatggtttgggtgtgactgttactcctggaactgtggcttatgtgacaactggtggacctatacctgatggtgcggacgcagttgtccaagttgaggacactaaagtaattggagacgtctcaactgaatcaaaaagagtaaaaatactgattcaaaccaagaaaggcaccgatatccgtagagtgggttgtgatattgagaaagatgcaactgtactaacaactggagaaagaattggtgcctcagaaatcggcttgctagcaaccgcaggagtaaccatggtgaaggtatatcctatgccaatagttgctattctctctactggagatgaacttgtggagccgacagctgggactttaggtcgtgggcagattagggactcaaatcgagcaatgttagtggcagcagtgatgcagcagcaatgcaaagttgttgaccttggaattgttagagatgatagaaaagaacttgagaaggttttggacgaggccgtatcctctggagttgatattattttaacttctggtggtgtttcaatgggagacagggatttcgtcaagccattactcgaagagaaagggaaagtatatttcagcaaggtattgatgaaacccgggaaacctttgaccttcgccgagattagagcaaaaccaactgaaagtatgctggggaaaacagtccttgcatttggattacctggaaatcctgtgagctgtttggtttgtttcaatatctttgttgtgcctacaatccgccagcttgcaggatggacaagcccccatccactgagagtgcgacttcgacttcaggagcccatcaagtctgatcccatccgccccgagtttcatcgggccataatcaaatggaaagacaacgatggatcagggactcccggatttgttgctgagagcactggacatcagatgagcagtaggcttttaagtatgaggtcggctaatgctttgttggagttgcctgctacgggaaatgtgctttctgctggaagttctgtatcagctataattgtttctgatattagtgccttttcaatagacaagaaagcctcattatcagaaccaggctctattcggaaagaaaagaagtacgatgaagtacctgggcctgagtataaagtggctattcttaccgtcagtgatactgtctcagctggggctggacctgatcgaagtgggcccagagctgtgtcagtagttgattcctcgtctgaaaaactggggggagctaaggtagttgcaacagctgttgtccccgatgaagtggaaagaataaaagacattcttcagaaatggagcgatgttgacgaaatggatctcattcttacacttggtggtactggcttcactccaagagatgtaacacctgaagcaacgaaaaaggtgatcgagagagaaacacccggtctcctctttgttatgatgcaagagagcttaaagatcactccatttgcgatgctctcgcgctctgcggcaggaattagaggctcaacattgataatcaacatgcctggaaacccaaacgcagtggccgagtgtatggaggctctgttacctgcattgaaacacgcactgaagcagatcaaaggagacaagagagagaaacatccgaagcacatacctcacgcagaagccaccctaccgactgatacatgggaccaaagctataagtcagcctatgagacgggagagaagaaagaagaggctggatgttcttgtactcactaaaactctccatttaaatacccagcaaatacccagcaaattggagctctgcagagctttcgtt

SEQ ID NO: 142 - DNA, 736 bp, Saccharomyces cerevisiae
atttatttgtcagctttcaaactctttgtttcttgtttgttgattaacccttaattaatccgggcgcgcctgatttatcacaagtttgtacaaaaaagcaggctcctgcaggaccatgggccgtgatatatgcacattagacaatgtttacgctaacaatttgggcatgctaaccaaactagctcatgtgacagtaccaaacttatatcaagatgccttcttcagtgcattattcgctgaggatagcttagttgcaaaaaataaaaagccatcttcgaagaaggatgtacatttcacacagatggcttattacagtgaaataccagtgggtggtttggttgctaaattagttcctaaaaaacaaaacgaactatctctcaagggcattcaaatcgaatttttgggcgtgttgcctaattataggcacaaatccatcggttcaaaattactgaagtttgcagaagacaaatgctcagaatgtcatcaacataacgtgtttgtctatttaccagcagtggatgatcttacaaagcaatggtttatagctcatggcttcgaacaagtgggcgaaactgtcaacaatttcataaaaggtgtaaatggcgacgaacaagatgctatcttattgaaaaaacacatttcttaactcgagacccagctttcttgtacaaagtggtgataaattggagctctgcagagctttcgttcgtatcatcggtttcgacaacgttcgtca

SEQ ID NO: 143 - DNA, 1435 bp, Agrobacterium tumefaciens str. C58
aactctttgtttcttgtttgttgattaacccttaattaatccgggcgcgcctgatttatcacaagtttgtacaaaaaagcaggctcctgcaggaccatgactgccattaccgatatcatcgcgcgcgaaattctcgacagccgcggcaatccgaccgttgaagtcgatgtttacctcgaagacggctccatgggccgtgcggccgttccgtccggcgcctccactggcgcgcatgaggcggttgagctgcgcgatggcggcaagcgttatctcggcaagggcgtggaaaaggcggtcgaagccgtcaataccgaaatcttcgacgccatcggcggtttcgacgctgaaaaccagatccagatcgatcagatgatgatcgcgcttgacggcacgccgaacaagtcgcgcctcggcgccaacgccatcctcggcgtctcgcttgccatcgccaaggctgcggctgaagcctccggcctgccgctttaccgttatgttggcggtccgaacgcccatctgcttccggttccgatgatgaacatcatcaacggcggcgcgcatgccgataaccccatcgacttccaggaattcatgatcctgccggttggcgcggaaaacatccgcgaagccgtgcgtatgggttcggaagtgttccacacgctgaaaaaagaactgtccgcacagggccacaacaccaatgtcggtgatgagggcggttttgcaccgggcctcgagagcgcgccggcagccctcgatttcatcatgaagtcgatcgaaaaggctggctaccgtccgggcgaagacatgtatgtcggcctcgactgcgcatcgaccgagttctttaaggacggtaagtacgttctggaaggtgaaggccgcacgctggagcccggcgccatggccgaatatctggccgagcttgtcaataaatacccgatcatctcggttgaagacggcatggccgaagatgactgggaaggctggaagacgctgactgatctcgtcggcaacaaatgccagctcgtcggcgacgatctcttcgtcaccaactccgcgcgtcttcgcgacggcatcaagatgggcgtcgccaactccattctcgtcaaggttaaccagatcggttcgctttccgagacgctggatgcagtcgaaacggcacacaaggccggttacaccgccgtcatgtcgcaccgctctggcgagacggaagattctaccatcgccgatctcgctgtcgccaccaactgcggtcagatcaagaccggttcgcttgcccgttctgaccggctcgcaaagtacaaccagctgatccgcattgaggaaatgctgggtccgcaggctgcctacgccggccgttcgatcctgcgcgggtaactcgagaccccagctttcttgtacaaagtggtgataaattggagctctgcagagctttcgttcg

SEQ ID NO: 144 - DNA, 1165 bp, Glycine max
ttaattaactagagttaagagaggagatgggagaaatagaaagagaggagatgtcgtcgacaaggtgggagaaggaggaggaagaagaagaagaagaggcccaaatggatatctggaagtacatatttgggtttgtggaactggcagtgataaaatgtgcgattgagcttggcatagctgaagccatagagaagcatggaagtcccatgacactatcggagatatcatcaagtttagggtgtgatacttcacatctgaagcgcatcatgaggttcctggtgcaaagaaagatattcaaaggcgacgggtgcagcaggggctattctcaatcagctctgtctcgtcgattgatgagaaacggcgaacacagcatggctagttttctcttgctggagagtagtcctgtaatgctggcaccttggcacagtctgagtgctcgcgtcatggccaatggcaacccctcatttgcaaaggctcacggtgaagacgtgtggcgctatgctgccgcaaatctcgatcacagcaacctcatcaacgaagcaatggcatgtgatgctaagcttgttatgcctatcatcattcaaagttgcagcgaggcatttcatggcctcaagtccttggtggatgtcggtgggggcaacggcaccgccatgcgcatcctggctaaggcttgcccttccattcgacccatcaattttgatcttcctcatgtcattgccctctgcgatggcgatggcgatggcgtccaacacgtgtcaggcgacatgtttctaagtgttcctaaagctgatgctgcttttcttatgtgggttttgcacgattggtcagacgaagagtgcatccaaatcttaaagaagtgtagggaagccatatcaaattcaaaggaaaacggaagggttattattgtggaggcggtgattgaaggagaaggagaaggagaaggagggaagcatgacggattgaaggatgtgggattgatgctggacatggtaatgatggcgcacactaacttcggcaaagagcgcacactcaaagagtgggaatatgtcatcaaaatggcaggatttagctcatacactgtcaaacccattcatgctgtgcagtccgtcattatggctttctactaaaatatatccaccaaaaattacccttgcaagatttaaat

SEQ ID NO: 145 - DNA, 1174 bp, Glycine max
ttaattaatccctgtttccctcaaagttctcttctttttcgtgattcagaagtgctcagtgatacccttttcttagaacaatgagagcggggaaagggagtcaggaagaggatgagtacgaggaagaagagtttggttcttccaagaaacagggcacttcctctgcccctaacaccaataaagatggaaaagccatcgataaggctagtgcgataagatcgaaacattctgtgactgagcagcggagaaggagcaagataaatgagagattccagatattgagggatctcatacctcatagtgatcaaaagagggacacggcatcatttttattagaggtgatagagtatgttcagtacttacaggagaaggtacaaaagtatgaaggttcatatcaaggttggggtcaagaaccctcgaagttgatgccatggagaaatagtcattggcgtgtccagagctttgccggtcaacccacggctgtaaagaatggtttgggtccagtatcaccttttcctggaaagtttgatgaaagcaatgttagtatctctccaactatgcttaatggctcccagaatacaatagatcctgatcagagcagggatattgtcaacaaaacggctgagaggcaacctgatttagtaagcaagggaatacctcttccccttgctatgcatgcaaacatgtctgttcctgtcagaagtgatggcgtacttgcacatcctcttcagggaactgtttctaatgcacaatcaactgaatgcccaacaactagtgaaccacagaatcaacaggatgaactctcggttgaaggagggacaattagcatctcaagtgcatactcccaagggttgttgaataatctaactcaagcgctacaaagtgctggtttagatctgtctcaggctagtatatcagttcagattaatcttgggaaacgggcaaacaaaggactgaattgtgggacctcttctctcaagcatcatgacaacccttcttcaaacaatcaaacaattgcacattttagagatgcaggcagtggagaagactctgatcaagcacaaaaaagaatgaaaacatataagtgatatatatgtggcattttcatgagaatccacttgcatccagatttctcacttattcttggtgcagcatataacttgtggatttaaat

SEQ ID NO: 146 - DNA, 1130 bp, Glycine max
ttaattaatctctcttcaatggccggaatccgcttgcagccggaggactctgacgtctcccaacaatcccgcgcggtggctctctccgccaccgatctggtctccgacgacgaccgctccgtcgccgccgactcttggtccatcaagagcgagtacggaagcactctggacgacgaccagcgccatgctgacgccgccgaagctctctccaacgccaacctccgacctccctccgattacagttctgacaaggatgaacctgattctgaagcagtcacatccatgctgggatttcagagttattgggattctgcatatgctgacgagctcacaaattttcgtgaacatggtcatactggtgaagtctggtttggagttgatgtgatggaagtagtagcatcttggacaaaagccttgtgtgttgaaatttctcaaggtcacataccaaatggtgtcgatgaggttaaggctgaagctgacaaactaggtgataaagttttgtctacttggagtgtactagatattgggactggcaatggtttactgctccaagaattagctaaacaagggttctctgatttaactgggactgattatagtgaaagggccatcagccttgcccaaagccttgctaatcgtgatggattttccaacgtcaaatttttggttgatgatgtcctcgagacaaagttggaacaagagtttcgacttgtcatggataaagggacactagatgctattggattgcatcctgatggtcctgtcaagagaatgatgtattgggattctgtttcgaggttggttgcatctggtggaatacttgtgatcacatcatgtaacaatacaaaggatgaattggtacaagaagtggagagtttcaaccaacgaaaaattgctactgcacaggaacttggggcagtgaaggacgaggaaccgtgcagagagcccccatttcagtatgtaaatcatgtccgcacatatccgacattcatgtttggtggatctgtaggctcccgtgttgcaaccgtggcattccttcgaaaatgaaaatgttgtcatttgttatgattaaggtctctggtcggatggatttgaagttgttcctaactgttgtgtcaaacaatttaaat

SEQ ID NO: 147 - DNA, 1255 bp, Arabidopsis thaliana
ttaattaacactctaaatcccatcttctctaccaccggagatacaccgccgttacatggccgcgacatcaaactcaggcgaagatccgactctctcttaccatcaccgatctccttttcgcttcgaattacttcaatctatctcttcctctgatcctcgttactcttctctaactccttcttcaacgaatcgacctttctcagtctctcaatcgcttccgaattcacaactgtctcctctaatttcacctcactgggacgattcttactctcaaatcactcagaaagttcagaagagtagaaagaatcatcgaattcagcttggatctattgccaacatgtctggaggagaaagcatagatatagctaaagtaatagtgaaacaagagtcgtctcctcaaaatgttaaacgtgtatacaacaagtcaaagggtggtactaaactgttaaaggctgggaaacgaatggcgaatggcgaagtgcaaaatggtggcttaaatggagctagtattaactgccgttatgacagttctttagggttgttgacaaaaaaattcgtgaagttgatccaggaagctgaggatggaacacttgaccttaactattgtgcagttgttttggaggtacaaaaaagaaggatatatgatattacaaatgtccttgaaggaattggattgatagagaaaactacaaagaatcatatccgctggaagggtgctgacaatcttggacaaaaggacctgggagatcaaatttctaggcttaagtcagaagtagagagtatgcaatctgaggaaagcaggttggatgatcttataagggaacgacaagaagctctcagatccttggaggaagatgactactgtagaaggtacatgtttatgacggaggaagatataacgagtctcccacggtttcagaaccagacattactagcaattaaagctcctacagctagttacatcgaagttccagatcctgatgagatgagttttccgcaacagtaccggatggtgattaggagtagaatggggccgattgatgtctatcttttaagcaaatacaaaggagacagtgcggaaacaagcgacaagttgggtaatgagtctgatcaaaaagctccagttggagtagacactccttccttgaaaatagtaacttcagatactgatttaaaagcagattactggttcgagtcagatgcagaggtgagcctcacagatttatggagcaacttcaacagctgagggcgcgcc

SEQ ID NO: 148 - DNA, 582 bp, Arabidopsis thaliana
atgaggttccggtacgcaatggtttgttcgtcgaatcagaaccggagcatggaagctcacgctcttcttaagagacaaggactcgacgttgcttcgtacgggactgggtcacatgtaaaactacctggaccatctctgagagagccaaacgtttacgactttggaactccttacaagcagatgttcgatgagctcaggcgcaaagatcctgaactatacaagcggaatggtattttgcagatgattaagaggaatttatccgtgaaacttgctcctcaaagatggcaagataatgctggtgatggtgtgtttgatgtggttatgacttttgaagaaaaggttttcgattcagtccttgaagatctcaacaacagagaacaatcacttacgaaaacaatacttgtgatgaacttggaggttaaagataaccacgaagaagcagctataggtggccgacttgccttggaactctgtcaagagattgaagggaatgaaacatgggaagatacgatcgatgacattgttgcgggttttgaaaaacaacacaggcggaaactggtctacagcatctcattctactga

SEQ ID NO: 149 - DNA, 1380 bp, Arabidopsis thaliana
atgaatgtgagagacgagggaaaaactacggcggagaaacacggcggaggagaggagaataaatcaccggagaacaaatggcgatttaattctcctctagctcaagtgagcttaatgggattcgtttgtttctgttgtccaggaatgttcaacgctctctccggcatgggaggcggtggtcaagtagatccaaccgctgctaacaacgctaacaccgccgtttacaccgctttcaccgttttcggccttttaggcggcgggttttacaacgtcctcggtccacggctcacgttagccgctggatgttcgacttacgtactctacgccggatctttcctctactacaaccatcaccaccaccaagccttcgcgatagtcgccggagctttactcggttgcggcgcgggacttctctgggccggagaaggagctgtgatgacgtcataccctccgccgcatcggaaaggcacttacatagcgttgttctggagtatcttcaatctcggcggcgttatcggtggattaatcccgtttatcctcaactaccaacgtagctccgccgcatcggtcaacgactcgacgtacatagcgttcatgtgtttcatgttcgccggcgttcttctctctttcggtatcctcccggcgacctccgtgatccgtaacgacggatctagatgctctgccgtgaaatactcccgtccgtcaactgaagcagccgccgtgctacggctattcctcgatcggaaaatgctcctcatcgtccccgcggcttgggctagcaatttcttctacagctatcaattcaacaatgtgaatggactcctctttaacttaagaaccagaggattcaacaatgtcttctactggggagctcaaatggctggatccatcgccattggttacgtgatggacttcagcttcaaaagccggcgagctagaggattcaccggaatatcactagtcgcggtaatcggaaccattatatgggcgggcgggttagcgaatcagcacggttactcgttggacaaactaccggaaaagaaacttgattttaaagattccgggatagagtttgcgggaccattcgtgttatatatgagctatggattgttagatgcaatgtatcagagtatggtttattggttgataggagcattggctgatgattcgcagactttgagtagatatagtggattctacaaaggagtgcagagtgcaggagctgcagtggcttggcaagtggatactcgtaaggttccgttaatgtcacagcttattgttaattggtcacttactactgtaagttatcctttacttgttcttcttgtgtatttttatgttaaaaatgataatgatgatgatagtaatgataaggtttag

SEQ ID NO: 150 - DNA, 494 bp, Arabidopsis thaliana
tcttgtttgttgattaacccttaattaagatgtctgctactccggaagaagacaagaagcctgaccaaggagctcacatcaatctcaaagtcaagggacaggatggtaatgaagtcttctttaggatcaagagaagcactcagctcaaaaaactgatgaatgcttactgtgaccgtcagtctgtggatttcaactcaattgctttcttgtttgatggtcgtcgtcttcgtgccgagcagactccagatgagcttgaaatggaagatggagatgagatcgatgcaatgcttcatcagactggtggtggtgctaaaaatggcctgaagctcttctgcttttagatttaaatacccagcaaattggagctctgcagagctttcgttcgtatcatcggtttcgacaacgttcgtcaagttcaatgcatcagtttcattgcgcacacaccagaatcctactgagtttgagtattatggcattgggaaaactgtttttct

SEQ ID NO: 151 - DNA, 553 bp, Arabidopsis thaliana
atgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaa

SEQ ID NO: 152 - DNA, 551 bp, Arabidopsis thaliana
tatttgtcagctttcaaactctttgtttcttgtttgttgattaacccttaattaaatgaccgcggcagcagttccagcaactggatctttccagaaacaagacgaggagtggcgtgcggttctgtctcctgagcagtttagggttctcagactaaaaggcacagataaacgaggcaaaggagagtttacaaagaagttcgaggaagggacttatagttgtgctggttgtggaactgctctttataaatcgaccactaagttcgactccggttgcggttggcctgcgttcttcgacgccatccccggtgctattaaacaaaccccagaagcaggtggaagaagaatggagataacatgtgcagtgtgtgatggacatttaggccatgttttcaaaggcgaaggttactctactccaaccgatcaacgtcactgcgttaacagtgtctctctcaaattctcttctgctggttcctcccaataaatttaaatacccagcaaattggagctctgcagagctttcgttcgtatcatcggtttcgacaacgttcgtc

SEQ ID NO: 153 - DNA, 1974 bp, Arabidopsis thaliana
ttcacaaacttcaaatattattcatttatttgtcagctttcaaactctttgtttcttgtttgttgattaacccttaattaaatctggatttggatttggatctcatttcgattcaacgatgaaggtggttgataagatcaaatccgtgacggagcaaggccaaacagctttctccttcgagtttttcccaccgaagacagaagatggcgtcgagaatctctttgaacgaatggatcgattggtctcttatggacctaccttctgcgatatcacttggggtgctggtggatccacagctgatctcactctcgagattgcttctaggatgcagaatgttatctgcgtcgagactatgatgcatctcacttgtaccaacatgccgattgagaagattgatcacgcgcttgagacgattagatctaatggaattcagaatgtgcttgctcttagaggagatcctcctcatggacaagataagtttgttcaggttgaaggaggatttgcttgtgctttggatctggtgaatcacattcgtagcaagtatggtgattactttggaatcactgttgctggttatcctgaggctcatccggatgttattgaagctgatggacttgctactcctgaatcttatcagagtgatcttgcttacttgaagaaaaaggttgatgctggagcagatttgattgtgactcagcttttctatgatactgatatattcctcaagtttgtgaatgattgtcggcaaatcgggattaattgtcccattgttcctggaattatgcctatttccaactacaaggggttcttgcgtatggctggtttctgtaagaccaagatacccgctgagctcactgctgccttagagcctattaaggataatgacgaggctgttaaagcctatggaattcactttgcaacagaaatgtgcaaaaagattttggcccatggaatcacttcccttcatctctacacattgaacgtggacaaatcagctattgggatattaatgaaccttggtctgattgatgagtcaaaaatttctcgttctctaccttggagacgccctgcaaatgttttccgtactaaggaagatgttcgcccaattttctgggcaaaccgtccaaagagctacatatctagaacaaagggctggaatgacttcccacatggacgttggggtgattcacacagtgcagcatacagtacactttcggattatcagtttgcgcgcccaaaaggacgtgacaagaagcttcagcaagaatgggtcgtcccactgaaaagcattgaagatgttcaagagaaattcaaagagctctgcattggaaacttaaaaagcagcccatggtctgaattagatggactccagccagagacaaagatcataaatgagcaactcggaaaaatcaactccaacggtttcctgaccattaatagccaaccatcagtcaatgcagccaaatccgattctccagctattggatggggtggtcctggtggttacgtctaccagaaagcttatctggagttcttctgttcaaaggataagttagacacacttgtggagaaatccaaagcttttccttctatcacctacatggccgtgaacaaatcagagaattgggtatcaaacaccggtgagtccgatgtgaatgcagttacttggggagtgttcccagctaaggaggttattcaaccgacgatcgtggatccagccagtttcaaagtctggaaagacgaagcgtttgagatttggtcaagaagctgggctaacttgtacccagaagatgacccttctagaaagttgctcgaggaggtgaagaacagctactatttggtaagcttagtggacaacaattacatcaatggtgatatcttctctgtctttgcttgatctccgagaaaaccaccggcgaagaggaacattcgatttcgagatttatttaaatacccagcaaattggagctcggc

SEQ ID NO: 154 - DNA, 649 bp, Arabidopsis thaliana
ttaattaaatggcatctgctcactccatagccgccgtttctgttctcgatgcggcctccaagcaagcaacacttccttcttcttcttcttcttcctctgcgctctaccctctttcttctcttcgatctaaacctcgccagcagcttctctccctacgcagtgtcgctctcaaaggtcgagtaaaggcgcaggcaaaagaagcagaagctagtccaagtccagtgggagtgggagacgcattcagtaatgtgaagcatcttctcctgccggtgattgatcggaatccttatctttctgaaggcaccagacaggctgctgctacaacaaccagcttggcaaagaagtatggagctgatatcacagttgtagtcattgacgaagaaaagagagaatcatcttcggagcatgagactcaagtatccaacatccggtggcatttgtctgaaggtgggttcgaggagttcaagctgttggagaggcttggggaagggaaaaaagcgacggccataataggagaggtggcagatgagctgaagatggagctggtggtgatgagcatggaagccatccactctaagtacattgacgccaatctactcgctgagttcatcccctgccccgtcctcctcttgcccttgtgaggcgcgcc

SEQ ID NO: 155 - DNA, 582 bp, Saccharomyces cerevisiae
tttcttgtttgttgattaacccttaattaagatgaaagttaaaataaacgaagtgcacagtgtgtttgcttggtcatggcacatccctagcacatctgatgaggacgcagcaaataacgatccaaatggcaatgatgaagacgaggatgtctgtggtatctgtcgtgccagttataacggtacctgtccaagctgtaaatttccaggcgatcaatgccctttagtgattgggctatgccatcataacttccatgatcattgtatataccgttggctcgatacaccaacctcaaaaggactgtgtccgatgtgtaggcaaactttccagctacagaagggtctagcaattaatgacgctcatgtccaaaagttcgttgaaatagtttcaagaagaagagaagaaatgatagaggagggcgtcgcggaagagtttgtggactttgatgaaccaataaggcaaaacaccgataacccaatcggtagacagcaagttgataccatcctggacgaagactttttgttacgataaatttaaatacccagcaaattggagctctgcagagctttcgttcgtatcatcgg

SEQ ID NO: 156 - DNA, 1288 bp, Arabidopsis thaliana
aactctttgtttcttgtttgttgattaacccttaattaaatggcgactgagaatctcaccgataagaatgttgttttcagaaagctgaaatcaaaatccgagaacaaggtttgctttgattgtagtgcgaagaatccaacatgggcttctgttccttatgggatcttcctatgcatcgattgttctgctgttcatcgaagtctaggtgttcatatcagcttcgtcaggtcaacgaacttagactcgtggagtcctgagcagctaagaacaatgatgtttggagggaacaatcgagctcaggtgttttttaagcaacatggatggaatgatggtggtaagattgaggctaagtatacttcaagagctgctgatatgtatagacagactcttgctaaagaagttgctaaagccatggctgaagaaactgttttaccgtcgttatcctctgttgctacttctcagccagtggaatcatctgaaaatgggtttacttctgaatctccgaaagagagttctttgaagcaagaagcagctgttgtctcttcaccaaaagcttctcagaaagttgttgctagtacgtttaagaaacctcttgtttcgcgaaagtctgggaagactggtggtcttggtgctcgtaagcttactactaagtcaaaggataacctctatgagcagaagcctgaagaacctgtacctgtgattcctgctgcttctccaaccaatgacacatcagcagctggatcatcatttgcctctcgatttgagtactttgatgatgagcaatctggtgggcaaagtggcacacgggtgcttagccatgttgctccaccaaagtcatcaaatttctttaatgaatttggaatggacagtgctttccccaagaagtcaagctcaagctcatccaaagctcaggttgaagaaacagatgaagcaagaaagaagttttcaaacgccaaatcgatttcctctgcccaatttttcggaaatcagaacagagatgccgatcttgactcaaaagctacccttcagaagttctcgggttcagcagctatttcaagttctgatctttttggccacggaccagatgattccaacatcgatatcactgcaagcgatctcatcaaccgaatttctttccaggcgcagcaagatatgtcatctattgctaacttagctgaggaaacaaagaataagctgggaacatttgcctctagtatattcagtgatcttcaggatagaatgctgtaagggcgccaaaaattggagctctgcagagctttcgttcgta

SEQ ID NO: 157 - DNA, 687 bp, Arabidopsis thaliana
tcagctttcaaactctttgtttcttgtttgttgattaacccttaattaaatggttacatctccgacgaactcaacaatcaaatttctctgtagctatggcggcaaaatcctacctcgttatcccgacggtaaactccgttacaacggtggtcacactcgcgtcctcgccgttcctcgctccgtctcattttccgagttagcgtcgaagatggcggagatgtgcggcggcgtcggcggatctataaccgtaacgatccgatgtcagcttccgacggaagatctcgacgcgctcgtttcaattacttccgatgaagatctagtgaatctaatcgaagagtacgatctcgtttcctcttcatctccgatgaaaatcagagtcttcttaaatccaccaaaatccgccgccggatctaaaaaatctcctcctccgttagcgttaccgtcatcaaccaccacgtcatcatcttccacaacttcctctacttcatcaagtcctagatctccgtctctatcaaaaccaccgctacctccgtctccaccgagaataacgacggttacgaagaatccgtgttatggttgttatgttcaccgtaattccagaaatatctaccttgttcacaacggcaatcactggcaataaggcgcgccaaaaattggagctctgcagagctttcgttcgtatcatcg

SEQ ID NO: 158 - DNA, 2896 bp, Xenorhabdus nematophilus
tcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaacagcccaaattagataaagccgtctttcaagccgcgcttacacgccagtggcagcgctttggccttagttcagcacaggaaatgaccccacatcagtggtggcaggccatcagtgctgcactattagaattacttccctcttccagccagaaccatgcccatcagtttcataaccctaagcgtcatgtgaactatatttcgatggaatttctgataggccgtctgacagccaacaatttgctgaatcttggctggtatgacgatgttcaggcttatctggcagaagatggactgactttgagtgacttactggaacaagaagctgatcctgcattgggcaatggtggtctgggtcggctggcagcctgttttcttgactcaatggcgacgattgatcaacccgcaacaggctatggccttaattatcagtatggcttgttccggcaatcctttgatcaagggctacaaattgaggcacctgatgactggaagcgcggttcctatccgtggtttcgccataatgcccaattgaaagttgacgtaggtcttggcgggaaaatcgtgatgacagccgaaggtcatgaaacttggcttcctgcctttaccttgattggcgaagcttgggatctgcctgtcattggctatggtaatggcgtcacacagcccctacgcctgtggcaagcaacgcacgataatccttttgatctgtcacttttcaatgacgggcaatttctgaatgctgaacaacagggcatcgaagccaccagcctgaccaaagtgctttacccgaacgataaccatcaggccggaaaacgcctgcgcctgatgcagcaatatttccagtgtgcctgtgcgatggcagatattctgcgtcgtcatcagcaggctggccgcaaggtggaagaattaccacgctacgaagtcatccagcttaacgatacccacccgactatcgccatccctgaaatgatgcgtctcctgctggatgagtaccaattggattgggaaacagcatgggaaattacagggcagactttcgcctatactaaccatactttgctgccagaaggtttagaacgctgggatgagcatctagtcagtgaactgctgccacgtcatcaccgcattattcaggaaatcaaccgtcgcttccagaaaaccgtagagcaaacctggcctggcaatcaacaggtgtgggaaaaattagccgttattcacgaaaatcaggtaagaatggctaacctctgcgtagtcgcctgttttgctgtcaacggtgtagcagcattgcattcatccctaatcgtgacggatctgtttccagagtactatcacttgtggccggaaaagttccataacgtaaccaatggcgtcacaccgcgtcgctggttaaagcagtgcaatccagcactctcctcactgattgaccaaaccttgaatcatgaatgggttaatgatcttgagagcctgaaacaactcgaaccttatgccaacgatgcagctttctgcgaagcttatcgcagcatcaaacaggaaaataaaattcggttgtccaactacgtcaataaagtcatggggcttaagattgatccccacgccatttttgacgtacagataaaacgtctgcatgagtacaagcgccaacatttgaacctgctgcacatcctctctctgtatcgacagattcaggagaatccgtcactggatatccacccccgcgtcttcctgtttggcgccaaagcagctccgggctactatctggcaaaaaatattatcttagccattaaccatgcggctgaaaagattaatcatgatccgatcgtccgtgatcgtatcaaaattgcctttattcccgattacaacgtttccaccgcagaattgatgatcccggcggctgatgtctcagaacaaatttctactgcaggtaaagaagcctccggtacaggcaacatgaaactggccttaaacggtgcattgaccattggcacgctggatggcgccaatgttgaaatcgccgaacaagtcggcaatgacaatatttttatcttcgggaacaatgttgaagaagcaaaagccttactgaaaagtggctacaatccacgggagatcctccagcagaatcctcatctacaaggcatactggatgcacttgccagtggcgaattcagccacggagacacgcaggcattcgatctcatgctgcatagtttggttgatggtggtgatccttatttagtactggcagattttgactcctactgccatgcccatacgcagattgataccctgtaccgtaaccctcaacactggacacaccgtactattctcaacactgcccgcatgggtaaattcagttctgaccgagctattcaagattaccaacagcgtatctggcaggccaaataaggttcatcatggaaaataaacacctcgacaatttggcaacagaggctggcatagccgccgaatatattaatgcctacgggaaaccgcaggctatccctgatttaaatacccagcaaatacccagcaaattggagctctgcagagctttcgttcgtatcatcggtttcgaca

SEQ ID NO: 159 - DNA, 1866 bp, Bacillus halodurans
tctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaaaaaaatctcaacaaacgatagcaaattaaatccaaggttagtggcgtttttaaacggtggaccaaagaagctatttattaatggggaatgggttgattcattctctggacaatcttttgaaacgatgaatccagcaaccggagaaacattagctctcgtagcagaagctgggtcagaggacatcgattttgcagtgaaagcggcaaggaaagcgttcgatgaagggccttggtctaaaatgagcgcagcggaaagaagtcgactcatatacaagctggctgatttgattgaggatcataaagaagcgttagctcagcttgagacgttagataatggtaagccaattcgtgagacggccaatgctgatattccattagtaattgaacactttcgttactttgcagggtgggcgacaaaaattgtgggccaaaccatccctgtacaaggccattattttaactacacgcgccatgaagccattggcgttgtgggccaaatcattccttggaatttcccgttattgatggctgcttggaaacttggtgccgctctagctacaggttgtacggttgtgttaaaaccggcagagcagactccactttccgccttatatttaggagaattgatcaatgaagcaggttttccaaaaggggttgtgaacattgtccctggatttgggcattcggctggaactccccttgtgaatcacccagctgtagataaagtggcttttacagggtcgactgatgtcggaaagttaattatgaaacaagcgagtgaatcattaaaaagagtaacgcttgaacttgggggcaagtcaccaaatatcattttacctgatgctgatttgtcaaaggccgttcctggctcacttatgggcattatgttcaatcaaggccaagtgtgttgcgcaggaagtcgtttatatgtacaaaagaaacagtatgatcatgtcgttgctgacctggtgtcgttaacgaacgagattcagcaaggggatggattattagaacaaacgaccatgggacctctgatttcaaatcaacaacaaagtcgagtgaaaaattacatcgatcgtggggttgaggaaggggcagaactactaacaggtgggaacattccgtatgatcaagggtattttgtcgccccaaccatttttgctgacgtggatcattccatgacgatcgccaaggaggaaatttttggtccagttgtagccgcaatgccgtttgatagcatagacgacctaattgataaagccaacgattctgattatggactagctgccggtgtttggacacaggatattaaaaaagcacactacattgcccaccgaatcaaggcagggaccatttgggtgaattgctacaatgtattcgatgccgcgagcccgtttggtggttacaaacaatcggggattggccgggaaatggggagctatgcattagaaaattatactgaagtgaaaagtgtttgggtgaatatggattaactcgagacccagctttcaaatacccagcaaattggagctctgcagagctttcgttcgtatcatcgg

SEQ ID NO: 160 - DNA, 1830 bp, Rhodobacter sphaeroides
ttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggataccaagaccaccgagatcaagggcaaggaacgctacaaggccggcgtcctgaaatatgcccagatgggttactgggacggcgattacgtccccaaggacaccgacgtgctggcgctgttccgcatcacaccgcaggagggggtggatccggtcgaggcggccgccgccgtggccggcgaaagctcgactgcgacctggaccgtggtctggaccgaccggctgaccgcctgcgacagctaccgcgccaaggcctaccgggtggagccggtgccgggcacgccggggcagtatttctgctatgtggcctatgacctgatcctgttcgaggaaggctcgatcgccaacctcaccgcctcgatcatcggcaacgtcttcagcttcaagccgctgaaggccgcccggctcgaggacatgcgcttccccgtggcctatgtgaagacctacaagggcccgcccaccggcatcgtgggcgagcgcgagcggctggacaagttcggcaagccccttctcggcgccaccacgaagcccaagctcggcctgtcgggcaagaactacggccgcgtggtctatgaggggctgaagggcggcctcgacttcatgaaggacgacgagaacatcaactcgcagcccttcatgcactggcgcgaccggttcctctatgtgatggaggcggtgaacctcgcctcggcccagaccggcgaggtgaagggccactacctcaacatcaccgccggcacgatggaggagatgtaccggcgggcggaattcgccaagtcgcttggctcggtcatcgtgatggtcgatctcatcatcggctatacggcgatccagtcgatctcggaatggtgccggcagaacgacatgatcctgcacatgcaccgcgcgggccacggcacctacacgcggcagaagaaccacggcatcagcttccgcgtgatcgccaagtggctgcggctggcgggggtggaccatctgcattgcggcacggccgtgggcaagctcgagggcgacccgctgacggtgcagggctattacaatgtctgccgcgagcccttcaacacggtcgacctgccgcgcgggatcttcttcgagcaggactgggcggacctgaggaaggtcatgccggtggcctcgggcgggatccatgccgggcagatgcaccagcttctgagcctcttcggcgacgatgtggtgctgcagttcggcggcggcaccatcggccacccgatggggatccaggccggggcgaccgcgaaccgcgtggcgctggaagcgatggtgctggcgcgcaacgagggccgcaacatcgatgtggagggcccggagatcctccgcgccgcggccaaatggtgcaagccgctggaggccgccctcgatacctggggcaacatcaccttcaactacacctccaccgacacgtcggacttcgtgccgaccgcctcggtcgcgatgtaaggagaccggacatgcgcatcacccaaggctgcttctcgttcctatttaaa

SEQ ID NO: 161 - DNA, 649 bp, Arabidopsis thaliana
ttaattaaatgacattgagcagagttcatcaacaagttattgcatttcctgctgtcaatactgctccggtgggttacttgcctgatccagcttccatcaacaagcttcaaatcccaacttcttcaaaggtttcgatgcttcaaaagaagaaaaccgatagcttcacaaacggagcaagagatcaggacaagttaggacccaagctaaccgaaacagtaaagagaaagctatccttgggagctaagatccttcaaatgggaggcttagagaagatctataagcgactcttcaaggtctgcgataaagagaaactcttcaaggcgtaccaatgttacctatcgacaacagaaggttccattgcgggcctgctcttcatctcatcaaagaagattgccttctgtagcgaaagatcgatcaaggtgacttctcctcaaggagatctcactagggttcactacaaagtctcaatccccttgtgcaagatcaatggagtgaaccagagtcagaacacgaagaaaccatctcagaggtacctagaagtagtcacagtcgataactatgacttctggttcatgggattcgtgagctaccagaaagctttcaactgtctcgagaaagcgctaaacgaggatgagcaataaggcgcgcc

SEQ ID NO: 162 - DNA, 502 bp, Arabidopsis thaliana
ttaattaaagccaaatgggttcggaagaagagaaggtcgttgttcccagaaactttagattattggaagagctagaaagaggtgagaaaggaattggagatgggacagtgagttatggaatggatgatgctgatgatattttgatgcaatcttggactggtaccattcttggtcctcataatactgcgtatgaagggaaaatctttcagctgaagctattctgtggaaaggattatccggaaagtccacctactgtgaggtttcagagtcgtataaacatggcttgtgtcaatcctgagaatggagtggttgatccgagtcacttccctatgctttccaactggagaagagaattcacaatggaggatctactgattcagcttaaaaaagaaatgatgtcatcgcagaaccgcaagttagctcaacccttggaaggtaatgaggaaggcaggacagacccaaagggactagtggtgaaatgttgcgtgatgtgaggcgcgcc

SEQ ID NO: 163 - DNA, 1532 bp, Arabidopsis thaliana
tttaattaaatggtgagtcttctatcttttttcttgcttctactcgtccccattttcttcttgttaatcttcaccaagaagatcaaggagtcaaaacaaaatcttcctcctggcccagcaaagcttccgatcatcggaaacctacaccagctccaagggttgcttcataaatgtcttcacgatctctccaagaaacacggacctgtgatgcatctccgtctagggtttgccccaatggtcgtaatttcatcaagtgaagcagctgaagaagctcttaaaacacatgaccttgagtgttgttcaagacctatcactatggcctcaagggttttttcgcgtaacggtaaagacatcggatttggggtttacggtgatgaatggagagagctgcgtaagctttcggttcgcgaattctttagcgtgaaaaaagttcaatccttcaagtatattagagaggaagagaatgacttgatgatcaagaaactgaaagaattggcttcgaagcaatctccggtggatttgagcaaaatcctctttggtctcactgcgagtatcatattcagaaccgcctttggacaaagtttctttgataacaagcatgtcgatcaggaaagcatcaaagaactgatgtttgaatctctgagcaatatgacttttagattctctgattttttccctactgctggtcttaaatggtttataggctttgtgtcaggccaacataagaggctttacaacgtcttcaacagggttgatactttttttaatcatatagttgatgatcatcactcgaagaaagcaactcaagatcgtcctgatatggtcgacgctatcttagatatgatagataatgaacaacaatatgcatctttcaagctcaccgttgatcatctcaaaggagtcctctcaaatatatatcacgctggaattgacacaagcgccatcaccttgatttgggcgatggcagagctcgttagaaacccgcgggtaatgaagaaagctcaagacgagatccgaacttgcattggaatcaaacaggaaggaagaatcatggaagaagatcttgataagcttcaatacttgaagcttgtggtgaaagaaaccttaagactacacccagcagctcctcttttacttcctcgagaaacaatggctgatatcaagattcaaggctacgacattcctcagaaaagagctcttcttgttaatgcatggtctataggacgagatccggaatcctggaaaaatcctgaagagtttaacccggagaggtttattgattgtcctgtggattacaagggacatagctttgagttgttaccatttggttctggtcggagaatttgtccaggaatagctatggcgatcgcaaccattgaattggggctcttgaatttgctctacttctttgattggaatatgcctgagaagaagaaagatatggacatggaagaagctggtgatctcactgttgataagaaagttcctcttgagcttctgccagttattcgcatcagtttgtagatttaaat

SEQ ID NO: 164 - DNA, 651 bp, Arabidopsis thaliana
ttcaaactctttgtttcttgtttgttgattaacccttaattaaagggataaacatggcaggagaaggtgaagaagatgtacctagagatgctaagattgtgaaatctctgcttaagtcgatgggtgtagaagactacgagcctcgtgtgatacatcagtttctggagttatggtaccggtatgtggtcgaagtgttgacagatgctcaggtttactcagagcatgctagcaaacccaacattgactgtgatgatgtgaagctcgctattcaatccaaagttaatttcagcttctcacagcctcctccaagagaggttctgcttgagcttgctgcaagtaggaacaagatacctctgccaaaatcgatagcaggacccggtgttccactcccacctgaacaggacacattgctgagcccaaattatcagctcgtgataccgaagaagtcggtttcaacagaacctgaagaaaccgaggacgatgaagaaatgacagatcctggacagtcctctcaagaacaacaacagcagcaacaacaaacctcagaccttccaagccaaactcctcaaagggtctctttcccactctctagacgacccaaataaggcgcgccaaaaattggagctctgcagagctttcgttcgtatcatc

SEQ ID NO: 165 - DNA, 1486 bp, Glycine max
ttaattaacagtggagtgcaacagctactatctaatctaatggggtccgagcaaaatcgatttcctctgcacgaaaggcgaaagagatggggaggatgttggggtgcattttcttgttttaattcacagaaaggtgggaagcgcattgtacctgcatctcgcattcctgacagtagtgggccagcctctcagccaaatggacctcaagtgattgggttgaccaatcaagccacaggactagctccttctctcttagccccaccttcttcaccagcatccttcacacattctgcccttccttccactgcacaatcacctagttgtttcttatccttatctgctaactcacctggtggtccttcatctacaatgtatgccacaggaccatatgctcatgaaatgcagctggtgtctcctccagtcttttcaaatttcactactgaaccatctactgcacctctcactcctccacctgagttggctcatttaacgactccctcttccccagatgtaccttttgctcattttctctcatcttcagtggatctcaaaaacagtgacaagggtaactacatcactgcaaatgatcttcaagctacatattcactctaccctggaagtcctgccagtagccttatatctccaatatcaaggaactcgggtgactgtttatcatcttcttttcctgaacgagagttccgtccacagtgggattcatcactatctcccgagaatggaaagtatcagagaactgggtctgggagggtgtcagggcatgacacaaatggtgtcactatggcatcacaagatacaaatttcttttgccctgctacctatgcacaattctatttggaccaaaatcctccatttcctcataatggtgggagattaagtgtttcaaaagattcagatgttcaatctaatggcggaaatggacatcagagtaggcatgctagaagtcctaagcaagatgtggaagaaatagaagcttaccgagcatcctttggtttcagcgcagatgagattatatctaccagtcaatatgtggaaatttctgatgtaatggaggactcatttaccatgatgccatttgcttctgacaagtcaacaatggaagaaagcatagagccttcattaatgaaaggattcaaagctcaggagacgcaggtggcattgcagagtctgagaagtcttagatcagatccaggtccagtaggcaaggaagcacacaatcaggcccctatatgtccaggatgtgaagatcatacatcacaagggcattgtagcaacaactctggattaagtacaccagagaaacgtactctcgtagatgatgaggatatattctcaaaaatggaatcttccagaatctgcaggaaatatcagatggggttatcatgctctgatgctgaggttgactataggagaggaagaagcttacgagaaggaaagggaatgtgatttatgacactaagaattaatcagt

SEQ ID NO: 166 - DNA, 1641 bp, Pseudomonas fluorescens PfO-1
ctttgtttcttgtttgttgattaacccttaattaatccgggcgcgcctgatttatcacaagtttgtacaaaaaagcaggctcctgcaggaccatggataaaacttcaaaatttctgccggaagagctctggagtaactgtgttttcgacggtacttggataaatatttctcctgacgtcagtcaggtcatagagcccgcaacgggggcgtcgttgggttgcatcggcatggctaacgcggcctcggtttcagcggccgctcgcgtggctaatgaagtacaagcggattggttcctcaccgcttatgaagaacgtgctgcaatcatgcgtaaagcggcggaaatcgcagagctgcattttggcgatatcgtcgagtggttggttagagaaagcggttcgacccagttaaaagcggcgtttgaaacccgtgtaacgataaaagcgttgcaggaaagcgccatgatgcctgggaaaagccagggtgacgttctgcccaatgctccgggatccggtcgcctcagcctggccaggcgtcgtccattaggggttgtagggatcatctcacctttcaattttccgctttacctcgctatgcgctcggtcgcgcctgctttggccgtcggtaacagtgtcgtgctgaaacccgatccccgaaccgccgttagcggcgggctggtcattgggcgcttgtttgagcttgctgggctgccgaaaggcgttctccacgtcttgccgggtgggggcgatgcgggcgcagcgctggttgagtcgccagatgtggcgatgatccaatttaccggatcgaccgccgcaggtcgcaaagtcggcgaagcggctggccgcaatctaaagaaggtgtcactggaattaggcggtaagaattcgttgatcattttggacgatgcgaatcttgacctggcagtcgccaacgccatctgggggacgtttttgcaccaagggcaaatttgcatggctactgggcgtattctcgttcagcgcagcctgtacccagcctttctcaaagcactgactgccaaagtgggcaagctctcggtgggtgatcccgccacgacaaaggtctcgctcgggccgcttatcaatgcacaccagcgcgatcaagttgccaagattgtccgcgaggctcagcaggccggtgcaaaactcgaagtgggtgggcgttacgaagagcttttcttccagccgacggtgctcagcgatgtcaaaccggacaatcccgcgttccgtgaagagatttttggacctgtcgccgttgtcgtgccctttaactctgacgaggaagcaatacgactcgctaacgacacggaatacggcttggctgccggcatcatcagttcgaacattggccgtgcgatgaaggtcggtgacaagcttcggactggaatgcttcatatcaatgaccagacagtcaatgacgaagtggtgaacccattcggtggctggggcgcatctggaaatggcacgagcgtgggaggggcggcgaactgggaagagttcactcaatggcaatggttgaccatcaaggatgaggccacgccttatgccctgtaactcgagacccagctttcttgtacaaagtggtgataaattggagctctgcagagctttcgttcgtatcatcggt

SEQ ID NO: 167 - DNA, 911 bp, Glycine max
ttaattaaaaacatgtcagcggtggttgctggttcctcctcttcattctctgccaccttcacccccataaggagcccctccttaaaaaactctcaactctctcattccaaggcactcacttcacctcaatgccagaaaacatctttacaagggctctcacttcatgaagccaaaaggggtgtttcagaatccttcctagttgagaacaacaatggttcctccattgctggaaggagacttgagatcacagcacgaactgctggggcttcaaagacaattgaggtggaggttgacaagccacttggcctcaccttaggccaaaagtctggtggtggtgttgtcatcactgctgttgatggtggtgggaatgcagcaagagcagggttaaaggcaggggaccaagtcctttacactagcagtttctttggggatgaattgtggcctgcggataagcttggatttactaaaaccgccatccaagcaaagccggactctgtctactttgttgtcagcaggggtgctgaagtagacgttaaaaagctcacaaagcgacctgctcctcctcgatttggaagaaaactgaccgagactcaaaaggcgagagctactcacatttgccttgattgtggatacatatacaccttacagaaaccttttgatgagcagccggacacatacgggtgtcctcaatgtcaagcaccaaagaagaggtttgctcgttatgatgttaacactggaaaagctattggtgggggcttgcctccaattggagttattattggactcctggctggtgtaggggcagttggagctttgcttgtttatggtctttagtaacattttattaattccacgacatgttaattttgtttattttctgtcctccaaagttgtccaatattgatttaaat

SEQ ID NO: 168 - DNA, 1641 bp, Xenorhabdus nematophilus
gctttcaaactctttgtttcttgtttgttgattaacccttaattaatccgggcgcgcctgatttatcacaagtttgtacaaaaaagcaggctcctgcaggaccatgaccacaattaatcattggatcaacggtaaaaacgttggcagcagtacctattttgaaacagtcaatcccgcaaccggtgaggtattggcagaagtcgcttctggcggaaaagaagaaattgatcaggcggtggctgccgcaaaagacgcttttcctaaatgggcaaataccccaatgaaagaacgcgctcgcctgatgcggcgtttaggagaattaatcgaccagaatgtacctgaaattgcggcaatggaaaccagcgatacgggcttgccaattcatcagacaaaaaatgtccttatcccacgcgcttcccacaatttcgatttctttgcggaaacttgtcagcagatgaacggacgcacttatcccgtcgatgacaagatgctgaattatacccttatccagcctgtaggcgtctgcgcactaatttccccgtggaatgtgccgttcatgactgccacatggaaagttgccccctgtctggctctgggaaacaccgcagtcctgaaaatgtccgagctttcaccactgaccgctaaccgtctgggagaactggctctggaagccggtatccccgcaggagtactgaatgtggtacagggatatggcaatactgcgggtgatgcactggtaaaacatcatgatgtccgtgccgtttcttttaccggcgggacagctaccggtcgcctgattatgcagaactcagggctgaaaaaatactccatggaactgggcggcaaatcgccggtactgatttttgaagatgccgatattgaacgtgcgttagatgctgccctgttcaccattttttccctcaatggcgaacgctgtacagcaggctcccgtattttcattcaggaaagcatttatcctgaatttgtgaagcgttttgcagaacgtgccagccgcctgcgcgtcggtgatccacaggatctgaatactcaggtcggcagcctgatcagccaccagcactgggagaaagtttccggttatatccaactgggtattgaagaaggcgcaacgctgttaaccggagggccggataaaccggcagacctgcctgatcacctgaaaaatggtcacttcctgcgaccaaccgtcctcgccgatgtagataaccggatgcgtgtggcacaggaagaaattttcggcccggtcgcctgtctgctgccattcaagagtgaagaagacggtcttcgtatggctaacgatgtggaatatggtctggcatcttatatctggactcaggatgtgagcaaagtcctgcgtctggcacagggaattgaagccggcatggtcttcgtcaattcccagaacgtacgcgatctgcgccagccatttggtggtgtaaaagcctccggtgtaggacgggaaggcggagaatatagctttgaagtttttgctgaagtgaaaaatgtttgtatttcaatgggaaatcatcccattcctcgctggggactttgactcgagacccagctttcttgtacaaagtggtgataaattggagctctgcagagctttcgttcgtatcatcg

SEQ ID NO: 169 - DNA, 2196 bp, Saccharomyces cerevisiae
tatttgtcagctttcaaactctttgtttcttgtttgttgattaacccttaattaagatgaatggaaaagaggtttcaagtggctctggaagaacgcagagcaacaacaacaaaaaaaataacaacggaggcagtacaggaatctcgcatgcgtctggctcacctttaacggacggcaacggtggcaatagcaacggtaatagtagaagtagaagcagaagtagaaaatctagtggaactacaggtggtttgctaaaaaagccgccgctgcttgtgaacaatgaagcggtgcatgctagcgtacccgacgcgtcgcacacttcctgtaacaatggcacgcttgaagtgagcataaataaccctgagccacatgtggtagatgccgtggcacgccacttgataagaaacccgagtaacagcctacaattgcaaggcggagacattacaagagatctgtataagtggacaaacgaccatccttcatcaccatcgcagtatcagtacccaagtcaacctgcactttccacctcaataccttcacaagcgccctcattctcgaatcgtaaaaggtctatgagcttttctgccgcttctatagcatcttcctctcaccttaacaacaactcggaggcgaatgggaatcctctagcggcaataggcctggcgcccgcaccgatgacgcacgaagaaatcagggctcctggtggattcagaagatcttttataatacagaagcgcaggaaacataacgttgatgcgcccataccgaattttttcaccaggaactttattgaatttttgaccttgtatggccacttcgctggtgaagatttatcggaagaagaggaggaggaggaagaaactgaagaggagccagaggaggaagctttggaaacggaaagcacccagctagtttctcgtgaacacgggcgccatcctcacaaatcatctacggtaaaggcggtgctgctcttgttaaagtcatttgttgggacaggtgtgcttttcctaccaaaggctttccataacggtggttggggatttagcgccctttgtctactctcgtgtgccctcatttcttatggatgtttcgtatcattgattaccaccaaggacaaagtaggcgtagatgggtacggtgacatgggtcgtatactatatgggcccaaaatgaaatttgccattctttcgtctatcgccttgtcacaaatcgggttttctgctgcatacactgttttcactgcaactaatttgcaggtcttttctgaaaatttcttccatttgaaaccgggcagcatcagtctagccacctatatctttgcacaagtactcatctttgtcccactatctttgacaagaaacatagccaagttaagtgggaccgcgttaatagcagatctatttattctactgggattggtttatgtttacgtttactccatttattatattgctgttaatggtgtcgcatccgatacaatgcttatgttcaataaagcggactggtcgttgttcatcggtaccgccatattcacctttgaaggtataggcctacttatccccattcaggagtcaatgaaacacccgaagcatttccggccatcgttgtccgcggtgatgtgtatcgtggcagtgattttcatatcatgtggtctcttatgctatgccgcttttggatctgacgtgaaaactgttgttttattgaattttccgcaggacacttcctatactctcactgttcaattactgtatgcattagccattttgttatccacgccgttgcagctatttcccgcgatacgtattttggaaaactggacttttccctcaaatgcatctggtaaatacaacccgaaagtcaaatggttgaaaaactatttccgttgcgctattgtcgtcctgacatctatcctcgcttgggtaggcgccaacgatttggacaaatttgtatcactggtaggctccttcgcgtgtatcccattgatctacatatacccgccattgttgcactataaggcgtccatcttatctggaacctcgagagccaggcttcttttagatttaatcgtcatagtatttggagttgctgtcatggcctacacgtcatggcagacgattaaaatgtggagccagtaaatttaaatacccagcaaattggagctctgcagagctttcgttcgtatcatcggtttcgaca

SEQ ID NO: 170 - DNA, 1479 bp, Arabidopsis thaliana
atggatccttacaagtatcgtccttcaagcgcgtacaacgccccattctacaccacaaacggtggtgctccagtctccaacaacatctcttccctcaccatcggagaaagaggtccggttcttcttgaggattatcatttgatcgagaaggttgctaatttcaccagagagaggatccctgagagagtggttcatgctagaggaatcagtgctaagggtttctttgaagtcacccatgacatttcaaacctcacttgtgctgattttctcagagcccctggtgttcaaactccggttattgtccgtttctccaccgttgtccacgaacgtgccagtcctgaaaccatgagggatattcgtggttttgctgtcaagttttacaccagagagggaaactttgatcttgttgggaacaacactccggtgttcttcatccgtgatgggattcagttcccggatgttgtccacgcgttgaaacctaacccgaaaacaaacatccaagagtactggaggattctggactacatgtcccacttgcctgagagtttgctcacatggtgctggatgtttgatgatgttggtattccacaagattacaggcacatggagggtttcggtgtccacacctacactcttattgccaaatctggaaaagttctctttgtgaagttccactggaaaccaacttgtgggatcaagaatctgactgatgaagaggccaaggttgttggaggagccaatcacagccacgccactaaggatctccacgatgccattgcatctggcaactaccccgagtggaaacttttcatccagaccatggatcctgcagatgaggataagtttgactttgacccacttgatgtgaccaagatctggcctgaggatattttgcctctgcaaccggttggtcgcttggttctgaacaggaccattgacaatttcttcaatgaaactgagcagcttgcgttcaacccgggtcttgtggttcctggaatctactactcagacgacaagctgctccagtgtaggatctttgcttatggtgacactcagagacatcgccttggaccgaattatttgcagcttccagtcaatgctcccaaatgtgctcaccacaacaatcaccatgaaggttttatgaacttcatgcacagagatgaggagatcaattactacccctcaaagtttgatcctgtccgctgcgctgagaaagttcccacccctacaaactcctacactggaattcgaacaaagtgcgtcatcaagaaagagaacaacttcaaacaggctggagacaggtacagatcatgggcaccagacaggcaagacaggtttgttaagagatgggtggagattctatcggagccacgtctcacccacgagatccgcggcatctggatctcttactggtctcaggctgatcgatccttgggacagaaacttgcaagccgtctgaacgtgaggccaagcatctag

SEQ ID NO: 171 - DNA, 1180 bp, Arabidopsis thaliana
aaactttaacattttatatctaaaaccatttcatcttatgaatatcaacaacaatggcagaacaagaaactacgtcaaacataaacaccattaatgatcaagcagaagaagaaacaagaacaaaatctcagccattgatttcaggtctaccaaatgatatagctgagctttgtcttcttcgtcttccttacccataccatgctctatatcgctctgtttcatcttcatggaacaaaaccatcacaaaccctagattcctcttctccaagcaatctctttctatctcttctccttacctatttgtcttcgctttcaacaaatcaacggctaggattcaatggcaatcccttgaccttgcatctggccgttggtttgttttacctcccatgccaaactctttcaccaaaatctcgtctcctcacgcactctcatgcgcgtcgatgccacgtcaggggaagctttttgtactcggcggcggagatgtaaaccgctccgccgtcgtttacactgctctaacgaatcgttggtcgtgtatatctccgatgatgagcccgagaacgtacttcgtctccgggaatgttaacggtaaaatcatggccgttggtgggagtgtgggcggaaacggagaagcaactacggaagttgaatcgtatgatccagataatgacacgtggacggttgtgaagaagttgccgatggtgttggcgaagtatgactcagccgtgatcgggaaagagatgtgtgtaacagaaggatgggcgtggccgttcatgtttccaccgatgggacaagtgtacgactccgacgaaggcacgtggcgagagatgagcggtgggatgaaagaagggtggacgggtgtgagcgtcgtgatccgcgacaggctgtttgtgatctcggagcacggtgattttccgatgaaggtttattgttcagatgatgacacgtggaggtacgtgagtggtgagaagctacagggggagaagatgcggcgtcctttcgccgtgacgggagctgatgatcgtgtgtttgtggtggccagtgggattaacgtagcggaagggagagtgagtgaagggcaaaatggggattttagtgttgagtggaggatggtttcgtctcctaaaagttctattcagttttcacctgctagttgtcatgtgctatatgtttgatgtgtaat

SEQ ID NO: 172 - DNA, 1566 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggaccatgtttgattatgttattagcagaagacaacgtacgaagcaggtgctaagatatcttgaacagcaaagaagtgtcaaaaacgtttctaataaggttttaaatgaagaatgggctttgtatttgcaaagagaacacgaagtactgagaaaaaggaggttgaaacctaagcacaaggattttcagatactgacacaagttggacagggtggttatgggcaagtttatcttgcaaaaaaaaaagacagtgatgaaatttgtgctttgaaaatattaaacaagaaacttttattcaaactaaacgagacgaatcacgtccttactgagagggacatactaaccacaactagatctgactggcttgtgaagttgctttatgcatttcaggatccagagagcctatatttagcaatggaatttgtacctggtggtgattttcgcacattgttaataaatacaaggatattgaagagcggtcacgcaaggttctatatcagcgaaatgttttgtgccgtgaacgcgttgcatgaacttggttacactcaccgggatttaaagccggagaatttcttgattgatgctacagggcatatcaagctgaccgattttggtctagcagcagggaccgtatcaaatgaaagaatcgaaagcatgaaaatacgcttagaagaagtaaagaatttggaatttcctgctttcacagaaaggtctatcgaggatagaaggaaaatatatcataacatgaggaagacagaaattaattacgctaactctatggtcggttcgcctgattatatggccctagaagttctggaaggtaaaaaatacgattttacagtggattattggtcattaggctgtatgctttttgaaagtttggttggatatacaccttttagtggttcttctactaatgaaacttacgagaatttaagatattggaaaaaaactttaagaaggccccgtactgaggatagaagagcagcattctcagatagaacctgggatttaattacaagactaatagctgaccccatcaacagagtacgatcttttgagcaagttcgcaaaatgtcttatttcgcagagatcaattttgaaaccctaagaacaagttctccaccatttattcctcaattagatgatgaaacggatgcaggttatttcgatgacttcacaaatgaagaagatatggctaaatatgcagatgtcttcaaaagacagaacaaattatctgcaatggtcgatgactctgccgttgattccaagcttgttggatttacttttaggcatagagatggaaaacaaggttcaagcgggatactttacaatggttcagaacattcagaccctttttcaactttttattaactcgagacccagctttcttgtacaaagtggtgataaattggagctctgcagagctttcgttcgtatcatcggtttcgacaacgt

SEQ ID NO: 173 - DNA, 1529 bp, Agrobacterium tumefaciens str. C58
aaaaaagcaggctcctgcaggaccatgaaaggcatcgcaagcgctgcgttgaaaaacctgcatcgacgcgatttgatcgaagaccgtgcgtttgtgaatggggcatgggtggagcgcgatcagatgttcgccatcgttgatcccgcgggaggcgatcacctcgccgacgtggcgtcctgcacgctcaatgatgtcgattttgcgatagacgcagccagcaaggctttcgccggctggcgcgatatgctgcctgttgatcgcggcgacattttgcgcaactggagtgcgcgcatgcgggagaatgcgcatgacctcgccacgatcatcagcgccgaacagggcaaaccgctggcggaatcacgcggcgaaatcgcctacgccgccaatttcctcgactggttcgcgagtgagggggagcgatcttacggcgaaacaattccaacccatctgaagggcagcaatctttccgtgcggatgcagccgatcggcgttaccgtcgccatcacgccatggaactttccctcagcgatgatagcgcgcaaggccggtgctgcacttgctgccggctgtacgatgatcgtcaaacctgctcccgaaacacctctgtcagcgctggcgctggcaagacttgccgaagagtccggcgtaccacctggcgtattgcaagttctgccgggagaagccgcaccccttgcgcgccgccttctggaaaataccgaggtgcgggcattttcctttacgggttcgaccgaggtgggacgaattcttctgacgcaatctgcggcgacggtgaaaaaagcatccttggagcttggagggcacgcacccttcatcgtcttcgcagatgcagatctcacagaggccgtcaaaggctgtctgggcgcaaaattcgccacttccgggcaggactgtcttgcggcaaaccgcatctatgtgcagcgcagcctttatccgcgatttgttgagcggtttgccgaggcgacgtccaggctgactgttggtcatggcctcgaaaccggtgtcgatatcggccccatgacgcggccgtccgtcgccgaaaagtgccgccagcaggttgcccaggcgctgtcggcgggtgcacggctcgtctgcggcggacaggacagtccgctcggcggcaacttcgtcacccccaccgtgcttgccgatgttaccgacgacatgctgatcgcccgcgaagaaaccttcggcccggtggccgccatcttgccgttcgatgacgaggcggaggtgatccgccgcgccaatgcaacagagatgggactggcggcctatctctacaccaacgatctcggccgggcgatgcgcctgaccgaccagctcgaatacggcatggttgccgtcaacacgccgaaattcaccggagcgcccattccattcggcggctggaaacaatcaggccttggccgcgagggctcgcgtcatggcctcatggaatatctcgaacccaaatatgtctgcttcggcaatctggctgcctgactcgagacccagctttcttgtacaaa

SEQ ID NO: 174 - DNA, 492 bp, Arabidopsis thaliana
ttaattaaatctcaagctttaactctccctgaaaatgatgataaacgcaaagaagctcatgaagttggccaagaaatggcaacaaagagcagccctcaagagaaaaagaatttcatttcagagatcaagtattactactagcagccaaacagctgtagaaaagggttgtttcgtggtttacacggctgataagatccgtttttcatttcccttaagttacctaagcaacactattgtccaagagctcttgaaaatatctgaagaagagttcggtctcccgacggaaggaccaatcacattgccattcgattcggcctttttagagtatctcatcaatctgatccaaagacgaatggatgaagatacagaaaaggctctgttattgtcaatctcaagtgctagaagctcttttcaaccacaacaacattgtagtgctactcaacagttgcttgtgttttagagtttcgcaaatttctgtattttgggcgcgcc

SEQ ID NO: 175 - DNA, 1846 bp, Saccharomyces cerevisiae
tttatttgtcagctttcaaactctttgtttcttgtttgttgattaacccttaattaagatgccaataagatcaatcagctcagcttcacaaatgaacgtgttcggtaaaaaagaagaaaagcaagaaaaagtttactctctacaaaacggttttccgtactctcatcacccatacgcttctcaatactcaagaccagacggccctatcttactgcaagacttccatctgctggaaaatattgcaagtttcgatagagaaagagttccggagcgtgtagtccatgccaaaggtggtggttgtagactggagttcgaactaacagattctttgagtgatattacatacgccgctccataccagaatgtgggttacaaatgtcctggtcttgttcgtttttccaccgttggtggtgaaagtggtacaccagacactgcaagagacccaagaggtgtttcttttaaattctataccgagtgggggaaccatgactgggtcttcaacaatactcccgtcttcttcctcagagacgctattaagtttcccgtatttattcattcgcaaaagagagaccctcagtctcatctgaatcagtttcaggacactaccatatactgggattatctaacattgaatccggaatcaatccatcaaataacttacatgtttggtgatagaggtactcctgcttcgtgggctagtatgaacgcgtactctggtcattccttcatcatggtcaacaaagaaggtaaggacacatatgtgcaattccacgtcttgtcggatactggttttgaaaccttgactggagataaggctgctgaactgtcaggctcccaccctgattataatcaggcaaagctgttcactcaattgcaaaatggcgaaaagccaaaatttaactgttatgtgcaaacaatgacacccgaacaagcaactaagttcaggtattcggtaaatgacctaacgaaaatatggccacacaaggaattccctttgagaaaatttggtaccatcaccctaacggagaatgttgacaattatttccaagaaattgaacaagttgcattcagtccaacgaacacttgtatcccaggtattaagccttctaatgattccgttctacaagccagacttttctcctatccagacactcaacgtcatagattgggagccaactatcagcaattgcccgtcaacagaccaagaaacttgggatgtccatactccaaaggtgattcccaatacactgccgaacagtgtccatttaaagcagtgaacttccaaagggacggcccaatgagttactacaatttcggtcctgagccaaattatatttccagtttaccaaatcaaactctgaaattcaaaaatgaagacaacgacgaagtatctgataagttcaaagggatagttcttgacgaagtaacagaagtttctgtgagaaaacaggaacaagaccaaatcagaaacgagcatattgttgatgccaaaattaatcaatattactacgtttatggtattagtccactagacttcgaacagccaagagctctatatgaaaaggtatacaacgatgaacagaagaaattattcgttcataacgttgtttgccacgcttgtaagatcaaagatcctaaagtcaaaaagagagttacgcaatactttggtttgctaaacgaagatttgggtaaagtcattgcagaatgcttgggagttccttgggaacctgttgaccttgaaggttatgccaagacttggtatattgcaagtgccaattaaatttaaatacccagcaaattggagctctgcagagctttcgttcgtatcatcggtttcgacaacgtt

SEQ ID NO: 176 - DNA, 1530 bp, Arabidopsis thaliana
tgtcagctttcaaactctttgtttcttgtttgttgattaacccttaattaagatggccgccaccactgagaatctccctcaactcaaatccgccgtcgatggccttactgagatgagtgagagtgagaagagcggattcatcagcctggtttcacgttacctgagcggtgaggcacaacacattgagtggagtaagatccagactcctaccgatgaaatcgttgttccctacgagaaaatgacccctgtctcccaagatgttgccgagaccaagaatctgttggacaaacttgttgtgttgaagcttaatggaggtcttggaacaacaatgggatgcactggcccgaagtccgttatcgaagttcgtgatggtttgacatttcttgatctgattgttatccagattgagaatctcaacaacaagtatggctgcaaggttccgttagttctcatgaactcgtttaatacacatgatgacacacataagattgtggaaaagtacaccaactcaaatgttgacattcacacttttaaccagagcaaatatccccgtgttgtggcagatgagtttgtgccatggcccagcaagggaaagaccgacaaggagggctggtatcctcccggtcatggtgatgtattcccagccctcatgaacagtggaaagctcgatactttcttatcacagggtaaggaatatgtgtttgttgccaattcagacaacttgggtgccatcgttgacttaacaatcctgaagcatttgatccagaacaagaacgaatactgcatggaggttacacccaaaaccttagctgatgtaaaggggggaactctcatttcttatgaaggcaaagtccagcttctggagattgctcaggttcctgatgaacatgtcaatgagttcaaatcaattgagaagttcaagatattcaacacaaacaacctatgggttaacttgaaggccatcaaaaagcttgtggaagctgatgcacttaaaatggagatcattccaaacccaaaggaagttgatggagtcaaagttcttcaactggaaactgcagccggtgctgcgataaggttctttgacaacgctatcggtgttaatgtacctcgctcacggttcttgccagtgaaggcaagttcagacttgctgctcgtccagtctgatctctacaccttagttgatggctttgtcactcgaaacaaagctagaactaacccctcgaacccgtcaattgaattgggacccgagttcaagaaggtggctactttcttgagccggtttaagtccattcctagtatagtcgagctcgacagccttaaggtgtctggtgatgtctggtttggctcttccattgttctcaagggcaaggtgactgtggcggcaaaatccggtgtgaagcttgaaattccggacagggccgtggtcgagaacaagaacatcaatggtccagaagacctctgaatttaaatacccagcaaatacccagcaaattggagctctgcagagctttcgttcgtatcatcggtttc

SEQ ID NO: 177 - DNA, 2471 bp, Arabidopsis thaliana
tcatttatttgtcagctttcaaactctttgtttcttgtttgttgattaacccttaattaagatgcaacccaattctcacatcttcgtcatcatcaccatttcatcactcatcattacagtttctgcgtatggctcaacaggcacaatcgcagcagctttcggcgaaaacggattcttctgcgccattgacgcaagtgggaagcaagaagtcatctgttgggatagaggaaacactaaccgatcattaaaccgacccccaggtgaaatctccggttattctcctccaatgacttctctttccggtggtgaaggttttctctgcgccattacgtcgaacacttcgcgtgcgttttgttggaaccttgaagatccttctgagaatctcgttcctcgagcttttcagtataattcttacttacagattgcttctggtaacaatcatgtttgtgctattagtggattgtattactcaggtcctgattatggtcctgttcattgttgggagtatagtgataacactaatttcacttctggtcttctttggaattcttcttttcataatccttatatagatagtctcatgtttcgtaagattgtttctggagatgggttttcttgtggtgttactaaagatggagacttggtttgttggggaccaaaatcaaaccttttgaatttctccaataatgaagaattcgaggttttagcttctgggaggaactctgtttgtggtgtctctaaagattcaggtcaacttcattgctttggagatgaaacagagtttggttcgttaccaaaccggcctcggtttattgctctttcagctggtgctaatcattattgtggtatacgtgaggatgatcatggagttgagtgttggggaaggaacttgaattcttcttcatcatcttcagctcctaatacttcagggtttgtggcgatttcgtcttcggattcaacaacttgtggagttagagagcttgatttagttcttgattgttggagagttcatgattcttcgaaagcggattatagtcctcctttggagttatgtagccccgggatgtgttcgcctcgcggtaattgtggtgatggttggtttgctttcaatgcaagtatcttgaaagaatctgagcttactagcttgtgctcgtttcataacctcaacatttgtttacgttgtggaatcagttgcttggaagggtatttcccttccagcacttgtaatccaaacgcggaccgggtctgtactccttgttcgctatgtcagaatagttcttgttacggtatctgtaagattcgggctacgaaatcgaaggagcatgagcagaaagagcagagagaggtacggagattggtgatcatcatagggtgctctgttttagggttcttggtgatgttgattggtttgtctttcattccaaagatgacaaaaggtagtaaacgagatgatgaagagaggagtaagatgacttgttgcttctgtttcgataagaattctgtagaagctgatcctgatcctgtccctcatcagtcggttcttctaccaaccgctgtatctctcggggaaaccaagatcttccgtctatcagaacttaaagacgcgactcacgggttcaaagaattcaacgagctcgggagaggtagcttcgggtttgtctataaagctgttttatctgatgggatacatgttgcggtcaaaagagcgaatgctgcaacgatcattcactctaataaccgaggtttcgagtccgagctagagattctttgcaaaatcagacacaacaatattgtgaatttgttaggatactgctcagagatgggggaaaggcttttggtttatgagtacatgccgcacggtacgcttcatgatcatctccatggagatctttcacaactggactggagcatgagactgaagatcatgttgcaggctgcaagaggacttgattacttacacaacgaagtagatcctccgataattcacagagatgtgaaaacgtccaacatcttgttagacggtgaaatgtgcgcaagaattgcggatttcggattggtaagctcgaatgaaagggattcaagcaatagtgatagagaaggtgatgtgtatgactttggtattgttctacttgagatactaagcgggcgaaaagctatcgatagagagtctgatcctgcggggattgcggaatgggcggttcctttgatcaggaaaggaaaagcagcggcgataatcgataggaacatttgtttgccaagaaatgtagagcctttgcttaaattggctgagttagctgagcttgctgtgagggaaaattcgaatgaacgaccaaatatcagaaatattctgtgttttcttgatctcatcgtcaagtctggcctcactttttaaatttaaatacccagcaaatacccagcaaattggagctctgcagagctttcgttcgtatcatcggtttcgacaacgttcg

SEQ ID NO: 178 - DNA, 1184 bp, Rhodopseudomonas palustris
aactctttgtttcttgtttgttgattaacccttaattaatccgggcgcgcctgatttatcacaagtttgtacaaaaaagcaggctcctgcaggaccatggcagtccgggtcgcgatcaatgggtttggccgtatcggccgcaacgttctgcgggcgatctacgagtccggtcgtaaggatatcgaagtcgttgcgatcaacgatctcggcccggtcgagaccaatgcccatctgctccgcttcgactccgtccacggccgcttcccgttcgaggtgaaggtcgacggcgacaccatcgatgccggccgcggcaagatcaaggtgacggccatcaaggatccttcggcgctgccgtacaaggaagtcggcgtcgacatcgctctggaatgcaccggtatcttcaccgcgcgcgacaaggccgccacgctgctgaccgccggcgccaagcgcgtgctggtttcggctccgtcggacggcgctgacgcgaccatcgtgtacggcgtcaaccacgagaccctgtcgaaggaccacatggtggtttcgaacggctcgtgcaccaccaactgcctggctccggtcgccaaggtgctcaacgacaccgtcggcatcgaaaccggcttcatgaccacgatccacgcctacaccggcgaccagccgacgctggacaccatgcacaaggatctctaccgcggccgcgctgcggcgatgtcgatgatcccgacttcgaccggtgccgccaaggcgatcggcctggtgctgccggagctgaagggcaagctggacggcgtcgcgatccgcgtgccgaccccgaacgtctcggtggtcgacctcaagatcattgccaagaaggccaccaccaaggaagagatcaacgaagcgatcaagcgcgccgccgagcaggagctgaagggcatcctcggctacaccaacgcgccgaacgtctcgatcgacttcaaccacgatccgcactcgtccaccttccacatggaccagaccaaggtgcagaacggcacgctggtgcgcgtgatgtcgtggtacgacaacgagtggggcttctccaaccgcatggccgacaccgccgtcgcgattggcaagctgatctaactcgagacccagctttcttgtacaaagtggtgataaattggagctctgcagagctttcgttcgtatcatcggtttcgaca

SEQ ID NO: 179 - DNA, 1172 bp, Arabidopsis thaliana
tcatttatttgtcagctttcaaactctttgtttcttgtttgttgattaacccttaattaaatggtgcttttaccagcgtttttggacggattagcgagaactgtatcgacgaagaaaggtaaaaaactatcggaagatgaagatggagggagagagatcgcaaaatcgatgattaaagattcgaagaagaactcgacgttgctcggtacttcaggctttgttagctccgaaagttctaagaggtttacctctatttgttctaatagaggtgagaaaggaatcaaccaagatcgtgcaattgtttgggagggatttgggtgccaagaagacataacattttgtgggatgtttgatggacatggaccatggggacatgtgatagccaaaagagtaaaaaaatcatttccatcttctctgctttgccaatggcaacaaactcttgcctccttatcatcctcgccggaatgttcctctccgtttgatctttggaagcaagcttgcctgaaaacattctccatcatcgatcttgatctcaagatcagtccttccattgattcttactgtagcggctgcaccgctctcaccgctgttttgcagggtgatcatctcgttatagcaaatgcgggtgactcacgagcagtaatagcaacaacttctgatgatggaaacggtttagtcccggttcagctctcggtagactttaaaccaaacattcccgaggaagcagaacggataaaacaatcggatggacgattgttctgcctagacgatgaaccgggagtgtaccgggtgggtatgcctaatggaggatcactcggtttagctgtttcaagagcgtttggagattactgccttaaagacttcggtttagtctctgaaccggaagtaacataccgaaagataaccgacaaggaccagtttctaatcttggccaccgatgggatgtgggatgtgatgacgaataatgaggcagtggagatagtaagaggagttaaagagagaagaaagagcgcaaagagattggtagagagagctgtgacgctttggcgtaggaagagaagaagcatcgccatggatgatatttctgttctctgtctcttctttcgtccttcttaggcgcgccaaaaattggagctctgcagagctttcgttcgtatcatcggtttcgacaa

SEQ ID NO: 180 - DNA, 1841 bp, Saccharomyces cerevisiae
ttcatttatttgtcagctttcaaactctttgtttcttgtttgttgattaacccttaattaagatgaattcaactcccgatctaatatctcctcagaaatccaattcatccaactcatatgaattggaatctggtcgttcaaaggccatgaatactccagaaggtaaaaatgaaagttttcacgacaacttaagtgaaagtcaagtgcaacccgccgttgcccctccaaacaccggaaaaggtgtctacgtaacggtttctatctgttgtgttatggttgctttcggtggtttcatatttggatgggatactggtaccatttctggttttgttgctcaaactgattttctaagaagatttggtatgaagcaccacgacggtagtcattacttgtccaaggtgagaactggtttaattgtctctatttttaacattggttgtgccattggtggtatcgtcttagccaagctaggtgatatgtatggtcgtagaatcggtttgattgtcgttgtagtaatctacactatcggtatcattattcaaatagcctcgatcaacaagtggtaccaatatttcattggtagaattatctctggtttaggtgtcggtggtatcacagttttatctcccatgctaatatctgaggtcgcccccagtgaaatgagaggcaccttggtttcatgttaccaagtcatgattactttaggtattttcttaggttactgtaccaattttggtaccaagaattactcaaactctgtccaatggagagttccattaggtttgtgtttcgcctgggccttatttatgattggtggtatgatgtttgttcctgaatctccacgttatttggttgaagctggcagaatcgacgaagccagggcttctttagctaaagttaacaaatgcccacctgaccatccatacattcaatatgagttggaaactatcgaagccagtgtcgaagaaatgagagccgctggtactgcatcttggggcgaattattcactggtaaaccagccatgtttcaacgtactatgatgggtatcatgattcaatctctacaacaattaactggtgataactatttcttctactacggtaccattgttttccaggctgtcggtttaagtgactcttttgaaacttctattgtctttggtgtcgtcaacttcttctccacttgttgttctctgtacaccgttgaccgttttggccgtcgtaactgtttgatgtggggtgctgtcggtatggtctgctgttatgttgtctatgcctctgttggtgttaccagattatggccaaacggtcaagatcaaccatcttcaaagggtgctggtaactgtatgattgttttcgcatgtttctacattttctgtttcgctactacctgggccccaattgcttacgttgttatttcagaatgtttcccattaagagtcaaatccaagtgtatgtctattgccagtgctgctaactggatctggggtttcttgattagtttcttcaccccatttattactggtgccatcaacttctactacggttacgttttcatgggctgtatggttttcgcttacttttacgtctttttcttcgttccagaaactaaaggtttatcattagaagaagttaatgatatgtacgccgaaggtgttctaccatggaaatcagcttcctgggttccagtatccaagagaggcgctgactacaacgctgatgacctaatgcatgatgaccaaccattttacaagagtttgtttagcaggaaataaatttaaatacccagcaaattggagctctgcagagctttcgttcgtatcatcggtttcgacaacgtt

SEQ ID NO: 181 - DNA, 1791 bp, Agrobacterium tumefaciens
tatttgtcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgaacaccagtcaggacatcacagttgcagcaggtggccttgacgccacggcggcgattcagcaggctatcgatgccgtgtcatcagcaggcggcgggcgcgtgtctctctcggccgggcgtcatgtcagcgccggtctccatctcaaaagcggcgtggaactgcacctcgccgaagatgccgtgcttgcgccggtttccgattacgacgcttacgcgctgacccgggtttcggtgattgccgaagactccgatcgcggcatgatcatcgcgaacggcgcaagcaatattgccgttaccggtcccggccgtatcgaggccggcggtgaaaacttcatcatcggcgatgacgcggccatgggaacctatgtcccggcgaaaaaacgcccgcgcgtgatggtgctggaagcctgccgcaacgtgcgcctcgaaaacctgaacgtcagcgcctcacccatgtggacgctgcatatggtaaattgcgaggacctccatttccgcaatctccgcatcgaaaacgaccgccgcctgcccaatacggacggcatcgtgctggacgcctgccggcgcgcgctgatagaggactgctttatctcaactgccgatgacggcatctgcctcaaaaccagcgccgggccggatggcaaggcggtgggggtctgcgccgacatcaccgtgcgcggctgcaccgtctccagcatgagctgcgcgctgaaactcggcacggagtccttcggtgatttcaccaatgtggtgttcgaggattgcaaggtcgtgcagtccaatcgcggcatcggtcttttctcccgcgatggcggcgcgatgcgcaacatccgcttttcgcggatcgagaccgagtgccacgagacaccgggcggattctggggctcgggcgaagcggtcaccgtcaccgtcgtcgaccgccgtcccgaacggcaggccggccgggtggaaaacctcgtggtggaagatctgggcggctccatggaaggggcgatcaacctcgtctccacctcaaaggcgggcattcataatgtcaggctggagcgcatcacgcttgcgcagcagcccggtaagctcggcaccggcctgcaatatgacctgcgccccaccaatgccgacatagcgccaagcgccgaggcggccggccgcgccaatgcctggacacaggatgctgagggccggattgtcggcatggaggattatcccggcggcatgccggcgatctatctttccggcgttcacagattttcggctgataatgtcgccatcaaaagagcgatgcccttgcccgagggctggaatatcaaagagatcgtcgcgacgacgggctctgatgaagggagcatgtgatgggaagtctgaaactcgaaaacctcaacaaggcgttcatttaaatacccagcaaatacccagcaaattggagctctgcagagctttcgttcgtatcatcggtttcgacaacgttc

SEQ ID NO: 182 - DNA, 1279 bp, Agrobacterium tumefaciens
ttaattaaatgtcggaaaaaagagttcagcctttggcgcgtgatgcaatggcctatgtcctcgcaggcggaagaggaagccgtctgaaggaactgacggaccgccgggcaaaacccgcggtttattttggcggcaaggcgcgcatcatcgattttgcgctttccaacgcgctcaattccggcatccgccgcatcggcgtcgccacgcaatataaggctcactccctcatccgccacctgcaacgcggctgggacttcttccgtcccgagcgtaacgaaagcttcgacattctgccggcttcgcagcgcgtgtccgaaacgcaatggtacgaaggcaccgccgacgcggtttaccagaacatcgacatcatcgagccctatgccccggaatatatggtcattctggccggcgaccatatttacaaaatggactacgaatacatgctgcaacagcatgtggattccggtgccgacgtcacgatcggctgccttgaagtgccgcgcatggaagcgaccggcttcggcgtgatgcatgtgaacgaaaaagacgagatcatcgacttcatcgaaaagccggccgatccgcccggcattcccggcaatgaaggttttgcgctcgcctcgatgggcatctacgtcttccacacgaagttcctgatggaagcgctgcgccgcgatgccgccgatccgacctccagccgcgacttcggcaaggacatcattccctatatcgtcgaacacggtaaagccgttgcgcaccgcttcgctgattcctgcgtgcgttcggatttcgagcacgaaccctactggcgagacgtcggcaccatcgatgcctattggcaggccaatatcgacctcacggatgtggtgccggacctcgatatctacgacaagtcctggccgatctggacctatgcggaaatcaccccgccggcgaaattcgtgcatgacgatgaagatcgccgtggttcggccgtatcgtcggtcgtctcgggcgactgcatcatttccggtgcagcgctcaaccgcagcctgctgttcacaggcgtgcgcgccaattcatactcccgccttgagaatgccgtagtactgccgagtgtgaagatcgggcgtcatgctcagctcagcaatgtcgtcatcgaccatggcgtggtcattccggaaggactgattgtaggagaagaccccgaactggatgccaaacgcttccgccgcacggaaagcggcatctgccttatcacccaatcgatgatcgacaagctggacctgtagatttaaat

SEQ ID NO: 183 - DNA, 1080 bp, Arabidopsis thaliana
atggactggaatttcaaacttagctctggttatttatctggattcgatcaagaaccagatttatcaccaatggatggttcgatctcgtttggtgggtcgtcacagtcaaaagcggatttttcatttgatctaaaacttggaagaaacattggaaactcttcctctgtttttggtgatacagagcaagtgattagtcttagtaagtggaaagatagtgctttagctaaaccagaaggttcaagaagctcgagttcaaagagaacaagagggaatggtgttggaaccaaccagatgccgatttgtcttgttgatggatgtgattctgattttagtaattgtagagagtatcataagagacataaagtttgtgatgttcattcaaaaactcctgtggttactattaatggtcataaacagaggttttgtcaacaatgcagcaggtttcatgctttggaggagtttgatgaagggaagagaagttgtaggaaacgtcttgatggacataatcgaagacgacggaagccgcagcctgaacatatcggtcgtcctgccaacttctttacgggttttcaaggtagcaaattgctagagttttctggtggttcacatgtgtttccaactacatctgtgttgaacccgagctggggaaatagtcttgtaagcgttgctgtagccgccaatggttcgagttatgggcagagccagagctatgttgttggttcttctcctgcaaagacagggataatgtttccaatctcttcttctccaaacagtaccagaagcatagcaaaacaattccctttcttgcaagaagaagaaagctcgagaaccgcatcgttgtgtgagagaatgacgagttgcatccatgactctgattgtgctctctctcttctgtcatcctcctcgtcgtcagtccctcatttgcttcaaccaccactttctttgtcccaagaagcagttgagacagttttttacgggtcgggattgtttgagaatgcgagtgcagtctctgatggatcggttatatccggtaacgaggctgtccgtcttccgcagacattcccgtttcattgggagtag

SEQ ID NO: 184 - DNA, 996 bp, Arabidopsis thaliana
atgggattatattcactaatcacaggaagaagaggaccaagtggatttggttcagcttcaacagctgaagaggttactcaagggattgatgcaactaatctcactgcaattatcacaggagggacaggaggaatagggatggagacagcgagagtgctgtcgaagagaggtgctcatgtggtgatcggtgcccgaaacatgggagctgcagaaaacgccaaaacagagattctcagacaaaacgcaaacgcacgtgtcactcttcttcaattagatctctcttccatcaaatccatcaaagcctttgttcgtgaatttcatgccctccatcttcctctcaatctcctcataaacaatgcaggagtaatgttctgtccataccaactctctgaagatggaatcgaattgcagtttgctacaaatcacattggtcactttctgttgacaaacttgctcttggacacaatgaagaacacagctaaaaccagtggtgttgaaggaagaattttgaatgtatcatctgtagctcatatctatacttaccaagaaggaatccaattcgacagcatcaatgacatttgcagttactcggataagcgagcttacggacaatcgaaactagccaatatattgcatgctaatgagctctcccgtcagcttcaggaagaaggagtaaacataacagcaaattcagttcaccctggtcttattctcaccaatctcttccaacacactgctcttttaatgaggttcctgaagttcttcagcttctacttgtggaaaaatatacctcagggagcagcaacaacatgttatgttgctctgcatccaagtgtgaagggagtaacaggaaagtactttgctgattgcaacgaagtcactccaagcaaacttgctagagatgagactttggcacagaaactctgggatttcagtgttaagctcattaactcggtttctaaaaagaactacctcggtttcgatgacaccacttga

SEQ ID NO: 185 - DNA, 1841 bp, Glycine max
ttaattaatgatcactgatcactcatcatcatcatcatcatgggggtgttacaggagaagctctcttccttctacaagagccggtggctagtgttcgtggccgcaatgtggctgcagtcgtgggcgggcatcgggtacttgttcgggagcatctctcctgtcataaaaagctcccttggctacaaccagaagcagctcgccatgcttggcgtcgccaaggaccttggtgacgccgtcgggttcatgaccgggcttctttgtgagatcttgcccatctggggcgcgcttcttgtgggtgctgctttgaaccttgtgggatatggctgggtctggcttgttgtcacttctcaagtccctgtcttgcctctctgggctatgtgtgctcttatctttgtgggaacaaatggtgaaacctacttcaatacagtttctctggtgtcttgtgtacaaaatttccccaaaagccggggtcctgtggtgggaattctaaagggctttgctgggttgagtggtgcaatcttgactcagatatatgcactgttccatgcccctaatcaagcatcactaatatttatggttgctgttggtccatcattggtaggaataggtcttatgttcattgttaggcctgttgggggtcacaaacaagttaggccatcagatggcaaatgcttcacattgatctatggtgtgtgccttctattggctgcatatttgttgggagtcatggttgtccaagatttggttgaagtgagtgaaactgtaatctctatattcactggggttctcttgttgatcctccttgtcccaatcgttattcctattacattgagttttggcccggagcaaaggcatccagaggtagaagcacttcttccaccaccacagaataaagaagcagggaaatctcagctggattctgatgaagtgatactgagtgagttggaagatgagaagcctaaggaagttgacatgctccctgcatcagagaggcagaaacgtatcgcgcacttgcaacaaagactgctccaagcagctgcagaaggagcagtgagggttaagaggagaagaggaccacacagaggggaagatttcaccttgacacaagcattgatcaaagcagacttttggcttcttttcatttccatgatcatgggttctggatccgggttgactgtaatcgacaatctgggtcagatgagccagtctctaggatatgacaatgcacatatatttgtctccatgatcagtatttggaactttcttggccgtgtcggaggaggttacatatctgagcttgttgtgagggatcatgcatatccaaggccagttgcattggctgtatttcaactcattatgactcttgggcatgttttccttggtatgggatggccagggtcaatgtatgttggcactttactagttggacttggttatggagctcattgggcaattgttccagctacagcctctgagttgtttggtttgagaaactttggtgctttgtacaatttcattactatagcaaaccctgcaggaacactggttttctctagtctcattgccagcaccatctatgatgctgaagcagagaaacaacatcgccaaaatatgatgttgcgtgtgctgaatgctagtgagcctctaaagtgcgaaggttccgtatgtttcttcctaacttccatgatcatggcaggattatgcgtggttggagcaggcctatgcatggttcttgtgttaagaacaaggattgtttatgccaacctatatggaaaagcttcttctagtagacttcgattatgagagtttggactatgtattttggtgtctgtaatttaaat

SEQ ID NO: 186 - DNA, 1567 bp, Arabidopsis thaliana
ttaattaaatgtcgtcatcatcatataacacaagcgttattccttcatcatcatcctctgctcagcctttcttcatcaccagctccggcaccggagataacgactttaaccggaaagatacttttatgtcaatgattcaacaacctaactcctcagctccaccacccaagaaacgaagaaaccaacccggaaacccaaatcctgatgcggaagtggtagcattatctccaaagacactaatggctacaaacagattcatatgcgatgtatgtaacaaagggtttcaaagagaacaaaatctacagcttcaccgaagaggacacaatctcccatggaagctgaaacaaaaatcaaccaaagaagtgaagaggaaagtgtatctttgtccggagccaacgtgcgttcaccatgacccgtcacgtgctctcggagacctcaccggaatcaagaagcattattaccgtaaacatggcgaaaagaagtggaaatgtgagaaatgttctaagcgttacgctgttcaatcagattggaaagctcactctaagacttgtggtactaaagagtatcgatgtgactgtggtaccatcttctctagacgtgatagttacatcacgcatagggctttctgcgatgcattgatacaagagactgcaagaaaccctaccgtgagctttacgtcaatgacagctgctagtagtggtgtcggctccggcggaatctacgggagacttggcggtggcagtgctctctcacaccaccatttgagtgaccatccaaattttggatttaaccctctcgtgggttacaatctgaacattgcatcttctgataataggagagactttattccgcaatcatcaaaccctaacttcctaatccaaagcgcttcgagccaaggaatgttgaatacaacgccaaacaacaataaccagagtttcatgaaccagcatggtctgatacagtttgatccagtcgacaacatcaacctcaagagtagcggcaccaacaacagcttcttcaacctcggattctttcaagaaaacacgaagaactcagagacgagtcttccttctctatatagcaccgacgttcttgttcatcaccgtgaagaaaacttgaacgcgggttctaacgtgtcagccacggcactacttcagaaagctacacaaatgggttcagtcacaagcaacgacccatctgctttgttcagaggcttagcttcttcgtctaactcatcaagtgttatcgctaatcactttggtggaggacgaattatggagaatgataataatggaaaccttcaaggtctaatgaactcattagccgccgttaatggaggtggcggatccggtggcagtatcttcgacgttcaatttggagacaatggaaatatgagcggctcggacaagttaacgttagattttcttggagttggaggaatggtgagaaatgtaaatcgcggtggtggtggtggtggtcgcggcagtgctcgtggcggagtttctttggatggtgaggcgaagtttcctgagcaaaattatccatttggaagaggttgaggcgcgcc

SEQ ID NO: 187 - DNA, 1099 bp, Arabidopsis thaliana
ttaattaaatgtcgaaatttctcccggaagaattagccattgagattctagtgaggctatcgatgaaggatcttgctcgattcagatgcgtctgcaagacatggagagatcttatcaacgaccctggattcacagaaacgtaccgagacatgtctccggcaaagttcgtgtcgttttacgacaagaacttttacatgcttgacgttgaaggcaagcatccggttattacaaacaagctcgatttccccttggatcagtcaatgatcgatgaatctacatgtgtgcttcattgtgatgggactttatgtgttaccttaaagaatcacactttaatggtttggaatccgttttcgaagcaattcaagatcgtaccaaatcccggtatataccaagattcaaacattctgggtttcggttatgacccggttcacgacgattacaaagtcgtaacgtttatcgaccggcttgatgtttccacggcgcatgttttcgaatttagaaccggttcatggggagagagcctacgtatttcttatcctgattggcattacagagacaggagaggtacatttttggaccaatacctctattggattgcgtaccggtctagtgctgaccggtttatcctatgctttaatctctcaacacatgaataccgaaaactccctctcccggtttacaaccaaggcgtgacgtcttcatggttaggcgttacaagtcaaaaactctgtattacagagtatgaaatgtgcaagaaggagattcggatttcggttatggagaaaaccggatcatggagcaagattataagcctttcaatgtcgagtttcatctctgtacaagatcgtatctacgattatcaagtcgaattcgtgtcgtttactagaaagaacgatctcgtcgtaacattcactggatacaacgatcatttcgagatggaacctgaagagcgtacgaagaagaagatgttcttgtacaaaaccggaaacgagagatctgaagaagtccggttctgtaaccctctagccgggttacggtttctctgtgaatgtgtggagactcttaagattgttaatcgcatatttatttgaggcgcgcc

SEQ ID NO: 188 - DNA, 871 bp, Arabidopsis thaliana
ttaattaaatgaacaacaatcattcctatgatgatcgcagttttcacattccacttcatccttctaacacaagcaaccctaatccaaatctccagtttgctttatcttcaagctacgatcacagtcctaagaagaaacgcaccaaaaccgttgcttcatcctctagttcttcaccaaaatccgcgtcaaaaccaaaatacaccaaaaaaccagacccaaatgcccccaaaatcacacgtccatgtactgaatgtggcagaaagttttggtcttggaaggctctctttggtcacatgagatgtcaccctgagcgtcaatggcgtggcattaatcctcctcctaactaccgtgtgcccaccgcggcttcttcaaaacagttaaaccagatattaccaaattgggtctcatttatgtccgaggaagaccatgaagtcgcttcttgtctcttaatgctgtctaatggtacaccatcatcatcgagtattgaacggttcgagtgtggaggatgtaagaaagtgtttggatcacatcaggctttaggaggacacagagcgagtcataaaaacgttaaaggctgtttcgctatcacaaacgtaaccgatgatcctatgacggtttctacttctagtgggcatgatcatcagggaaaaatccttacgttttcagggcatcataagtgtaatatctgttttagagtgttctcgagtggtcaagctttaggaggtcacatgagatgtcattgggaaaaggaggaggagccgatgatcagtggtgctttggatttgaatgttcctccaacaatacaggatctttctacttcggacacatcagggtgttgtttagatcttaggttaggactctaaggcgcgcc

SEQ ID NO: 189 - DNA, 789 bp, Arabidopsis thaliana
ttaattaataacgacagtcgccgagtgagagatatagagagagaaagatgccggtgcacgatgagcaagagcatgaggtgtacggtggagagatcccagaagaggaagaaggtgagatggatacggaagagtacgaagaacacggcggagaagaaggtgccgccgccggagatgaggagcttgaacctggctctagctctagggacttggaggatatgaagaaacgaattaaggagattgaggaagaagctggagctttgcgtgaaatgcaagccaaggctgagaaagatatgggtgctagtcaagacccttcaggtggtgttagtgcggctgagaaggaagaagtggattcgcgttcaatatatgttggcaatgtggactatgcatgtactccagaggaagtccagcagcattttcaatcatgtgggacagtgaatagggttacaattctgacagataagtttggtcaacctaaaggttttgcgtatgtcgaatttgtggaagtagaagctgttcagaattcgcttattttgaacgagtcagaactacatggtcgtcagataaaggtatctgcaaagaggactaatgtacctggaatgaggcaatttcgaggaagagggcgtccctttagaccgatgaggggattcatgccaggagttccattttatcctccatatgcttatgggagagttcccaggttcagacggcctatgcgctacagaccgtactgattaggcaaattggtgttaaaaaagtagcagctgcttctccgttttcgggaggcgcgcc

SEQ ID NO: 190 - DNA, 1953 bp, Arabidopsis thaliana
atgcttcggaagtcggttctcgagctgtcttctcgtttgtcaataaagagattcccgaggaatttgggagctcagaggtttcatttgagctcttcgagaaatgcatctacatctggtaaaaatggtctccctggagctaaacccgttgggaaaccagatgcctcaaaagttgatcctccaaaagtgactcctcctcctcctactaaaggaaattcttcaaaagtggttataggaggtgttgcaatcgctggggcttttctggtagcgtatcagactggctatttggatcaatatctggggaaagaacagcagaaattaagtgagcgaattcattctgatgctctaactgaaaagctggaggaggctcatcatttgaatgtaccttccggtgttgaagattctactgaaaaagatggaaaagttgaaacgcaacctcaagttactcattctgaagcttccgagggagtgcagagtgacatagaactgcaacccgagtctgatctatcatctgaccgttttacatatatttcttctaaccaagaggagacacctcaagaaactgtcattgatagagcagagataaacttgcctatttctgcatctgaagattcaggagctaagccggacatgccatcagaaattatttctgaggcagaaagtgtgaagttggaagctgtacccaaacctggggatagtcctattattgttaatgcccagtctagttcggttcatagagaaagcgaaacggaatctgcttcaccaaaggatcctgccgctctaaagacacctgaggatggcattgagcgggaagtacaattaccaggttctctccttaaggaatataatctagaaggcagtgatactgaaagcactgggtcctcgtcaataggggagcaaataactaaagaaactgaggcctttcctaactcaaccgaggggctgaaagatagttacatgactgaggatggaaagttggtacttgattttctggctgccattcatgcagctgagaagcaacaggcccatttagatgcccaggtttttgctgaagaattacgagccttgaaggagaagtatgaaaatgagttaagagaccttagggcacgtgagctaatgcgtatagaggaggcagcaatattggataaggagctaaaaagagaacgaacaaaagcagcagctgctattaaagcaatccaggagagaatggaagataagctcaaagctgaacttgaacaaaaggaaactgaagcgcagttggctttgagtaaagctgaagaattggcaaaagctgagatgatttcgacaattgcaaaagaaaaggcagcacagattgaaaaaatggcagaggcagatcttaatataaaggcactgagtatggcattctatgcgcgctctgaagaggctcgccaaagtcattcagttcacaagcttgcattgggtgcacttgcgctggatgatacactctcgaaaggactgccagtccaaaaagaaatcgatacgcttcagacttatcttgaagggactcataaagattcaatcctaggcctggtattatcatctcttccagaagaagcacgatccaatggaaccgacacagtgctgcaattgaatcagaagtttgataccttgaaaggaacacttagacatttcagtctcattccacctggtggcggaggcatcttagcacattccctagcacatgtagcatcttcgctaaagtttaaagaagtggatcaagctaatggaggcatcgaatctgtaattaaaaaggtggataattacttggcggaaggaaaactagcagaagcagcagcaacactagaagaaggtgttaaaggaagtaaagcagaggaaatagtgagtgattgggtgcgacgtgcaagaaacagagccattacagaacaagctcttacgcttctccaatcttatgcaacttgtgttagcctcacttga

SEQ ID NO: 191 - DNA, 1412 bp, Arabidopsis thaliana
ttaattaaatggcgagaagatccgtttcgatatttaatcgccttctggcgaatcctccttctccattcacatcactgtcccgatccatcacctacatgcctagacccggagatggagctccacgaaccgtaaccctaattcccggcgacggaatcggacctttggtgaccggtgcggtggaacaggtcatggaagcgatgcacgcgccagtgcatttcgagagatacgaggttctaggaaacatgagaaaagtccctgaagaagtgatcgagtctgtgaagagaaacaaggtttgtctcaaaggtggattagcgactcctgttggtgggggtgtcagttctttgaatatgcaattgaggaaagaactcgatatcttcgcttctcttgtcaattgcatcaatgtccctggattagtgacgcgacacgaaaatgttgatatcgttgtgataagagagaacactgaaggagagtactcaggtctcgagcatgaggttgttcctggtgttgtcgagagccttaaggtaaaccatatataattatagggattgtttttagtccaaattgtgatcccttttgtatacatgatgttgttgaattgtttgtgtaggtgataacaaagttttgttctgagagaatagcgagatatgcatttgagtatgcgtatctaaacaataggaagaaagtgactgctgttcataaagctaacattatgaagcttgcggatgggctcttccttgaatcttgtagagaggttgctaaacattattcggggattacttacaatgaaataatcgtagacaattgctgtatgcagcttgtcgccaagcctgagcaatttgatgtcatggtaatgctcttcttttcctagttacaaatcaaaatgagtcattttgaaatgtgacagacgatgaaaccatcattgatgttgttttgatgtctctcatggatattttttgttggtttgtttcaggtgacacctaatttgtatggtaaccttatagcaaacacggcggctggaatagccggtggcactggagtgatgccaggaggtttgtcaaataaatataatagttacagttataatctttcgtaaaatgacgtttcttgggtttgttggggacagggaatgttggtgcagaacatgcgatattcgagcaaggtgcatcagcagggaatgtggggaatgataagatggtggaacagaagaaagcgaatccggtggctctacttctctcgtcggctatgatgctaagacatctccggtttcctacttttgctgatcggcttgaaacagcagtgaaacaagtgattaaagaaggaaaatatagaacaaaagatcttggaggagattgtaccacgcaggaagttgttgatgctgtcatagcagctcttgagtgaggcgcgccaaaaat

SEQ ID NO: 192 - DNA, 1286 bp, Arabidopsis thaliana
cttgtttgttgattaacccttaattaagatgtataagtggaatcttccttaccgaaaagatgacgtggagaccggccgtgaaggcggtgagagatctctgtatccgactatgcttgagagccccgaactccgatggggtttcatcagaaaggtatattccataatcgcattccagcttttagcaaccatcgccgtcgcctccacggtggtttttgtccgtccgatcgccgtgttcttcgccactactagtgccggtctcgctctctggattgtcttaatcatcacgcctcttataggtaaccaaattatcaatcattaattcgatgattatttgatttaggtttttggtttaatttgttattgttttgctgttgcagtaatgtgtcctttgtactattaccaccagaaacatccagtgaattatttgcttctagggattttcacggtagctttggctttcgccgtcggattaacatgtgctttcaccagcggtaaggctttccttgtgaaacactctagttctctttattcgtttctgtcctttcaagggtcggtcttattaattgcttgaaatcacacgcttaagatataatataaaattagtctgtgagacctccaacacatttgagctgggtttgaatttcctcatactcaatacaactggttcattgaagattgatgttccatggttgcatagaaacattggattgttttaatccaaattcgataaacgaaccatagagttttgggagtataaatttattcattagagtttggaactttgttgttggaacagggaaagtgattcttgaggcagcgattttgacaacagtagtggtgctttccttaaccgtctacaccttttgggcagcaaagaaaggatatgactttaacttcctcggtccattcttgtttggtgctctcatcgttctcatggtctttgcccttattcaggttcctgtcccttacaattgcttgttttggtttaacattcgaaattcaggtttaaaactgagcctgatcgtggtgctttgggttctatttgtttttttgcagattttcttcccgttgggacggatctcagtgatgatctatggatgtttggctgcgataatattctgcgggtacatagtttacgatacagacaatctcatcaaacgttacagctacgatgagtatatttgggcagcagtttcgctctacttagatattatcaacctcttcttggctctccttaccattttcagagctgccgagtgaatttaaatacccagcaaattggagct

SEQ ID NO: 193 - DNA, 1400 bp, Arabidopsis thaliana
tgttgattaacccttaattaagacgaagcacaatgggtcaaggaccttccggcggattgaatcggcaaggagatcggaaaccagatggtggagagaagaaggagaataagttcgaaccagccgcaccacctgctcgtgtagggaggaagcaacggaagcagaaaggacctgaagcggcggcgagattgccgacggtgactccttctactaaatgtaagcttcgattgctgaaattggagcgaatcaaggactatttgcttatggaggaagagttcgtagcgaatcaggagagattgaaacctcaggaagagaaagctgaggaagatagatctaaagttgatgatcttcgtggtacacctatgagtgttggcaatcttgaagagcttattgatgagaatcacgccattgtttcttcttcggttggtcctgagtactacgttggcattttgtctttcgttgataaggatcagcttgaacctggctgctctattttgatgcataacaaggtactctctgttgttgggattcttcaagatgaagtggatccaatggtgtctgtgatgaaagtggagaaggctcctttggagtcatatgctgacattggaggtttagaagctcagattcaggagattaaggaagctgttgagttacctttaacacatcccgagctgtatgaagatattggaattaagccaccaaaaggtgtgatcttgtatggtgagccaggcactgggaagacattgcttgctaaggcagtggcaaattctacttcagctactttcttgcgtgttgtcggtagtgaactgattcagaagtatttaggagatggtcccaagcttgtgagggaacttttcagggttgctgatgacctttctccttctattgttttcatagacgagattgatgctgttggcaccaagcggtatgacgcaaactcaggtggggaacgtgaaatccaaagaaccatgttggaactactgaaccagcttgatgggtttgattcaagaggagatgttaaggttattctcgcgacaaacaggatcgagagtcttgacccggcacttcttagaccaggccggatcgacaggaaaatcgaattccctcttccagatatcaaaacaagaagacgtatcttccagatacacacatcaaagatgactttggctgaagatgtgaacttagaagagtttgtaatgacaaaagacgagttctcaggagctgatataaaggcaatatgcacagaagctggtctgcttgctcttagagagcgtcggatgaaagtgacgcatgtggacttcaagaaggcgaaggagaaggttatgttcaagaagaaagaaggagttcctgaaggtctttacatgtgaatgatgcatttaaatacccagcaaattggagctctg

SEQ ID NO: 194 - DNA, 1956 bp, Arabidopsis thaliana
gtttgttgattaacccttaattaatttagtttgatttggaaagtcacagacttgacaaggatggagaaagaaggtgtgtgtgataccattaatttaagtgatcagatgtaccctgatgagcctttctgttccgagatgaaaactgaaaccattgcttcatctcagaaatttgaaggaggcgaggggagtaaagtggttttttcgagagaggcacctttaataggaaaggattcagctggaactaattcgggagaatgctgtggttgtagtgctaagaaactaaattttaaaggggatgatgatctcgttgagaaggaaaatattgagcagcagaaaaagcttaataggcaagaaagaattgagttgggacggctcttccaaggcgctgttacctcactggattgggaacttgctgagagattgattcagttggctgatcctcagactttaaatgatttgttgtgtgttggtctagattcagtttggttcttgagtacaaagcctgagtttcaggggatcaccggattgattaagaagatcatatgtcatggtgctcatgactttactagagctactcttaggacttcgtttctcgcttcttgtgtctctgcttgccagagccggacaatgagtctttctgatacagtaactgttatggctcaaaggttgcatgagcgtctccaggagtgcaacggggatgagattctaaaagcagaggctggtgccaaagttcagaagttcactgaatgggctctcaaatgtataggtttccactcccgatgccagggggcaaaggatagagttagccaaaattcggctgctgaaattgaactacaactttctgctttcaagatgttcttagatctagcaggaaaccatctctcaggaagagacttcactgaggcctttgatgcagcttgtttcccgctcactctgttctccaactcgtttgatcctggctgggcatctgggatgtcagctactgttatacagggactgctcggtatgcttgttgaaggtggcgcagataatgtgaaccaatgtttccttgaagcttcacgttttggtagtacagaacttgtccgcgtcttattgcagattgcccaaaggaacagcttagatgttgatgtggacttagctcttggttttgcctcgcattattgtaaaatcggaacaatgaagtgcctagtggaagaaggtaatgccattgccttcttgggtcccttaatgagagcagcagagagaggttgcatgcaagttgttcaatggtttgtgaaaagaggttgccgtgacatggagctttgcttggctctaacagcggccacttcaagttgccaagtcgaggtagctgcttatctcctccctcgtgttccaccacctgtcttaaccgctctcagcatcgaaatcctcaaagcagcaggagaaagaagcggagggtctctccaaggagtagagtttcttctcaaatcagacttcttaggagattccacggctacatactcagtggcagacagcatcgcaaggtcatcagaagacgaatccgttccttcagatctaaaatcgtttctccaagaacactggtcggagtcagcttttgagaaaggaatgagagaaagccatgacgatttcatgaatttcatgagagttttgaaaaaaggggagtcagcgatatccttaagagaccttcctgcaccgctaagagtagcaatagcgtacatgccgctgtacagagagtgcatgaaagcggacggtcggttactgtctcagaggctaagaggacagcttgtagaagcagtgagacagcttcaaggctgtgctgttgcagttgtggaagtaagccagactcgtaaccttatggcggttttggagcatcaccttaccgccattttcgattgaaacaaatggattctgcttttgggcttcactggttttcggcgcgccaaaaattggagctct

SEQ ID NO: 195 - DNA, 1364 bp, Arabidopsis thaliana
tcttgtttgttgattaacccttaattaactcattgttcagtggttgagagagaaaagagtaaaaaagcacatggcctcattaccattggggcctcagcctcatgctcttgctccgccgctgcagcttcacgacggcgacgctttgaaacgccgtcctgaattggattctgataaggaaatgtctgcagctgttattgagggaaatgacgctgttactggtcatatcatttccactactattggaggcaaaaacggcgaaccaaagcagaccattagttacatggctgagcgggttgttggaacaggttcattcgggattgtttttcaggcgaaatgcttggaaactggagaatcagtagccattaaaaaggtcttgcaagatcgacgctataaaaaccgtgagttgcaactaatgcgaccaatggatcacccaaatgtcatctccttgaagcactgtttcttctctacaacgagtagagatgagctcttcctcaaccttgttatggagtatgtacctgagactttataccgggttttgaggcactatactagttctaatcagaggatgccaattttctatgtcaagctttacacatatcaaatctttagaggtttggcttacatccatactgttcccggtgtttgccacagagatgtgaaaccacaaaatctcttggttgatcccttgacccatcaggttaagctgtgtgattttggaagtgcaaaagtattggtcaaaggtgaaccaaacatatcatatatctgctcccgttattatcgtgctccagaactgatctttggcgccacagagtatacggcatccatagatatatggtctgctggttgtgtactggcagagcttcttctgggccagccgttatttccaggagaaaattcagttgatcagcttgtggagatcataaaggttcttggtactccaactcgtgaagaaattcgatgtatgaacccgaactacacagattttaggttcccacaaatcaaagctcacccttggcacaaggtttttcataaacggatgcctccagaagcaatagaccttgcatctcggcttcttcaatattcaccaagtctacgctgcactgcgctcgaagcatgtgctcatccgtttttcaatgaactccgagagccaaacgcccgtcttccaaatggtcgtccattaccgccattgttcaatttcaaacaagagttaggtggagcttcaatggagctaatcaacaggctaatacctgagcatgtgagacgacaaatgagcacaggattacaaaacagttaaaaactgtgcatgtctgaagagaaagaggagaaaagcaggttatttaaatacccagctttctaaattggag

SEQ ID NO: 196 - DNA, 992 bp, Arabidopsis thaliana
gtcagctttcaaactctttgtttcttgtttgttgattaacccttaattaaatgactaatataggaaaatgcatgcagggatatctcgacgaacaattcatggagttagaagagctccaagatgatgcaaaccctaattttgttgaagaagtttccgcattatacttcaaagattcagctcggttaatcaataacattgaccaagctttgtgagtattattttgttttctattatatatatatttttttttttttcagttttctaatcatttttacaatgcagggaaagaggatcatttgatttcaatcggctggatagttacatgcatcagtttaagggaagcagcacgaggtaatttccccccttagtttttgactattctaattacgccttcaagaaataattttacttaaagaaatgcgaatacttaaatgtttataagataaaagaatgtaacgcaaaagtacattaaaattacttccattctcattcaggattcaatggcagaatctactttaaccagaaataattagattttatgatcgttagttatactgacaaatgttgcatttcttttttttgtagcattggggcaagtaaagtgaaagctgaatgcactacgtttagggaatactgcagagctggaaatgcggaagggtactttcgtctttatacttatataccttcatgcttctcgtttttaacagaaaactaagtaacggggtcaaaatgaaaataagtatagtttagatggctaaaattgctgcaattaatccgctgaaccttgaacttttactttacttcattttcgaccccctaattagttttcttcgctttttcttacttgcagatgcttgaggactttccagcaactgaagaaagaacactcaacgttgagaaagaagcttgaacattatttccaggcgagccaataaatttaaatacccagctttctaaattggagctctgcagagctttcgttcgtatcatcg

SEQ ID NO: 197 - DNA, 1275 bp, Arabidopsis thaliana
ttaattaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgaggtgggttcatctcaaaacttcttttctgttttaaatctgacaacgacttcttttgcgttctccccctttttcagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagccaagctctaataaccagtattgataccgccgagaagaagaagaatccttatgatgatgcacaagggactgagattggtgagcataaattgggtcaagagacgatcaagaagaaaagagctggtttctttcacaggatgatacaaaaattcgtcaagaaaattcacctatgttcttccatctcaagaacttgaggcgcgcc

SEQ ID NO: 198 - DNA, 1851 bp, Arabidopsis thaliana
ttaattaaatggcgaatgcatcacccttgtctccgactaaccaacacttcttccagcctcttcttcccggattccagagcaacctcgtacgcaatctttctttctctcaatctgtctgaacataacatatagtctcatgatggttctgtttctctgttgcagaaaattcctgtgaactacttctctgagcacatcgagggaaaacacgaaggcaagactgtaacgttgagaacagatgcgtcggagagaacatgggaagtaaagatggagggtcatagactcacggaaggttggaaagagttcgttgaggcacatgatcttcgaatcggtgactttgttgtctttagacatgaaggagacatggtgttccatgtcactgctttgggacctagttgctgtgagatccaatacccacagtctagcagacatgaagaaggcgaagagagtggtgaaaatggtatgaatcatcattcaatgaacctttatacatttatcttaggctattcttgaaacgtttattttctgattcagaaatatccgagaaagaaggtgaagagaatgtgcaaaaagaatctgataagtcttcatcagatctgaattgttttagccaatccgtgacgcattcaaacatatcaagagatgcagtggtttgtcggattagcggtttctttgtttttttctatgtttatatcagtcctaatgcaatttgatgactgatgcagagtgtgccgagagatttcgtgaagcgaagtggttttagtaaaggaaggcatgagatagttttgatgaacgaagaaggaaagtcatgggaatcagaagtaaagagttatatgtctggtgcggtttatttagttggaggttggacaactttctgcaccgaaaataaattagatgttggagattcttgcacattcaaactgttgcaaaaggcgaaaacgcccgtgtttcagctctgcagccgcacaaaggtggagagtatgaacataactggagaaagcaagtttgtgaagttaactcctacaccaagcagccttgcgcttggtaaaaggtgacttttggaaacctctgtctctggtttcttcaatgcactgactgtctttataattctgaatatttttgcagcatctaccgttaagtttcacgaaagtgaatggactcatcaatccagggaagataattctggtggacaaagacagagctgagtggtcgatgatgcttaaggttgatagtagaggagctgtgtatattattggtggtaatgactggaaaagtttctgtgccgcaaatgaagtaggcgcaggggagtcactagctttggagttgatccaaggaggtgtaagtcctttgctcaagttctgctccaaggtcagtaagaacgtcaaatagcttgcaatccacgttttaggttttgctaaatcaaataacgacttgttttcagatggagcaaccctcattcaaagcagaggatgggagacacaagagagctcgagtccaaaataggagccaggaaacagataagggagcagaaacttctagagcatctacaatgggaccgaagcttgagataactgaaaaaggagaaccctctcgagcatctacaatgagaccgaaagttgagataagggagaaaatagctgaaacgggagaaccctctcgagcatctaacaaatctagtggtattgaaggaaacttgcagcacacgaaaccttgctcagtcaaaacagatcagttggccaaggtgaaagagagcgttgtagatacgttaactagtatcgggcggttccaagcagagctcgagacaatgaaacgtaaactagaagattcattgcaggaactcaactagggcgcgcc

SEQ ID NO: 199 - DNA, 870 bp, Arabidopsis thaliana
ttaattaactttggcttttctcctcctgttctcatggaagcttcacccaatgatcgacttcattttggcaaaatgggtttcgggtgtaagcattacaagaggagatgccaaatcagagctccatgttgcaacgaagtcttcgattgtcgccattgtcacaacgagagcactagcacattgcgcaatatctacgaccgtcacgatcttgttcgtcaagacgttaaacaagtgatttgttctgtttgcgatacagagcagccggcagctcaagtttgttcgaattgtggtgtcaacatgggagaatatttttgcagcatctgcatattctatgatgatgatactgaaaaacaacagtttcattgcgatgactgtggaatttgcagagttggtgggcgtgagaatttcttccattgcaagaagtgtggatcttgttatgcggttggtctgcgcaacaaccatcgctgcgttgagaattcaatgcgtcatcactgtcccatttgttacgagtacctttttgactctctaaaggacacaaatgtgatgaaatgcgggcacacaatgcacgtagaatgctacaacgagatgatcaaacgtgacaagttttgttgtccaatttgctcgaggtcagtgattgatatgtctaaaacatggcagagactcgatgaagagatcgaagccactgctatgccttcagattaccgtgacaagaaggtttggatactttgcaacgattgtaacgacacaacagaagtgcacttccacataatcggacagaaatgtggacattgcagatcatacaacacacgagcgattgcgcctcctgttcttcctcaatgacaaaaccaagatcttcccatgtattggcgcgcc

SEQ ID NO: 200 - DNA, 897 bp, Arabidopsis thaliana
ttaattaagttctccaaacgacaacttcgagccaaaacaatggcggctactacattgtacaattcctgtcttcttcaaccgaagtatggcttcaccactcgccgcctaaaccagtctctcgttaactctcttacgaacccaacaagagtttcggttttgtggaagagtcgtagagatgttattgcgaaagcttcgattgaaatggcggaatcgaattcgatatcttccgttgttgtcaattcctctggtcctatcatcgtgattgataattacgacagcttcacttacaatctctgccagtatatgggagagctagggtgccattttgaagtttaccgcaatgatgaacttacagttgaggagctgaaaagaaaaaagccaagaggattgttgatttctcctggacctggtacccctcaagactctgggatttccttgcaaactgttttggaactcggaccacttgttcctttatttggagtatgtatgggtttgcagtgtataggagaagcatttggaggaaagattgtgcggtcaccatttggtgttatgcatgggaaaagctcaatggttcactatgatgagaaaggagaagaaggcttgttctctggattatccaaccctttccttgtaggtagatatcacagtctcgtgatcgaaaaagattcatttcctagtgatgaactcgaggttacagcatggacagaagatggtctggttatggctgcccgtcacagaaagtacaagcatatacagggagttcaatttcatccggagagtattataacaaccgaaggcaagacaattgttcgcaatttcatcaaactcgtagagaaaaaggaatctgagaagctggcataggcttagcctgaatgagaaaatcagctgtggcgcgcc

SEQ ID NO: 201 - DNA, 812 bp, Saccharomyces cerevisiae
cagctttcaaactctttgtttcttgtttgttgattaacccttaattaagtgtaagaagattaagacaacggtggtataaactagtgtcgaagtccaaaatgcctagtcatcgcaattcaaacttgaagttttgcacagtttgtgcatcaaacaacaatcgttcaatggaatcgcataaagtcctgcaagaagcaggctataatgttagctcttacggaacaggttcagctgtgagactgcctggtctatcgatagataagcctaatgtgtactcatttggtacaccctataatgatatatataatgatcttttatcacaatcagcagaccgttacaagtcgaacggtttattgcaaatgctggatcgtaatagaagactcaaaaaagcacctgaaaaatggcaagaaagtacaaaagtcttcgacttcgttttcacttgtgaagagagatgttttgatgccgtttgtgaagatttgatgaatagaggtgggaaattaaacaaaatagtgcatgtaattaatgttgacattaaagatgatgatgaaaatgctaaaattggtagcaaagctatattggaattagctgatatgctcaatgataaaatagaacaatgtgaaaaagatgacattccctttgaagattgtataatggacattttaactgagtggcaaagctcacattctcaactaccgtcattatacgctccttcatattactaaacaaaacggtcaattactgtagaaaagcataagcattaagcgatttaaatacccagcaaattggagctctgcagagctttcgttcgtatcatc

SEQ ID NO: 202 - DNA, 1187 bp, Arabidopsis thaliana
ttaattaaagtggttggctgggctttcggtcaccatcttatgatatgcactgaacctatagttaaagacaacaagcttgttatctctgcagagagcatttcatatggcctgcagacgttgcatgatattcagaacgaaaacaagagtttaaagaagtctctcaaggatgttgttactgagaacgaatttgagaaaaaactgttgtcggatgtcattccacctagcgatataggtgtttcctttgatgatattggagctctggaaaatgtgaaagaaacgttgaaggagttggtgatgcttcctcttcagagaccggaattgtttgacaaaggccagctcacaaagcctacgaaaggtatactgttgtttggacctcctggtactggaaagacgatgctggcaaaagcagtagcaactgaggctggcgcaaatttcatcaatatctcaatgtccagcattacttcgaagtggtttggtgagggagagaagtacgttaaagctgtcttctccttagcgagcaagattgcgccaagtgtcatttttgttgatgaggttgatagcatgttgggtagacgtgaaaatccaggggaacatgaagctatgcgtaagatgaagaacgagttcatggtaaactgggatggtttaagaacaaaggatagagaacgggttctggtactcgctgccaccaacagaccatttgacctagacgaagctgttattagacggcttccccggagattgatggttaatcttccagatgcaacgaacagatcaaagatcttgagcgttattctagcaaaagaagaaatagcaccagacgtcgatttagaagctatagcaaatatgacagatgggtactcaggaagtgacttaaagaatctgtgtgtgaccgcagcacattttccaatccgagaaatactggagaaagaaaagaaggagaaaactgcagctcaggctgagaaccgtcccacaccgccattgtatagctgcacagatgttcgttccctgacaatgaacgatttcaaggctgcccatgatcaggtatgcgcaagtgtgtcttcagactcgtcgaacatgaacgaacttcagcaatggaacgagctgtatggtgaaggaggatcgaggaagaagacgtcgttgagctacttcatgtagaagagagacaaaagagagagggagggcgcgcc

SEQ ID NO: 203 - DNA, 1975 bp, Saccharomyces cerevisiae
ttcatttatttgtcagctttcaaactctttgtttcttgtttgttgattaacccttaattaagaacatttcaaaaggctatttcttctgaaatatcaagatggatatactcaagaggggaaatgaatcggacaagtttacgaaaatagagacagaatctactacgataccaaatgactcggatagatctggttcactgatcagaagaatgaaggattccttcaagcaaagtaacctgcatgtcattccagaagaccttgaaaacagcgaacagacagagcaggaaaaaatccaatggaaactagcttctcagccctatcaaaaagtcttgagccaaaggcacttgaccatgattgccataggtggtactttggggacgggactgttcattggtttaggttattctttggcatctgggccagccgctttgctaatcggttttttgttagttggtacttcaatgttctgtgtcgttcagagtgccgcagagctttcctgccaattcccggtttctggctcatatgccacacatgtcagtaggttcatagatgaatcggttggctttactgtggctacaaactatgctttggcttggctgatttcttttccaagcgaattaattggttgtgcacttactatttcatactggaaccaaacggttaatccggctgtttgggtggccattttttatgttttcattatggtactgaacttgtttggtgtgagaggctttgccgagactgagtttgctctgtcaatcattaaggttattgctatatttattttcatcattattggtatcgtccttattgccggaggggggcctaactctactggttatattggcgccaaatactggcacgacccaggtgccttcgcaaaacctgtcttcaagaatttgtgtaacacattcgtttctgctgctttttcctttggtggtagtgagttagtgctgttaactagtacagaatctaaaaatatttcagctatatcacgtgctgccaaaggtacgttctggagaatcgcgattttttacattactaccgttgtcattattggatgtctcgtaccttataacgaccccagactgctcagtggttcgaacagtgaggatgtatctgcctctccctttgttattgctttgagtaatacaggatcaatgggtgcaaaagtttccaactttatgaatgtcgttatccttgttgcggttgtgtcagtttgcaattcttgcgtttatgcttcttcaagactaattcaagctttaggtgcatctggccaacttccttcggtatgttcctacatggacagaaagggtaggcctttggttggcattgggattagtggtgcatttggtcttttaggttttcttgtggcctcgaaaaaggaggacgaggtcttcacttggcttttcgccctttgttccatttcatcattcttcacctggttctgtatttgtatgtcacaaattagatttaggatggctttgaaagctcaaggaagatccaatgacgaaatagcttacaaatccatactgggtgtttatggtggaattttggggtgtgtgctaaatgcattgctaattgcgggtgaaatatacgtatcggccgccccggtcggtagccctagctccgctgaagccttctttgaatactgtttaagtattccaatcatgattgttgtttattttgcacataggttttatcgaagagattggaaacacttctacatcaagaggagtgagatcgatctggatactgggtgttccgtggagaatctagagcttttcaaagcacaaaaagaagctgaggaacaactcattgcttctaagccattctattacaaaatctacagattttggtgttagatggtactcttgcatatgtaacctttaataaattttgcaaatcgaatatttaaatacccagcaaattggagctctgcagagctttcgttcgtatcatcggtttcgacaacgtt

SEQ ID NO: 204 - DNA, 1442 bp, Saccharomyces cerevisiae
tttatttgtcagctttcaaactctttgtttcttgtttgttgattaacccttaattaatccgggcgcgcctgatttatcacaagtttgtacaaaaaagcaggctcctgcaggaccatggctggcgacaaccctgaaaacaaggatgcttccatgttagatgtcagtgacgcagctagcaacactacgattaatggtaaacatagcgccgattcaactaatgaggcttccctggcgtacactttttctcaaatgaacgtagataatcctaatgaattagagcctcagcatcctttaagacataaatcgagtttaatttttaacgacgatgatgacgatgaaatacctccatattcaaaccatgcggaaaatggttctggggagacctttgattctgatgatgatatcgatgctagcagctcgagtagtatcgacagcaacgaaggcgatatccacgatgcagatatgacaggaaataccttgcaaaaaatggattatcaaccatctcagcagcctgactcacttcaaaatcaaggctttcaacagcaacaagaacagcaacagggcactgtggaaggcaagaaaggaagagctatgatgtttccagttgacatcacttggcaacaggggggtaataaagtgtacgttactgggtcttttacgggatggagaaagatgatcgggttagtaccagtccctggacagcctggacttatgcatgtaaaattacagctgcctccaggtactcatcgtttcagatttattgttgacaatgagttaagattcagtgattatttacctaccgcaaccgaccaaatgggaaacttcgtcaactatatggaagtgagcgcaccgcctgattggggcaatgaacctcagcagcatctggctgaaaaaaaagcgaatcatgtagatgatagcaaattgagtaagagacctatgagcgctcgctcgagaatcgcattggagatagaaaaggaaccagatgacatgggcgatggttacactcgttttcacgatgagacccccgctaaacctaatttagagtacactcaagatatacctgctgtgttcaccgacccaaatgtaatggaacaatattatttgacacttgatcagcagcaaaataatcaccaaaatatggcctggttgactcctccacaactgccacctcatttagaaaacgtcattttgaatagttactcaaacgcgcaaactgataatacgtctggcgcccttcccattccgaaccatgttatattgaaccatctggcgacaagcagtattaagcataatacattatgtgtcgcatccattgttaggtataaacaaaaatacgtgacccaaatactgtatacaccattgcaatagctcgagacccagctttcttgtacaaagtggtgataaattggagctctgcagagctttcgttcgtatcatcggtt

SEQ ID NO: 205 - DNA, 1256 bp, Synechocystis sp. PCC 6803
aactctttgtttcttgtttgttgattaacccttaattaatccgggcgcgcctgatttatcacaagtttgtacaaaaaagcaggctcctgcaggaccatggccgttagtgagattcatattcctaactctttactagaccgggattgcaccaccctttcacgccacgtactccaacaactgaatagctttggggccgatgcccaggatttgagtgccatcatgaaccgcattgccctagcgggaaaactgattgcccgtcgcctgagtcgagctgggttaatggccgatgtgttgggcttcactggggaaaccaacgtccagggggaatcggtgaaaaaaatggacgtatttgccaatgatgtttttatttctgtctttaagcaaagtggcttggtttgtcgtctggcttcggaggagatggaaaaaccctactatattcctgaaaattgccccattggtcgctatactttgctgtacgacccgattgatggttcctccaacgtggacattaacctcaacgtgggttccatttttgccattcggcaacaggaaggggacgatctagacggcagtgcgtcagatttattggctaacggagacaagcaaattgctgctggttatatcctctacggcccctccaccatcctggtttattccctcggctccggagtgcatagctttatcctcgatcccagtttgggggaatttattttagcccaggaaaatatccgcattcccaaccacggccccatttacagcaccaatgaaggtaacttttggcaatgggatgaagccctgagggattacacccgttacgtccatcgccacgaaggttacactgcccgttatagcggtgctctggtgggggatattcaccggattttgatgcaagggggagtgtttctttatcctggtacggaaaaaaatcccgacggcaaattgcgtttgctctatgaaactgcgccgctggcctttttggtggaacaggctgggggaagggctagtgacggccaaaaacgtttactggacttaattccttctaaattacatcagcgtacccccgccattattggcagcgcagaagatgtgaaattggtggaatctttcatcagcgaccacaaacaacggcagggtaattagtttacttaatcactgcaaatcgtttgaggtctaggaacgtcttctcgagacccgctttcttgtacaaagtggtgataaattggagctctgcagagctttcgttcgtatcatcggtt

SEQ ID NO: 206 - DNA, 1651 bp, Pseudomonas fluorescens PfO-1
aaactctttgtttcttgtttgttgattaacccttaattaatccgggcgcgcctgatttatcacaagtttgtacaaaaaagcaggctcctgcaggatcatgacgctcgcacgcttccagatgtgcatcggcggagaatgggtcgacgccctctccggcaagactttcgaaagcctcaacccggcgctggccgaaccctgggccgaattgcccgacgctgacgaggccgacgtcgagcgcgccgtgcaagccgcgcagaccgccttcgacagcccggcctggcgtggtttgaccgcaaccgcgcgcggcaaactgttacgtcggctcggtgacctgatcgccgaaaacaaggaacaactggcgcaactggaaagccgtgacaacggcaaactgatccgcgaaacccgcggtcaggtcggttatctgccggagtttttccactacaccgccggcctcgccgacaagctcgaaggcggcaccctgccgctggataagcccgatctgttcgcctacaccgtgcacgaagccatgggtgtggtcgccgcgattattccctggaacagcccgctttacctgaccgcgatcaaactggcaccggcgctggctgccggcaataccattgtgatcaagccgtccgagcatgcctcggcaaccattctggaactggcgcgcctggccctcgaagccgggattccgccgggcgtggtcaacgtcgtcaccggctacggcccgagcaccggcgccgccctcacccgtcatccgctggtccgcaagatcgccttcaccggcggcgcggccacggcccggcacgttgtgcgcagcagcgccgagaacttcgccaagctgtcgctggaactgggcggcaaatcgccgaacatcatcttcgccgacgccgatctcgacagcgcgatcaacggcgccatcgccgggatctatgccgcatccgggcagagctgcgtatccggttcgcgactgctggtgcaggacgacatctacgacgagttcgtcagccgactggtggagcgcgcccagcgcatccgcatcggcaacccgcaggacgacagcagcgaaatgggcccgatggccaccgcgcaacaactggcagtggttgaaggtctggtggctgatgccatcgctgaaggcgcacgcctgcgcctgggtggcaagcgtccgagtggcgtcggtgacggttggttctacgaaccgacgctgttcgaatgcgaccgcaattcgatgaagatcatgcaggaagaagtgttcggcccggtggcctcggtgatccgtttcaaggatgaagccgaagcgctggcgattgccaacgactcgcagttcggcctcgccgccggcatctggacccgcgatctgggccgcgcccatcgcctggcccgggacgtgcgttcggggatcatctgggtcaacacctaccgcgcggtgtcggccatggcaccgatcggcggcttcaagaacagtggctatggacgcgaaagcggcatcgattcggtgctggcctacaccgaactgaaaacggtgtggatcaacctctcccaggcaccgatgcctgatccgtttgtgatgcgttagctcgagacccagctttcttgtacaaagtggtgataaattggagctctgcagagctttcgttcgtatcatcgg

SEQ ID NO: 207 - DNA, 1413 bp, Sinorhizobium meliloti
cagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgactccgcgaaaatccgcgtccgtttccagccgcaagaccgctgccaagccggccaagaaagattttgccggcggcacgatcgccgaattctccaaggaagacgatctcaaggcctaccgggaaatgctgttgatccggcgtttcgaggaaaaggccggccagctctacggcatgggattcatcggtggtttctgtcacctctatatcggtcaggaagccgtcgtcgtcgggatgcagctggcgctgaaagagggcgaccaggtcatcaccggctatcgcgaccatggccatatgctcgcctgcggcatgagtgcgcgcggcgtgatggcggagctcaccgggcgccgtggcggtctttccaaggggaagggcggctctatgcacatgttctccaaggaaaagcatttctatggcgggcacggcatcgtcggtgcacaggtctcgctcgggaccggcctcgctttcgccaacagataccgcggcaacgacaatgtaagcctcgcctatttcggcgacggtgccgccaaccagggtcaggtctatgagagcttcaacatggccgctctctggaaactgccggtgatctacatcgtcgagaacaaccgttatgccatgggtacctccgtgtcgcgggcatcggcgcagaccgatttctcccagcgcggcgcttccttcggcattcccggctatcaggtcgacggcatggatgtccgcgccgtcaaggccgcagccgacgaggcggtcgaacattgccgttccggcaagggcccgatcatcctcgaaatgctgacctaccgctatcgcggccattccatgtccgatccggcgaagtatcgctcgaaggatgaagtgcagaagatgcgttcggagcatgatccgatcgagcaggtgaaggcccgcctgacggataaaggctgggccaccgaggacgaactgaagcagatcgacaaggaggttcgcgacatcgttgcggacagtgccgatttcgcccagtctgatccggagccggatgtctccgagctctataccgatatcctgctttgatccggggagggacaaacatgcctgtagaaatccttatgcctgccctattta

SEQ ID NO: 208 - DNA, 1951 bp, Xenorhabdus nematophilus
tcagctttcaaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtgagtgaaataaccttgctaaagcccgttacggattttctgcaacgtcctcatggtcattatatcaacgggttatccattcctggtcagggaaacaacaccttttctgtcgttaatcctgcttctgatgaagtgatcgctaaagttaatcgaggagaggaagccgaaataaatttggcaatggaagcagcctcgaaggcttttcatggttcatgggcgcagacatcgcctatggagcggggtaagtgcctgaaccggctggccgatttattgcaaaaacacggtgaagaattagcccagctggaaagtttatgttcaggtaaaccgatccagcttgctcgaatgttagacgtgggcgcttctgctgattacctgcgttattttgctggttggtcgagcaaaattagtggtgagacattgaatgtttcattgccatcactcaaaggggaaaaatacacggcctttacccgacgtgaaccaattggcgtggtggttggcattattccgtggaatttttccattatgattgctatctggaaactgggggcggcactggcctgtggttgtactttagtactgaaacccagtgagtatacccctttgactatgcttcgtgtggcagaattggcgaaagaagccgggatacccgatggcgtgatcaatgttgtcaatggttctggcgctagagttgggtcagccctgctcgctcatcccaaatgtgccaaagtcacttttactggctcagtcccgaccggcactattatcggtaagtcggcgatagagtatggcttgactcgtgcgacgctggaattgggaggcaagaatgcggctgctttcctgtctgatatgtcagttgaaaagattgttgagggtgtgttggaagccggttatttgaatcaggggcaaatctgtgcggcagcggaacgtttctatatcccatctgttcacatggatgcggtcttaaaattactttctgaacgtttgtcagcgatgaaaatcggctctcctcttgatgaatcaaccgaaatggggcctttggcaaacaaagagcattacgaaaaaatcctgtccctgtttgaaaaagcgcgtcaggatggcagtgagatcgtatatggtggccatgcgctggaaggcgaaggtttttttgtcgcaccaacgattatccgagccaagagtgctgaagacacattaatgcaagaagaaaccttcgggccgataggaacgttcctcagctatgatgatgaagaagaattaattgtcatgatgaacgcgacgccatttggtctgtctgccagtttatggacgaatgatctcagtaaggcgatgcgtatgatcccccgcattcaagtgggtactttgtggattaatatgcatacatttctggatccagcggtgccttttggtggcgtgaagtcgtcgggcattggccgggagtttggtagtgcatttattgagcattacaccgaactgaaatcggttatggttcgttattaatcacgcattattacagcttattttcgtgatttattttcagcttgtgactcgagacccagctttcaaatacccagcaaattggagctctgcagagctttcgttcgtatcatcggtttcgacaacgttcgtcaagttcaa

SEQ ID NO: 209 - DNA, 1728 bp, Synechocystis sp. PCC 6803
tttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgggtaagaatctcctcgaacaactgcgccaatttacagtggtggtggccgacaccggcgacatccaagccattgaaacctttacccccagggattccaccactaatccttctttgattacggcggcggcccagatgccccagtaccaggaaattgtggacagcaccctgctcaaagctaaggacgaagctggggaaaatgcatctattaaagacattgtccgattggcctttgaccgtttggcggtggcttttggcctcaaaattctgcaaattatccccggccgggtttctacggaagttgatgcccgcctttcctacgacacggaagccaccattgccaaagctcgctacctaattggggaatatgccaaagctggcattgataaaaaacgcattctgatcaaaattgcttccacttgggagggtattaaggctgcagaagtattggaacaagaaggtattcactgtaaccttactctactattcggtctccaccaggcgatcgcctgtgccgaagccaaagtcaccctaatttccccctttgtgggacgcattttggattggtacaaaaaaagtactggcaaggaatatgacagccacgaagacccaggggtacagtctgttacaaccatttacaactactacaaacgctttggttacaaaactgaagtgatgggagccagcttccgtaacattggcgaaatcatcgaactggccggctgtgacctgttgaccatttccccccaactgttggatcaactgcggaacaccgaaggggatttacctcgcaaactcgaccccgccacggtgccccaggacattgaaaaaattgttatggacaaggccaccttcgacaaaatgcatgccgaagatccgatggcctcggaaaaactggccgaaggcattgccggtttcaccaaggctctggaggtgttggaacatttattggaagaaaggttaaaagttctcgatggccaagagcacatcaaacatggggcagaggaaattttccatgcctatgatctagatggggacggttttattaccagggaggaatgggccggcaccgatgtggtttttgatgccctagaccgggaccatgatggcaaaatcaccgccgctgaaatgtccgctgggttgggagccgctttccgtttagcctctgttggttaggtgttctcagggcccagcccttaaaagtattggggaaaacatattaaatacccagcttgatgccctagaccgggaccatgatggcaaaatcaccgccgctgaaatgtccgctgggttgggagccgctttccgtttagcctctgttggttaggtgttctcagggcccagcccttaaaagtatggggaaaaccatatttaaatacccagcaaatacccagcaaattggagctctgcagagctttcgttcgtatcatc

SEQ ID NO: 210 - DNA, 610 bp, Arabidopsis thaliana
ttaattaaatggatctttcgcctgttaaggaagctttggccgccaaatcctttgacaaaatcgccgatatctgcgatactctcatgcttcaggttgcttccgaaggaattgaatatcatgatgattggccttacgcaatccatcttctgggttacttttacgttgacgattgtgatagcgcacgtttcctctggaaaaggatacctacagctatcaaggagaggaagcctgaagttgttgcagcttgggggattggtcagaagctgtggacacacgactatgcaggtgtatatgaagctattcggggttatgattggagtcaagaagctaaagatatggttgctgccttctcagatctttacacaaaaaggatgtttcagcttttgttgtctgcctactccacaattaccatccatgatttagctcttttcctagggatgacggaggatgatgccacaacttatgttgtagagaatggatggacagtggatgcagcttctcaaatggcgagtgtgaagaaacaagctgttaaaagagagcaaaaggtggattcatcgaagctacaacgcttgacggagtatgtgttccaccttgaacattaaggcgcgcc

SEQ ID NO: 211 - DNA, 2064 bp, Arabidopsis thaliana
ctattccactcccactaaacattccttctctcgctcactcttctccaatccttattttattttttgaaagtttaaaattttatacaacatatcaatttggggtagaaaaattcgaaagaaatgaaagagatgggagtgatagtgcttcttctccttcactcgttcttctacgttgccttttgcttcaatgatggtaaatccctcgttctttatcttttccgtagaaatctcgcattttcgtatcttgtctatatactagccaaaccaacaaaagaaactcgtagtgagttccaacaatattctagtatttaagaaattcgtgttataaaaatttgtacagcttcttataacttgtgtgtccaaaattttgtttgtcgtcaaaataattcatttatattgcaccacaaatcatgaagaatgacctattagcttgacgaacatgttgaacactacgccgagacagatctgtaaatgcacatggtgtttagtcaatcgttttcaataaatgtgtcactaaattaccctcaccttcccatctgtaactaacctttttaatcatttaaatatttcatacttccaactttttattcaattattatacactgatcacttgtttattcatatacagatctaaaatagcaagattgagaatttgtttacctagaatcactgtcaattttaggtgactagatgcagttgaagttcaaatattattgtcagcaaatcactatcgtttaaatcaaatttcacaacaaatccctaactagttttgtttttgtaacttgattacattaacaaaacaaaacaggactactaccaaacggtgacttcgaactcggtccacgacattcggacatgaaaggaacacaagttatcaacataacagcaatcccaaactgggaactctcaggctttgtcgagtacattccctcaggacacaaacaaggcgacatgatccttgtcgtgcctaaaggcgcattcgcagtacgtctaggcaacgaagcctcaatcaaacaaaaaatcagcgttaagaaagggtcgtactattcgataacgttcagtgctgctcgaacatgcgcacaagacgagcggttaaacgtttccgtggctcctcaccatgcagtgatgccgatacaaacagtgtatagtagctcaggttgggatttgtattcgtgggcttttaaggcccaaagtgactatgcagatatagtgatacataatccaggtgttgaggaagatcctgcttgtggacctctcattgatggtgttgctatgcgagcccttttccctcctcgtcccaccaatagtgagtgctcttttcttatacttaatttggggtctcgtttgaataaaaatattcttaatggggcaaatacggaaatatctaaaacatgttgggtttatttttgttttgcagagaacattctaaagaacggaggattcgaagaaggtccttgggttttaccaaacatatcatctggtgttttgattccaccaaactccatcgacgatcactctccgttacctggttggatggtcgagtctcttaaagctgtcaaatacatagattccgatcatttctccgttcctcaaggccgtcgcgccgtcgaactcgtcgccgggaaagaaagcgccgtcgcacaagttgtccgcactatccctggaaaaacctacgtcctatccttctctgtcggagatgctagcaacgcttgcgccggatcaatgatcgtcgaagctttcgccggaaaagacacgatcaaggtcccgtatgaatcgaaagggaaaggaggattcaagcgatcgtcattgagattcgtcgctgtctcgagtcggactagagttatgttctacagtacgttttacgcgatgagaaacgacgatttctcgagcttatgtggaccggtgatcgacgacgttaagcttctcagtgctcggaggccgtgagcttgcggcgacgagttgattcacgggacaatgaatgatgacagtcactgtgggtttctcgcgtctagtgagaaattgggcttttaggcccagtggcccactgtttttgttgttgtttta

SEQ ID NO: 212 - DNA, 927 bp, Arabidopsis thaliana
atggcgtcgtggatgaaagcggtgctaatctctactggcgtcgtagccacggctatgcatctaaaggttattgttcctgtggctatggatttctcacaaaatccgattattttgagctctttcctcacgtggctgaaaccgccgtatctttacgtcatcactaacgtcatcatcatcgttgtcggagtttcctaccggattactactgtctccagccacgtcgacggcaaagactatgaggcttcttacagtggcgacaataagtttcagactgatcatcagcagatcgtccaagaagctcctctaaggcgacgaacggagacgaaagatgcggattttggtttcatcggcaaagttttgcagatcgttaaggagccggaggttgtgtatgaagagaaggagaggccggcgacggtagaggaggaggagaagaagtgtataattgtggtgagcaaatcggaaaatcaacctccggtggagaagcctcttgttacggctaggatcggccaaaagaaaccggtggttaagactacaccagcagaaaggaattctatgagagcgttgagagttgcgaaaccgaaacgtaacgagacgttagagaatacgtggaagatgattatggaaggcaacaagtcaacgcttccgttgaccagttattacaagagacccgacacgttcggacttggcgaagagacaaaacaatcaggtgttttgaagaaatcggagacgtttagtgacagaactaactgttaccagtctctgccgccgccacctccgccgctagtgaaggtgaagaaggtgaaagtgtcacggagtagggatgagcttaaccggaaagtagaagcgtttataaaaaaatgcaacgacgagaggttcgcgtcgatgaaactggacaacgaagtggctcgtcatggtctttcttattaa

SEQ ID NO: 213 - DNA, 768 bp, Arabidopsis thaliana
atggaagcaggtggcgcgtacaatccacgcactgttgaagaggtgtttagggattttaagggtcgtagagctggcatgattaaggctttaaccactgatgttcaggagtttttccgactttgtgatcccgaaaaggagaacctttgcctttacggacatccaaatgagcactgggaagtgaatttgccagctgaagaggttcctcctgagctcccagagcctgtcttgggtatcaattttgccagagacgggatggcggaaaaggattggttgtcccttgttgctgtccacagtgatgcttggcttcttgctgttgctttcttttttggagccaggtttggatttgacaaagctgataggaagaggcttttcaatatggtgaatgacctcccaacaatctttgaggttgtagctggcactgctaagaaacaaggaaaagataagtcctctgtttccaacaacagcagcaacagatccaaatcaagctccaagcgaggatctgaatcccgtgccaagttctcaaagccggagccgaaagatgatgaggaggaggaagaggaaggtgtggaagaggaggatgaggatgagcaaggtgaaacacagtgtggagcatgtggtgagagctatgcagctgatgagttctggatttgctgtgacctctgtgagatgtggtttcatggaaagtgtgttaagataacaccagcaagagctgagcacatcaagcaatacaagtgcccttcttgcagcaacaaaagggctcgttcctaa

SEQ ID NO: 214 - DNA, 915 bp, Arabidopsis thaliana
atgcccttagaggctgtcgtatacccgcaagatccattcggatatctctccaattgcaaagattttatgttccacgacttatactctcaagaagagttcgtagctcaagatacgaagaacaacattgataagttagggcatgaacagagctttgtggaacaaggtaaggaggacgatcatcaatggcgagactatcatcagtatcctttgttgatcccttcgttgggagaagagcttggtcttaccgccattgatgtggagagtcatcctcctccacagcaccggaggaagaggaggagaacgagaaactgcaagaacaaggaagagatcgagaaccagagaatgactcacatcgccgtcgagagaaatcgccggaaacagatgaacgagtatctggctgtgctccgttctctaatgccgtcgtcgtatgctcaaagaggagatcaagcgtcgatagtaggaggagctataaactacgtgaaggagttagagcatattttacaatctatggagccgaagagaactaggactcatgatcccaaaggagacaagactagcactagctcgttagtgggtccattcacagattttttcagcttcccacaatattctacaaagtcatcatcagatgtaccggaaagctcatcttcaccggcggagatagaggttacggtggcagaaagccatgcgaacatcaagataatgacgaagaagaaaccgaggcagcttcttaagctcataacttctttacaaagcctaaggctcactcttcttcatctcaatgtcaccactctccacaactccattctctactccatcagcgtcagggttgaagaaggaagccaactgaataccgtggacgacattgcaacagctttgaatcaaaccataaggaggattcaagaagagacataa

SEQ ID NO: 215 - DNA, 1047 bp, Arabidopsis thaliana
atggagaaagcagagaacgagaagaagccatcggctgtatctgacgtcggagcatgggctatgaacgtaacgagctccgttgggatcatcatggctaataaacaactaatgtcatcatctggattcggcttcagcttcgcgacaactctcacgggatttcactttgctcttactgctctcgttggtatggtgtcgaatgcgactggtttatcagcatctaagcatgttcctctttgggagcttctttggttctcactcgttgctaatatctcaatcgctgctatgaattttagtcttatgttgaactctgttggcttctaccagatatcgaaattgagcatgattccagttgtttgtgtgatggaatgggttctacatagtaagcattactcgagagaagtgaaggcatctgtcatggttgttgttgtaggagttgggatttgtactgttactgatgtcaaagttaatgccaaaggtttcatttgtgcttgcactgccgttttctccacttctctccagcagatctcaataggttcactgcagaagaaatactcgatcggatcattcgagttgctgagtaagacagctccaatccaagccatttcactcctcatctttggtccatttgttgactatttcttgagtggcagattcatttcgacttacaagatgacttatagcgcaatgttatgcattcttctctcctgcgcattggcggttttctgcaacataagccaatatctctgcatcggaagattctctgctacctcattccaagttcttggccacatgaaaacagtctgtgtcttaacattaggatggcttatctttgattcggagatgacattcaagaacatagcagggatggtcttagccgtggtgggaatggtgatatacagttgggcagtcgagttagagaaacagagaaagtcgaaagtgataccgcatggtaaacacagtatgacagaagatgagattaaacttctcaaagaaggtatagaacatatggatttgaaagacatggagcttggaaataataaagcataa

SEQ ID NO: 216 - DNA, 1110 bp, Arabidopsis thaliana
atgtcgaagataaccttagggaacgagtcaatagttgggtctttgactccatcgaataagaaatcgtacaaagtgacgaataggattcaggaagggaagaaacctttgtatgctgttgttttcaacttccttgatgctcgtttcttcgatgtcttcgttaccgctggtggaaatcggattactctgtacaattgtctcggagatggtgccatatcagcattgcaatcctatgctgatgaagataaggaagagtcgttttacacggtaagttgggcgtgtggcgttaatgggaacccatatgttgcggctggaggagtaaaaggtataatccgagtcattgacgtcaacagtgaaacgattcataagagtcttgtgggtcatggagattcagtgaacgaaatcaggacacaacctttaaaacctcaacttgtgattactgctagcaaggatgaatctgttcgtttgtggaatgttgaaactgggatatgtattttgatatttgctggagctggaggtcatcgctatgaagttctaagtgtggattttcatccgtctgatatttaccgctttgctagttgtggtatggacaccactattaaaatatggtcaatgaaagagttttggacgtacgtcgagaagtcattcacatggactgatgatccatcaaaattccccacaaaatttgtccaattccctgtatttacagcttccattcatacaaattatgtagattgtaaccgttggtttggtgattttatcctctcaaagagtgtggacaacgagatcctgttgtgggaaccacaactgaaagagaattctcctggcgagggagcttcagatgttctattaagatacccggttccaatgtgtgatatttggtttatcaagttttcttgtgacctccatttaagttctgttgcgataggtaatcaggaaggaaaggtttatgtctgggatttgaaaagttgccctcctgttttgattacaaagttatcacacaatcaatcaaagtctgtaatcaggcaaacagccatgtctgtcgatggaagcacgattcttgcttgctgcgaggacgggactatatggcgctgggacgtgattaccaagtag

SEQ ID NO: 217 - DNA, 1074 bp, Arabidopsis thaliana
atgatgaacgttaaaccaatggagcagatcatgattcctaataacaacacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcatcttcatcttcttcatcaaacatccttcagacaataccatcttcacttccagatctaaacccgccaatactcttctcaaaccaaatccataataaatcgaaagggtcatcacaagatctcaacttgttgtctttcccagtcatgcaagatcaacatcatcatcatgtccatatgtctcagtttcttcagatgcctaagatggagggaaatggtaacataactcatcagcagcagccttcatcatcttcttctgtctatggttcctcgtcgtctcctgtttcagctcttgaacttttaagaaccggagttaatgtttcttcaagatcagggattaactcatcgttcatgccttccggttcaatgatggattcaaacactgtgctttacacttcttcagggtttccaacaatggtggattacaagccaagtaatctctccttctctaccgatcatcaagggcttggacacaatagcaacaataggtctgaagctcttcatagtgatcatcaccaacaaggtagagttttgtttccatttggggatcaaatgaaggagctttcatcaagcataacacaagaagttgatcatgatgataatcaacaacagaagagtcatggaaataataataataataataactcaagccctaataatggatattggagtgggatgttcagtactacaggaggaggatcttcatggtga

SEQ ID NO: 218 - DNA, 1170 bp, Glycine max
ttaattaatccatcgatcaagcatggagtccgaactcaaagacctcaattcgaagccgccgaacggcaacggcaacagcgttcgcgatgaccgtcctctgctgaagccggagcctccggtctccgccgacagcatcgccgatatggagaagaagttcgccgcttacgtccgccgcgacgtgtacggcaccatgggacgcggcgagttgccgaccaaggagaagctcttgctcggtttcgcgttggtcactcttctccccattcgagtcgttctcgccgtcaccatattgctcttttattacttaatttgtagggtttgcactctcttctctgcgcccactggcgaagaggaacaggaagattacgctcacatcagtgggtggaggagaaccattattgtttcgtgtggacgcgccctctccagactcatgcttttcattttcggcttttattggatccccgaatcgaactctgcctctcaggaagacaagagtcggcagcccgaagagttgaggagacctggcgtaataatttctaatcatgtgtcgtacttggatattttgtatcacatgtcttcctcattccctagttttgttgctaagagatcagtggctaaacttccgctagtcggtctcatcagcaagtgccttggttgtgtctatgttcagcgggaatcaaggtcatcagacttcaagggtgtttcagctgttgtcactgacagaattcgagaagctcatcagaatgagtctgctccattaatgatgttatttccagaaggtacaaccacaaatggagagttcctccttccattcaagactggtggttttttggcaaaggcaccggtacttcctgtgatattacaatatcattaccagagatttagccctgcctgggattccatatctggagtgcgccatgtgatatttctcctgtgtcagtttgtgaattatatggaggtgatccgattacctgtttaccatccttcacagcaggagatggatgatcccaaactatacgctaataatgttagaaggttgatggctactgagggtaatttgatactttctgatattgggctagctgaaaaacgaatatatcacgctgctcttaatggtttgttttcccaatgctaattcatcggattcgtggtctgtatattcattatttaaat

SEQ ID NO: 219 - DNA, 1598 bp, Arabidopsis thaliana
tttaattaaatgaccggaggaggatttgcgacttcggcgaacggagtagagtttgaggcaaagataactccaatagtcatcatatcttgcatcatggctgctaccggcggcctcatgtttggttacgacgtcggtgtctccggcggagtgacatcgatgccggactttctcgaaaagttttttcccgtggtttatcggaaagtagtagctggcgccgacaaagacagcaactactgcaaatacgacaaccaaggactacaacttttcacatcatctttatacttagccggtctaaccgcaacgttctttgcttcatacacgacaagaacgctcggaaggaggctaactatgctcatagccggcgttttcttcatcataggtgtggctctcaacgcgggggctcaagacctagccatgcttattgcaggcaggatattgcttggttgtggagttgggttcgctaatcaagccgttccgttgttcttgtcggagattgcacctactaggatccgtggtggtcttaatattctctttcagcttaacgtcactattggtatcctcttcgccaatcttgtcaactatgggaccgccaagattaaaggaggttggggatggaggttatcgttaggtttggcgggaattcccgcgcttcttctaacggtcggagctttattggtgacagagacaccaaacagtttagtcgaaagaggtcgtctcgatgaaggtaaagctgttcttcgtcgtattcgagggaccgataatgttgaaccagagttcgctgatctccttgaagctagtcgacttgctaaagaagttaaacacccttttagaaaccttcttcaacgtagaaaccgtcctcagctcgtcatcgccgtcgctttacagattttccagcaatgtactggaatcaacgcgattatgttctacgcgcctgttctgttcagcacattagggtttggtagtgacgcttcactttactcagcagtggtgaccggagcagtcaacgtcctctcaactttagtctcaatctactccgttgacaaagtcggtcgccgagttcttctcctagaagctggtgtccaaatgttcttctctcaagtcgtaatcgccattatccttggcgtcaaagtaacagacacttctacaaatctctccaaaggtttcgcaattctagtcgtggtaatgatctgcacatacgtcgctgctttcgcctggtcttggggaccgctcgggtggttaatccctagtgagacattccctctagagacacgttccgcgggacaaagtgtaacggtctgcgttaacttgctcttcacgttcattatcgctcaagctttcctctctatgctttgccatttcaagtttgggatattcatcttcttttctgcatgggttttgattatgtctgtctttgtgatgttcctacttccggagactaagaatattcctatcgaggagatgactgagagagtttggaagaagcattggttctgggctaggttcatggatgatcataatgatcacgagttcgtgaatggtgagaagagtaatggtaaatctaatggctttgatccttcaacacggctttaaatttaaat

SEQ ID NO: 220 - DNA, 1464 bp, Arabidopsis thaliana
ttaattaaatggatacggctcagtggccacaggtactatacacaaacatttacatatttatatattcgtacaattcaatatgtatgtgttgatgtagtttagatcatctgatttatctatctactagatcttgacttagaattttaatgttttcggatcttcttctttttgatgttactcttctcttcaacagtttttagatcttctcctttaattttaaatatatggttttttttttcactttaccctttattaatttgctttttcttttatgtttttagttaaagcttctctcaaatatctcaattatcattttgatcttgatgaaaatccattaatttgttgatagacagtacatatatatgtcaattatgtcttctatacttgtatataggcaaaggtttttgtgctaacgtttggaagagatgtatttttttattttgatgatcaggagattgtagtgaagcccttggaagaaatagtaacaaacacatgcccaaagccgcaaccgcaaccgcttcaaccgcagcagccaccgtcggtgggtggagagaggaaggcaaggccagaaaaggatcaagctgtaaactgtccgagatgtaactcaaccaacacaaagttttgttactacaacaattatagtttgacgcagccaagatacttctgcaaaggttgtagaaggtattggaccgaaggcggttcgcttaggaacattcctgttggcggtggctcaagaaagaacaagagatctcactcttcttcttctgatattagtaacaatcactcggattctacacaaccagctacaaagaagcatctctctgatcatcaccaccacctcatgagcatgtctcaacaaggtttgaccggtcaaaaccctaaattccttgagacgacccaacaagatctcaatttaggtttttcaccacatgggatgattaggaccaacttcactgacctcatccacaacattggcaacaacaccaacaagagcaacaacaataacaatccattgattgtttcttcatgttctgccatggctacttcttctctggatctcataagaaacaatagtaacaatgggaattcttcaaattcttccttcatgggatttccagttcataatcaagatccagcatcaggagggttttcaatgcaagatcattacaagccttgcaacacaaacaccacactgctagggttttcattagatcatcatcataataatggatttcatggagggtttcaaggaggagaagaaggtggagaaggtggtgatgatgtgaatggaaggcacttgtttccttttgaggatttgaaattgccagtttcttcttcatcagcaacaattaatgtcgacattaatgaacatcagaagcgaggaagcggtagtgatgcagctgctacgtctggtgggtattggactgggatgttgagtggaggatcatggtgctaaggcgcgcc

SEQ ID NO: 221 - DNA, 2227 bp, Arabidopsis thaliana
ttaattaaatggagtttggatcttttcttgtgtccttagggacatcttttgttatcttcgtcattctcatgcttctcttcacctggctttctcgcaaatctggaaatgctcccatttattacccgaatcggatccttaaagggctggagccatgggaaggcacctccttgactcgaaacccttttgcttggatgcgtgaagctttgacttcctctgaacaagatgtcgttaacttatccggcgtcgatactgctgtccactttgtcttcttgagcactgttctggggatatttgcttgttccagtcttcttctcctaccaactctactgcctctagccgctacagacaacaacataaagaacacaaagaatgcgacagataccacaagcaaaggaacttttagccaacttgataatctatcaatggctaacatcacaaaaaaaagttcgaggctgtgggcgttcctaggagctgtttactggatatctttggtcacatatttcttcttgtggaaagcttataagcatgtctcttcattgagagctcaagctctgatgtctgctgatgtaaaacccgagcaattcgctattcttgttagggatatgcctgcaccacctgacgggcagacacagaaagagtttattgattcttatttcagagaaatataccctgagacattctacagatcgcttgtcgcaacagaaaacagcaaggttaataaaatatgggaaaaattggaaggttacaagaagaagcttgcgcgagcagaagcaatattagcagcaactaataaccgtcccacgaacaaaaccggcttctgtgggctagtcggtaaacaagtagacagcattgagtattacactgagctaatcaacgagtctgtagccaaactggaaacagagcagaaagcggttcttgctgagaagcagcaaaccgcagcagtggttttcttcacaaccagggttgctgctgcatcagcagctcagtctctgcactgccagatggttgataaatggactgtgaccgaagctcctgagccacggcagctcctatggcagaatctcaacatcaagctcttcagcagaataatccggcaatacttcatctacttctttgttgcagtgaccattctgttttacatgataccaatcgcgttcgtctctgccatcaccactcttaagaatcttcagaggattattccgttcataaagccggttgtggagataaccgccataagaaccgttttggagtctttccttcctcagattgcgctcattgttttcttggccatgttgccgaagcttctcttgtttctctccaaagccgaggggattccttcacagagccatgccattagggctgcttcagggaagtacttttacttctcggtctttaatgtcttcattggtgttacccttgctgggactttgttcaacacagtgaaggatatcgcgaaaaatcccaaactcgacatgattattaaccttttggctactagcctccctaagagcgcaactttcttcctgacctacgttgctctcaagttctttatcggttatggccttgagctgtctcggatcatacctttgataatcttccacctgaaaaagaagtatctctgcaaaaccgaagcggaggtcaaagaagcttggtacccgggagacttaagctatgcgactagggttcccggagacatgctcatcctcacaatcacgttctgctattcagtcattgctcctcttatcctcatattcggcatcacctactttggtttaggctggctagtcctcaggaatcaggcgttgaaagtgtacgttccatcatacgagagctatggaagaatgtggccgcatattcaccagcgcatactagcagcgttgtttctattccaagtggtaatgtttggctacttaggagccaagacattcttctacacggcccttgtgatccctctcattatcacctctctcatcttcggatatgtgtgccgccagaaattctacggagggttcgaacacacagctctcgaggtagcttgccgtgagctgaagcagagtccagacctagaggagattttcagagcatacattccgcatagcttgagctctcacaaaccagaagaacacgagttcaaaggcgcaatgtctcgttatcaagatttcaacgcaatagcaggcgtttaaaatttgaatccaatccccaaattatctcatagatttggcgcgcc

SEQ ID NO: 222 - DNA, 1009 bp, Arabidopsis thaliana
ttaattaaatgactatgcgatcatcttcaccttcgtcctcttcttcttattcactcgctttcacaagtttgagcaataggcttgagaccatcttcaagaaagcttcagagctttgcactctttgtgatatcgaagcctgcgttatctattacggaccagacggagaacttaagacatggcctaaggagaaagagaaagtgagagacattgctcttaggtatagtctattgaacgaagcattgagacgcaagaaaagcgttaatcttcatgggttcctgaacaagaagaagaacaagggtttgaagaatccgaacaagaagatgaagacgagtcttaagaacgtgaatattttaaagtatccactcgctgatcattaccctcccgaccaagtttctccactgattcagtccttggaactccatgtctctaaattccaagaaaggcttcgatttcttgagtcgcagaaacagaatcagacaaaaccggatcatcagagtttaacaccatcctctctgaatcattacacccaatctttgaaccctagccagttctcgctgtttatgtataaccatggagacaatactctgtctcagatcccagtctctgcatcaaatttcaatcaggattatttctcagcgttacttgaagaatctgagttgaagaatcagttaatgaagccggagatttgtggttatgatcagaatcagaacatgagcatgggtgacatcacaaacaacaaatttcaagatccttgcgtctcaaacaaagaagcggtacaagaatctgtcaacaactttgggttgaatcaattgatgtacaaggagttttatggttgtgatcaaaacatgtctatgggtaacatcaatagcaacagctttcaaaatccttgcgtctcaaacacacaacattactcggcggtagaagaatctgtgaagaacccctggttgaatcagttaatgcagaatgaactttacggttacggttatgcaggcttttgttaaggcgcgcc

SEQ ID NO: 223 - DNA, 2440 bp, Arabidopsis thaliana
ttaattaaatgccagcttctgaagatagaagagggaaatggaaaaggaagaagagaggggggttatcggcggcgaggaaaccgaaacaagaggaggaagatatggaggaagaagacgaagagaataacaacaacaacaacgaagaaatggatgacgttgaaaatgccgatgagcttcagcaaaacggcggcgcaactcccgatccgggacttggtattggcgaggtagttgaagattctggttcgcgcatctctgatttcccggcagtggttaagcgtgttgtgatccggccacacgcgtctgtaatggctgttgtggcggctgagagagctggtttgataggggagactagagggcaaggttcacttccagctctggagaacatttcgtttgggcaattgcaagcgttatctactgtacctgctgattctcttgatcttgagaggagtgatggatcgtcttcggcttatgttatctctccaccacctattatggatggagaaggagttgttaaacggtttggggatctggttcatgtcttgcctatgcattcagattggtttgcaccaaacacagtagatcgacttgaaaggcaagtggtgccacagtttttctctgggaaatcgccaaatcatacacccgaaagttatatggaattcaggaacgccattgtttccaaatatgtagagaaccctgaaaagacactgacgatttctgattgccaaggattggtagatggtgttgacattgaagattttgcacgagttttccgttttcttgatcactggggaataatcaattactgtgccactgcccagtcacatcctggccctttgagagatgtatcggatgtgagggaggacacaaatggcgaggtcaatgtgccgtctgctgctttaacatctattgatagtttgatcaaatttgacaagcccaactgtagacacaaggggggtgaagtctattcatccttgccaagtttggatggtgacagccctgacttggacatcagaattcgtgaacacctatgtgatagtcattgcaaccattgttctcgaccgcttccaactgtgtacttccaatcgcaaaagaagggggatatactcttatgctgtgattgttttcaccatggaagatttgttgttggacattcttgtcttgactttgtaagagtggatccaatgaaattttatggcgatcaagatggagacaattggactgatcaggaaactctcttgcttcttgaagctgtggaactctacaatgaaaattgggttcaaattgctgatcatgttggttccaagtcaaaagctcaatgcattcttcattttcttcgattacctgtggaggatggtctattagataatgttgaggtttctggtgtaactaatacggaaaaccctacaaatggatatgaccacaaaggaacagattcaaatggggatttacctggatattccgagcaaggttctgacactgagatcaagcttccatttgtgaagtctccgaatccggttatggcattggttgcatttttggcatcagctgttggacctcgagttgctgcgtcctgtgcccatgaatccctctcggttttatctgaggacgataggatgaaatctgagggaatgcaagggaaagaagccagcttgcttgatggagaaaatcaacagcaagatggagcacacaaaacatcaagccaaaacggagcagaagcgcagactccactgccacaggataaggttatggcagcatttagagccggtctatcagctgcagcaacaaaagcaaaattgtttgctgatcatgaggaacgcgaaatccagagactttctgctaatatcgttaatcaccagctgaagaggatggagctgaaattaaagcagttcgcagaaattgaaacactgttgatgaaagaatgcgaacaagtagagaaaacccgtcagagattttctgcagaacgggctcgtatgctctcagcaagatttggatctcctggaggaatctctccacagactaataatctccaaggcatgtctctatccacaggtggtaacaacatcaattctctcatgcatcagcaacatcagcaacaacaagcttccgcaacttctcaaccaagcataatcccaggattcagcaacaacccgcaagttcaagcacagatgcatttcatggcacgacaacaacaacaacaacaacaacaacaacaacaacaacagcaagctttctcgtttggcccgagattacctctcaatgcaatacagaccaatgcaggatcaacagcttcaccaaacgtcatgtttggcaacaaccaactaaataaccctgcagcagctggagcagcatcgatcaaccagccttcgtttagtcacccgatggttaggtcttccacaggttcaggctcagggtccggcttaggcttaaactaaggcgcgcc

SEQ ID NO: 224 - DNA, 1615 bp, Arabidopsis thaliana
ttaattaaatggaaaatcaagaggattcttgtgaatgtgaggagcttccattgaatcacttaggagatgaggaagagtttagaagttgttgtggtgatgaagaactttggttaaagggtagtgatgatatagctaaagttgtagaggaggagaaaaaagatgatcttgatgatgagttctctgttaagatggtctttaaaggagtctcgatattcgaaagaggagatttgggttctggttattcgggaattggtgttgtgttggagaggtcaggagatttggagttgattcaggttcagaagaagttggatttttatgtcgaagagtctgtagctaactatttagctcttatggatggtcttgaagtagctttacagaacaatctcagctctgtggttgctgtaaccgactccgagttgctctataatcagataactcgtgaggagcagctcgagatccctcttttagtagctctgagagaaagggtattggagaaaacaagtaaccttaatgggtttgttctaaagcttgctcctttctgtgatcttgatgaagctctaagcttggctcaagtagcggtaggaatcgtgtcttctaatcttgatggggataaaccgatcgagaactgctcgatctgctgtgaagaccgtcagtctgagatgatgctatcattgaaatgcactcacaaattctgttcgcactgcatgaaaacgtacgttgaagggaaagtaaagacttcagaggttcccatcaggtgtcctcaagtgcaatgcaagcattatctctcagcagcggaatgcaaatcgttccttcccgtcactactttcaaatcattcgaggaagcaaatgtgtgtagtaaaaacaatgggaagatttactgcccatatcccaattgctcttttctgttagacccgcaagaatgtctatcatcaggaagggctagctcaagctcgtctactcagtcagagaatagctgctgtgtggagtgtccagtctgtgagaggtttgtgtgtgtggactgtggtgttccttggcatgcttctatgagctgtgaagagtttcagattcttccagttgatgaaagatacccagatgatattacattgcatcgcttggcaaggtataagaggtggaggcggtgtcagcaatgccgtataatgatcgagcttgctcaaggctgcaaccacatgacttgccgatgcgggcatgagttttgctactcgtgtggagcagagtacagagaagggcaacagacttgcacgtgtgctttttgggacgatgatgaagaagaacaagaaaacgcagtagaggaaaacacaattcaagaagttgagcaatggccttgggacacatttaactcaattccaactgtaatggacgcgtactcagagcaagaaagatctcagcttgctctgatccaaaggttcttagcaggtggagggtttagtctcagtgatcaccatactacttatcagtcaccgccgcctccatgtacagagtcatcatatgttgaagccgcaatgaaagatcttcatcagcttccttggcttgagaggtttgtgtctgttataagtgatgattactatgaagagtataatagccagtgaggcgcgcc

SEQ ID NO: 225 - DNA, 1726 bp, Arabidopsis thaliana
ttaattaaatggcaatggaggttggggagatgtctcagccggaggcgacggcgagtcttctctctctcgcttccgccactcagcaaccgtacgtctccgagctcctctctttcactcttgatcgtctccacaaggaaccggagctgcttcgagtggatgcggagcggattcagaggcaaatgcaagaggtggctgttggaaattaccgcgcgtttatcaccgctgctgatgctttgcttgcgatccgtcaggaagtttcttccattgataagcatctcgagtctctgattggcgaagtcccaaaactaacgtctggttgcactgaatttatcgattctgctgagaatattttggagaagaggaagatgaaccaagcattgctggcaaatcacagcactcttcttgacttgcttgagattcctcagcttatggacacatgcgtgaggaatggaaattttgatgaggctcttgacctggaagcatttgtatcgaaacttgctaccctgcatcccaaattgccagttatccaagcacttgcagcggaggttagacaaacaactcagtcacttctctcacagcttctccagaaactacgctcaaatatacagttaccagaatgtctccgcattattggatacttacgccgaataggtgtctttggcgagtatgaaatgcgattacagttcttaagatgccgagaggcatggctcactggaattcttgaggatttagatcagaaaaatgcctatgagtatttaaaaggcatgataaactgtcacagaatgcacctatttgacgtggttaaccaatatcgagctatattttctgatgatacatctgggagcgaagaaaattatgatggtggacttttgtttagctgggccatgcatcaaataacatcacacctgaagactctaaaaatcatgcttccaaagattactgaaggaggatctctatcaaatattttggatcagtgcatgtactgtgcgatggggcttggtggggttgggctagacttccggggtctgcttcctccactttttgaagaggcggttctaaacttattctccaagaacatgagtacagcagttgagaattttcagttagttttggattcacatcgatgggttccattaccatctgttggctttccttcaagtggtattaatgaagatagcaaggatgacgtcacacctccatcatacttgatggagcacccgccacttgcagttttcataaatggggtatcttctgctttgaacgaattacgtccttgtgccccgctaagtctaaagaatgttgttgctcatgaactgatcaaaggactccaggccgtgtctgactccttactaagatacaatacaactcggatgcttcgactcagtgaatccaatctattcctttcactttgccgagcttttgtcgaggtggtttttccacattgcgccacatgctttggccgatgttatccaggtggtgccacaatcgttatggatgccaagagtgcatacgaaggtctgggtcgcatcttagctgcatcgtcctctcaagaaccatccaacaaatctccaaaggtcatcagcacggacacaaaggatgcatcagagaatggtgtagcctcccaacctgaagaaaaacaagccgagaatccaaacgcgaaagaagaagataacagtcccattcctttgcagactcctgagataacacccgagtcttgaggcgcgcc

SEQ ID NO: 226 - DNA, 2619 bp, Arabidopsis thaliana
atgaaatcaacgtttctgttgttgttgttgttacttagtctcaatcttctctttgtctttgtttcatgtgcttcttccatagagtttgtttaccctaatttcacagcttctaacctcagattcgtcgatagctccaaaggagctttcctcttgtctcgtaattccatcttcaaagccggtttattcagtcccggcggcgatgattcctctaccggtttctacttctccgtcgtccatgtcgattccggttcaacaatctggtcatcaaatcgagattcccctgtttcaagctctggtacaatgaatcttactcctcaaggaatctctgttattgaagatggtaaaagtcaaataccagtttggtcaacgccggttttagcttctccggttaagtcccttcggttaaccgacgccggtaatctccttcttcttgatcacttgaacgtttctctatgggaaagctttgattttcctactgactcgatcgttcttggacaaagacttaagcttgggatgttcttgtcaggatccgtctcgcggtctgatttctctaccggagattataagttcttggtcggtgaatccgacggtttgatgcagtggagaggacagaattattggaagctaaggatgcatatacgagctaatgttgattctaacttccctgttgagtatctaacggtcactacttcaggattagctcttatggcacggaacgggacggtggttgtagtccgcgtggctttaccaccgtcctctgatttccgagtggcgaagatggattcatcaggtaagttcatcgttagtagattctccgggaagaatcttgtgacggaattctctggtcctatggattcttgtcagattccgtttgtctgcggtaagctcgggctttgtaatcttgataacgcttcggaaaatcagagctgttcatgtccagatgagatgcgaatggatgctggtaagggtgtgtgtgttccggttagccaatcattgagtttacctgtttcttgtgaagcaagaaacatttcgtatctcgaactaggtcttggtgtgtcttacttctctactcatttcaccgatcctgtggaacacggtctcccgttattggcttgtcatgatatttgcagtaagaattgctcttgcctcggtgttttctatgagaacacgtctcggtcttgttatctcgtaaaggactcgtttggttctttgtctttagtaaagaactcaccagagaatcatgatcttattggatacgttaagttgtctatcagaaaaacaaacgctcagcctccgggaaacaataacagaggaggatctagcttccctgtgatcgcacttgtgctcttaccttgctctggtttcttccttttgattgcattagggcttctctggtggcgtagatgtgcagtgatgagatacagtagcatccgtgagaagcaagtaactagacccgggtcgttcgaatcaggagatctaggatctttccatatcccggggttacctcagaaattcgaattcgaggagctggaacaagcaactgagaatttcaagatgcagataggatcaggcggatttggatcagtctacaaaggaactctcccagatgaaacactcattgctgtcaagaaaatcacaaaccatggacttcacggtagacaagagttttgtacggaaatcgcgataattggaaatatcagacacacgaatctagtgaaactgcgaggcttttgcgctcgcgggaggcagttactcttagtctacgagtacatgaaccatggctcgttagaaaagactctgtttagtgggaatggtccggtgcttgagtggcaagaaaggtttgatatagcgctcgggactgctcgcgggctcgcgtatctccacagtggttgcgaccagaagatcatacactgcgatgtgaagccagagaacatcttactgcacgatcatttccaacctaagatatctgatttcgggttatcaaagcttcttaatcaagaagaatcaagtctgttcactacgatgagaggtactcgaggctatttagctccagagtggataacaaacgcagcgatctccgagaaagctgatgtgtacagctatggaatggttttgttagaactagtgagtggtaggaaaaactgttcttttcgatctcggagcaacagtgtgacggaggataataatcagaaccactcgtcgactacgaccactagtactggtttggtgtatttcccattgtacgctttggatatgcatgaacaagggaggtatatggagctcgctgatccgaggctagagggtcgggtaacgagccaagaggctgagaagttggttcggatagctttgtgttgcgtccacgaggagccagcattgaggccaacaatggcagcggtagtgggtatgttcgaaggaagtataccgttggggaacccgaggatggagtcgttgaacttcttgaggttttatgggctgaggtttgcggagtcttccatggttgaaggacaaaatggggagagtgaaactatggtcttccaccggcgagagagctctaatagtggcggctctaggcagtctgcgtcttacatagcgtctcaggaagtgtccggcccgcgatga

SEQ ID NO: 227 - DNA, 668 bp, Arabidopsis thaliana
ttaattaagaatgactgatcaaggattggaagggagtaatccagttgatcttagcaagcatccttcagggattgttcctactcttcaaaacattgtctccacggtgaacttagactgcaagctagatcttaaagccatagctttgcaggctcggaatgctgaatataatcccaagcgttttgctgcggtgataatgaggatcagagaaccgaagactacagcattaatattcgcctcagggaaaatggtctgtactggagctaagagcgaggacttttcgaagatggctgctagaaagtatgctaggattgtgcagaaattgggattccctgcaaaattcaaggatttcaagattcagaatattgtaggttcttgtgatgtcaaattccctataagacttgaaggtcttgcttactctcacgctgctttctcaagttatgagcccgagctcttcccagggctgatttataggatgaaagtcccaaaaatcgtccttctaatctttgtctctgggaagatcgtaataacaggagccaagatgagagatgagacctacaaagcctttgagaatatataccccgtgctctcggaattcagaaagatacagcaataggtcacggatttgttccctgcaaaactagttgtgcggtcttagcccctggcgcgcc

SEQ ID NO: 228 - DNA, 843 bp, Arabidopsis thaliana
ttaattaaatctttgtggatccctccattgctatgtggaatttagcttcaaaatcgatcagagaaggttttatatcgaagggagaagaagctgctacaaaaccaagaagagctactttagatagatcaggagatggaagaaagacaacaaaggaagaaaaattggagtgtcccatttgctgggaatcattcaacgttgttgagaatgtaccttatgtcttatggtgtggtcatacaatctgcaagtactgtctcttagggcttcaacgtgccattgtcatcaaatcctctgctttaccattccagcttcccttcttcgttgcttgcccttggtgcaatattctctctttaaggctggtttgcaatggaaccatcagatttccttccaagaacttttaccttctgtggatggtagaaagcatgaatggctccagatcggaggcacccagcgacaacaaaagggttgcttcagggcagagagacttgagaaataggtgtgatggagtgagtaataccgccttgggtgatgaagggttgctggacaatcgcagctggtggaatggtgtgaccagaggattcttcagaactgggaggctccatgactcggtacgtaagtcaatggctcttgttgctcatttgttggctaagtttcctctggtagtcatattcctgttgatggctttatatgcaatccctgtgagtgctgcagttctcggggtttatttctttgttacgtttgctttggctgtcccgtcgtttctcgtcctttattttgccttcccgagcttaaactggctgatcagagagattgcaacctgactcattgtactgtttctttcttcct

SEQ ID NO: 229 - DNA, 1193 bp, Glycine max
ttaattaataataaagttttatttttccaaataaagggaatggcgactcctgttgagcctcctaacgggatcagaactgaagggaagcattattattccatgtggcaaaccctgtttgagtttgattcaaaatacgtgcccatcaagccaattggccgcggagcatatgggattgtgtgctcttctgtgaatagagagacaaatgagaaggttgccatcaagaagatacagaatgcctttgaaaaccgggttgatgcactgaggactttgcgcgaactcaagcttcttcgccaccttcaccatgagaatgtgattgctttgaaggatatcatgatgcctgttcataggaatagtttcaaggatgtctatctagtttatgaactcatggacacggatttgcatcagattattaagtcttctcaagctttgtctaatgatcactgccagtatttcctctttcagttgctccgtggcttgaaatatcttcactcagctaacatccttcatcgtgacttgaaacctgggaatcttctaattaatgcaaattgtgacctaaaaatatgcgattttgggttagcacgtactaactgcagcaagaaccagttcatgaccgagtatgttgtcactcggtggtatagggcaccagagctcctactctgctgtgacaactatgggacatctattgatgtttggtcagttggatgcatctttgcagagcttcttggccgaaaaccgattttccctggttcagagtgtctcaaccagctgaagttgattatcaatatccttggtagtcagagggaggaggatattgaattcattgataatccaaaggcaaagaagtatatcaaatcacttccttattctcctggaagccccttttcgcgactttatcctaatgcgcatccattagcaattgatcttcttgcaaagatgcttgtttttgatccaaccaagaggattagtgtcactgaagcacttcaacacccttacatggcccctctgtatgatcctaactgtgaccctccagctgtcattccaattgatcttgacattgatgaggatctaggggaagagatgataagggagatgatgtggaaagaaatgcttcattaccatcccgaatctgcgatggagaatgcagggttgtgctaatgatatttacttcttttcacggttatgttcatttaaat

SEQ ID NO: 230 - DNA, 1227 bp, Arabidopsis thaliana
ttaattaaatggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgcctctgccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggggtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttgagatcaagcttgcatgtagagatccaaaagctttatag

SEQ ID NO: 231 - DNA, 1608 bp, Arabidopsis thaliana
ttaacccttaattaagggacaaacaaaagttggcaagtttaactaagtgaaaagtctatggcggagacaacgagttggatcccagtatggtttcctctgatggtgttgggatgttttggtctgaattggttggtcaggaaggtgaatgtgtggctctatgagtccagccttggggagaacaggcactatctgccaccaggtgatttgggttggcctttcattggcaacatgttgtcttttctcagagctttcaagacttctgaccctgactccttcactcgcactttaatcaaaaggtatggacctaaaggtatatataaagcacacatgttcgggaacccaagtataatagtaacaacatcagacacttgccggcgtgtgctgacagacgatgatgcgttcaagccaggttggccaacatctacaatggaactcattggaaggaagtcattcgttggtatctctttcgaggaacacaagcgtctcaggcgtttgactgctgctccagtcaatggccatgaagccctctctacttatataccgtacattgaagaaaacgttattactgttctggacaagtggaccaaaatgggagagttcgagttcttgactcatctgcgtaagctcacctttaggatcatcatgtacatctttctcagctctgagagtgagaatgtaatggatgcattggaacgagaatatacagctcttaactatggggttcgagcaatggcagtcaatattcctggatttgcttatcatagagcactcaaggcgaggaaaacacttgtagctgcctttcagtccatagtgactgagcgcagaaatcaaaggaagcagaacattttatcaaataagaaagatatgttagacaatcttcttaatgttaaagatgaagatggaaaaactttggatgacgaagagattatcgatgttcttctgatgtatcttaatgccggtcatgaatcctctggccacaccattatgtgggctaccgtttttctacaagaacaccctgaggttctacaaagagcaaaggctgaacaagaaatgatcctgaaaagtaggcctgaaggtcaaaaaggtctatctctaaaagaaacccggaaaatggaattcttatcgcaggttgtcgatgagacacttcgagtcataacattctcactcactgcttttcgagaggcaaagactgacgttgaaatgaatggctatttgatcccaaaaggttggaaggttttgacatggtttagggatgtccacatcgaccctgaagtctttccagatccaagaaaatttgatcctgctagatgggataatggtttcgtaccaaaagctggtgcgttccttccttttggtgctggaagccatctatgcccgggaaatgatctggctaagctcgagatttcaatttttcttcatcatttcctcctcaaatatcaggtgaaacggagcaaccccgaatgtccagtgatgtatctgcctcataccagaccaactgataattgcttggcaagaattagttatcagtaaaacatggttttcatcttctccgttaagttctagtgaaatgccgtcatttaaatacccagctttctaaattggagctct

SEQ ID NO: 232 - DNA, 958 bp, Arabidopsis thaliana
ttaattaacagtctctcttcctctgtttctgattcctgaataaatttgttaaacgatggagaagatcgttcgttcttcttcgctgattctacttgttggcctccttctttttatgaattttcacggatttgtccggatcgccgaagcaacgaagcgacggatcgagatctccgatgacctagacgacgttgaagacaatgaagaagacgagtcatggaaagagtgggggaagaaagcaacgaccccggaatttgatccgcctccggatttcaccaatatgggattcgatcagatccaagaggaaatggctaaacggacttttggaaccgtcgtcggtttcgtcaagctccggttaggcgtcccccgtaccaaggtaaactaaaatccaaatcgaatcgtgaatttggggtccttaagttatagtttcagttactgttcaaaattctctgaattcgatatgggtccagttgcttcaggggattgaatagtgatctgtttatatgtttcaatcaggatgtggtgattgatattgctatgaaatggacaaaagttttaagaacaggagggataggagtaagattcatggctgtagatcgaagcacagtgatgttcaatatgcaaaatgggaagcttgtgactgaggtaaaagccacagaaaacacacaatgctgaaaactttgtttagtggattagtcaaaatctaacatcacaatcatatctttcaattagctaagggaattcgtgctgagccaagaagaagcttacgaggtcaagatagggaagcaagagtttagaagacctggagatcctccatttgaagatgtctttgacaaatttcaagctgagcaaaggaaagatcacgaagatggtgatggtaacaagaatgatcttactaaggatgaattataggtcacagaaaagcttctataatgggtagtactgaaagttcaggcgcgcc

SEQ ID NO: 233 - DNA, 1903 bp, Arabidopsis thaliana
ttcaactctttgtttcttgtttgttgattaacccttaattaaatggcgaaactcctcgagacctttccttgtgttccctccaccgaacgaggccgcggcattttgatctccggcgattccaaatccgacaccattctctactgcaacggccgctctgtcttcatccggagcctccgccaactccaagacgtccaagtttacggcgaacatggctatgctgttaccgttgctcgctactctcccaacggcgaatggatcgcttccgctgatgtctctggtactgttcgcgtttggggaacgcacaacggcttcgtgctgaagaacgagttcagagtccttgctggtcgtgtcgatgatctccaatggtctttcgatggacttcgaattgttgcttccggcgatggaaaaggcaaatctcttgttcgatccttcgcatgggactctggcaatacaatgggggattttgatggccattctcgtagggttttgagttgtgccttcaagccaacgagacctttccgaattgccacatgcggtgaagacttcttggttaacttttatgatggaccaccttttaagtttcactcttctcacagggagcattccaacttcgtcaactgcatcagatattcacctgatggtactaaattcattaccgtaagctctgacaaaaagggtatgatttacgatggcaagactggagataaagttggagaattggcctcagaagatggtcacaaaggcagtatctacgctgttagctggagtcctgacagcaaacgggtgcttactgtgtctgctgataagtctgccaaagtatgggaggtagctgaagatggaactattggctctgtaattaagacattgtcgtttatggaatctggtggagcagaagacatgcttgtgggatgtctttggcagaatgatcatctcattaccgtgtctcttggcggtactatgtccttgttctctgcagatgatatggataagcctcccttgctgttatctggacatattaagaacgtcacttctttggctgttcttggggaaaaccagaagacgattctgtcttgtagctatgatggtctcattgtcaaatggctaaaaggggttgggtacagttgcaagttacaaatgaaagacaccaaaatcaagcgattagcggctactgaatctagcattttcatatctggatatgataatatggtttggagaattcctttaaccgacaacggatatggagctgcagaacatgtcgatataggccatcagcctctggacataagcatagccgttgattctcccgaagccacagcactagtctcgtttgattccggagttgtattgctcaatggtctgaacattttgagcaagatcgatttgggttttgctgtggcagcctctgtgatctcacctgacgggaaagaagcgattgtaggagggcaagacgggaagttacacatatactcagtctcaggggacaacaacctcaaagaggaagcagtcctggagaaacacagaggtgctttgacagtgatacgttactctcctgacttaacaatgtttgcttctggtgatgccaaccgcgaagctgtagtctgggatcgcgagaccaaacaggtgaagctaaacaacatgttgttccacacggctcgtataaacagcttggcatggtcaccaaacaacaagatggtagccacagggtccatagacacttgcgtcattgtatatgaagtggacaagccagcttcaagtcgcataaccgcaagaaacgctcatctcggtggagtgaacgcagtcgccttcattgatgattgcaccgtagcaagttccggagaagacgcttccgttcgtttgtggcatatcgaacctcagtgaggcgcgccaaaaattggagctctgc

SEQ ID NO: 234 - DNA, 2348 bp, Arabidopsis thaliana
gattaacccttaattaaggtcaaaatggcttcccacaacgaaaacgatgatattcccatgcttccgatttcagacccatcatctcgtactagagccagagctttcacttccaggagtcgtagcgtttctctctcaaaccctacttcctccattgaaggatttgacacttccactgtggttttaggctacacgggtcctcttcgaactcagagacgtcctcctttagttcaaatgagtggtcctcttacctctactcgcaagcatgaacctctctttcttcctcatccttcttctgattccgttggtgtctcttctcagcctgagaggtatccttcttttgctgctcttgaacataaaaactcctcagaggatgagttcgttttgaaacacgcaaatctcttgaggtctggacaattgggaatgtgtaatgatccttactgtactacttgcccttcttactacaaccgtaaggctgctcaaatccctacttctagagtttctgccctttttgattccacgttccataacgctctgtatgatgatgctaaaggttgggcaaggagatttgcttcctctgttaatagatacttacctggaatcatgaatcctcatgccaaagaggttcaaacctggactaaattcttcgccctttcatgcttgttagctatttttatagatcccctcttcttcttcctcataaaagtccaagagcaaaacaaatgtattatgattgattggccgatgactaaagcatttgtagctgtaagaagtgtaacagatgttatattcactatgaacattctacttcagttccgattggcctatgtagctcgtgagtctacggtagttggagctggccagttagttagtcatcccaaaaaaattgcccttcattacctcaaaggaaagtttttccttgacttgttcatagtgatgccacttccacagatattgatactatggataataccagcacatttgggtgcatccggggcaaactatgcgaaaaaccttctacgagctgcagttcttttccaatacattccaaagttatatagacttctaccgtttcttgctggacaaacacctaccggattcatatttgagtcagcttgggctaattttgttattaatcttctcactttcatgcttgctggacatgttgttggttcttgctggtatctatttggtctgcagagagttaatcagtgccttcgaaatgcttgcggtaattttgggcgtgaatgtcaagatcttatagattgtggtaatggaaatagcagtgtattagtacgagctacctggaaagataatgcgagtgccaatgcttgtttccaagaagatggttttccttatggaatctatttaaaagcagtcaatcttaccaatcattctaatctcttcacaagatacagttactctctcttctggggcttccagcaaatcagcactcttgctggcaaccaagtcccaagctactttctaggggaggtcttctttactatgggtatcattggactagggcttttactttttgcgcttcttattggtaatatgcaaaatttccttcaagctcttggtaaaaggaatttggaaatgacgctgagacggcgtgatgtggagcaatggatgagccacagacggttgccagatggtataagaaggagggtgcgagaggctgagcggtttaactgggctgctactagaggcgttaacgaagaattgctttttgagaatatgcctgatgatcttcaaagagatataagacgacacctcttcaaatttctcaagaaggtgagaatattttcgttgatggatgaaccaatcttagatgcaatccgtgagaggctgaaacagaggacatacatagggagtagcacagtgttgcaccgtggaggactagttgagaaaatggtattcatagtgagaggtgagatggagagcattggagaagatggttctgttcttccattatatgaaggcgatgtttgtggtgaagaactcctcacttggtgcctcgaacgctcttctgtaaaccccgatgggacgaggataaggatgccatcaaagggattgcttagtagcagaaatgtaaggtgtgtgacaaatgtggaggcgttttcgctgagtgtagccgatctggaagacgtaacgagcttgttttcgagattcttgaggagtcatagagtccaaggagccataaggtacgactctccatattggaggctacgagcggctaggcagattcaagtggcgtggagataccgtaggagacggcttcatagattatgcactcctcagtctagttatagcctttagtttgggcgcgccaaaaattggagctctgc

SEQ ID NO: 235 - DNA, 1175 bp, Arabidopsis thaliana
ttaattaattcttctgcttcacttcactactgctttctctatttctccatagatggctccttcttcatcacctcttcgtactacaagtgaaacagatgaaaaatatgcgaatgtcaaatgggaagagcttggattcgctctgactccaatagattatatgtatgtagccaaatgcagacaaggagagagctttacacaagggaagattgttccttatggcgacatttcaattagcccttgttctccgattctcaattacggccagggactatttgaaggtctcaaagcttacagaacagaagacgaccggattaggattttccggcctgaccaaaacgctcttcgcatgcaaactggtgcggagaggctttgtatgacacctcctactctagaacaatttgtcgaggcagttaagcaaactgtgcttgccaacaagaaatgggttcctcctccgggtaaaggaactctgtatataaggcctctgctactagggagtggtgctacccttggagtagctccagcacctgaatacacttttctcatatatgcatctcccgtaggagattaccataaggtaagctcaggcttgaacctcaaagttgatcataagtatcaccgagcccattcaggtggaacggggggtgtcaagagctgcacaaactattctccagttgtgaaatcgttactcgaagcaaagtcagcgggtttctctgatgtcctgttcctggatgcagcaactggtagaaacatcgaagagcttactgcttgtaacatcttcattgtcaagggaaacattgtatccaccccaccaacttcaggaaccattttacctggagtcacgaggaaaagcataagtgagctggctcatgatattggctaccaggtcgaagaacgcgatgtatctgtggatgagctactagaggcagaagaagttttctgcacagggactgcagtggtcgttaaagctgttgaaactgtgaccttccatgacaaaaaggtaaaatacaggacaggagaagcagcattgtctacgaagcttcactcgatgttgaccaatattcagatgggagttgttgaagataagaaaggttggatggtggacattgatccttgtcaaggttgaaagaagaagtttagaaagctgatgattctatgtactcaaacgtgggcgcgcc

SEQ ID NO: 236 - DNA, 295 bp, Arabidopsis thaliana
ttaattaaatggctttcttaaggagttttttcgctaccaagcatatcattcgccggtcttttactacggaatcattatcaacgcctaaagggttctttgctgtgtatgttggagaaaatctgaagaagaagagatatcttgttccggtttgttacttgaacaagccatctttccaagctttgcttaggaaagcagaagaagagttcggttttaatcatccaacgggcggtttgagtttaccatgcgacgaagctttcttcttcactgtcacttctcagattcgttaaggcgcgcc

SEQ ID NO: 237 - DNA, 2639 bp, Arabidopsis thaliana
ttaattaaagatggatgatcggcacgaaggagaccatcatgatatagaggttgaaggaggagctttacatggtttcgagaggaagatatctgggattctagacgatggatctgtcggatttcgacagcctcttctcgctaggaatcgaaagaacacaacttctcagatcgctattgtcggagctaatacttgtcccatcgaaagccttgattacgagatcttcgaaaatgattttttcaagcaagactggaggtctaggaagaagattgagatacttcagtatacgtttctcaaatgggcgcttgcttttcttattggtttagctactggacttgttggctttttgaataaccttggtgttgagaatatagctggatttaaactcttgctcatcggtaatctcatgctcaaggaaaaatatttccaggcattttttgcatttgctggttgtaacttaattttggcaactgctgctgcttcactctgtgcttttattgctcctgcggcggcaggatctggcatacctgaggttaaagcatatctcaatggtatagatgcttattcaatattagctccaagcaccctctttgttaagatctttggctctatatttggagttgctgccggatttgtagttggaaaagaagggcctatggttcatactggtgcttgcattgctaatttacttggacaaggtggttccaaaaagtaccggttgacttggaagtggctcagattcttcaaaaacgatagagacagaagagacctgatcacttgcggggctgctgctggtgtagcagctgccttccgtgctccagttggaggagtgcttttcgcccttgaagaagctgcttcatggtggaggaatgcccttctctggaggacattcttcaccaccgcagttgtagcagtggtcttacgaagtttgattgagttctgtcgctctgggagatgtggactgtttgggaaaggaggtctcatcatgtttgatgtaaactcgggaccagtgctatatagcactccagatttgctagcaatagtattccttggagttattggtggtgtgcttggaagcctttacaactaccttgtggacaaagtcctccgcacatatagcattataaacgagaaaggtccgagatttaaaattatgcttgtaatggcagtttccattttgagctcgtgttgcgcatttggtctcccatggctttcacagtgtactccatgtcctattggcatagaggagggaaagtgccctagtgtaggtcgatccagcatctataagagtttccagtgtcctccaaaccattacaatgacctttcctccctacttctcaacaccaatgatgatgcaatccgtaatcttttcacatccagatctgaaaatgaattccatatctctacccttgccatcttctttgtcgcagtgtactgccttggcatcataacatacggcatagccataccctctgggcttttcattcctgtcattcttgctggagcctcttatggacgactagtgggtagactgctgggtccagtatctcagcttgatgtaggtctgttttctctgctcggagctgcttccttccttggaggcacaatgagaatgacggtctctctatgtgttatactgctcgaacttacaaataatctcctaatgctgccactggtgatgcttgtactccttatatcaaaaacggttgcagattgtttcaacaggggggtctatgaccagattgtaacaatgaaaggactgccttacatggaagaccatgcagagccgtacatgcgcaatttggttgcaaaggacgtagtttctggagctttgatatccttttcgagagttgaaaaggttggggtaatatggcaggctttaaaaatgacaagacataatggtttccctgtaattgatgagccacctttcacagaagcttctgagctatgtgggattgccttgagatctcatctccttgtgcttctccaagggaagaaattctcgaagcagagaacaacttttggttcacaaattctgagaagttgcaaagcccgtgactttggtaaagcagggttaggtaaggggctcaagattgaagatttggatctaagtgaggaggagatggagatgtatgttgatctccatcccatcactaacacatctccttacactgtgcttgagactctgtctctagctaaggcggctattcttttccggcaacttggtcttcgccacttgtgtgtggtgcctaaaacaccagggagaccgcctattgttggaatactgacaaggcatgatttcatgccggaacatgtcctgggactctaccctcacattgatcccctcaagtgaataaggggcgcgccaaaaattggagctctgcagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttg

SEQ ID NO: 238 - DNA, 1028 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatgagtgcagatcccaatcgtattgttcgtttattaccccttggggcgggcagtctcgggggactgttattgctaattaaccgcctttccacccccatgttaaacccttcccaagcccgttccgatgtggtgggggtaattttggcggggatgctggtgtgtgtctggctaatttggcaacggattcagcccaagtccccggaagcggtggtgctagaaggcaaagaaggctttgatttactggatagtctgccccaggaaataaaaacagagttagcttgggcttcccatttgctcttgactaatacggtcacccaaaccatggtggtctattacgatcgccaggtgttattgcgccggggcattttgagtgagcaaaaagaagtgaaaccggggccgattgtagaacgggtaatgcaaacccaaaagcccgtttatttggtgaatttacccctctatcccggtcgagtggaatttgattatttacccgccaacacccagggtttaatctgtcagcccctcgacgatcggggtgtgttaatcctaggagccaatattccccgcagttatacgaaacaggatgaaaattgggtcacgggcattgctgataaaattgcccatagcttgagcatgcccatcaatgcttaacggacaaatttgagccaagcaaaaatttccgctgtggttaggctgatttaaatacccagcaaatacccagcaaattggagctct

SEQ ID NO: 239 - DNA, 1503 bp, Saccharomyces cerevisiae
ttcatttatttgtcagctttcaaactctttgtttcttgtttgttgattaacccttaattaagtccacattgtgataccattagagtggcactcatcgctatctttatcgtaatgtacaagttggacaataacgacattgacgatgaaacgaataactctgtttcactgacgagccttttagaatttctcgacccgatcgcttcaaaagtagtttcaaaatactaccatggttctcatctttcgaaagcagaacagaaattgcgaaattttgagggttttagaagacgtaaaccccatcatgaacatgatagtcatcatccacatcacctgaatagaagtcgctctttcttgcaattagaggacttcaaagtaagagcgttacaaagaattaggaatctggataaacccttggattccatttttttcaaaaacagctcaaggttggagaaagcattttaccctttcacactgtttaatatatttttcatcggatttttgatgggcaggtttccagaatggtttcatgtttactataccatcctgttcttcgttctgatgcccatacgtttttacacatactataaaaccaaaaaccactactttctggctgatttttgttactttgtgaacatgctatgcctattgtttatttggattttcccatattcatacagccttttccagtcatgttttgcattcactttcggaacgttatgctttgccgttattacttggagaaattccttggtaatacattctatagataagactacttcatgcttcattcacataatacctccctgtgtcatgtacgtcatctatcatggattaccactcgaatacaaaatcgaaaggtttccgggagcaattattcaaagtgaattggacatcaaaaaaaatattctttggacatccctttattatttggtttggcaatcattataccattacttcatcacgttgaaaaagtctagcaagatcaagtcaggggaaagaatgacaagttttgaatatttaaccacacaccaatttaaaaacttttgggcagttaaattaaggtcaccttggccgatgataatttacacactttctcaatatttctatcaactattcactatgctattgtgtggcatatggattcgttacaaattagctgcggccctatttttaactatagtatttctatgggcgtctcataatggggctacctactatatcgaccactacgggaagaatttcgaaaaagaagttgatagattacgtcttgaagttgagaatttacaacaaaagttacagcctgattctgatgcagtcatatctgatgcctccgtgaatgataaggattacttgaatgtcaaccgtgacgaagattttgacgactcttcaagtgtatcctcaaagagtgattaagatagttcacttcatttatctgttaactttgagagcatttatttaaatacccagcaaatacccagcaaattggagctctgcagagctttcgtt

SEQ ID NO: 240 - DNA, 1491 bp, Escherichia coli K12
aaactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggctaagatttttgatttcgtaaaacctggcgtaatcactggtgatgacgtacagaaagttttccaggtagcaaaagaaaacaacttcgcactgccagcagtaaactgcgtcggtactgactccatcaacgccgtactggaaaccgctgctaaagttaaagcgccggttatcgttcagttctccaacggtggtgcttcctttatcgctggtaaaggcgtgaaatctgacgttccgcagggtgctgctatcctgggcgcgatctctggtgcgcatcacgttcaccagatggctgaacattatggtgttccggttatcctgcacactgaccactgcgcgaagaaactgctgccgtggatcgacggtctgttggacgcgggtgaaaaacacttcgcagctaccggtaagccgctgttctcttctcacatgatcgacctgtctgaagaatctctgcaagagaacatcgaaatctgctctaaatacctggagcgcatgtccaaaatcggcatgactctggaaatcgaactgggttgcaccggtggtgaagaagacggcgtggacaacagccacatggacgcttctgcactgtacacccagccggaagacgttgattacgcatacaccgaactgagcaaaatcagcccgcgtttcaccatcgcagcgtccttcggtaacgtacacggtgtttacaagccgggtaacgtggttctgactccgaccatcctgcgtgattctcaggaatatgtttccaagaaacacaacctgccgcacaacagcctgaacttcgtattccacggtggttccggttctactgctcaggaaatcaaagactccgtaagctacggcgtagtaaaaatgaacatcgataccgatacccaatgggcaacctgggaaggcgttctgaactactacaaagcgaacgaagcttatctgcagggtcagctgggtaacccgaaaggcgaagatcagccgaacaagaaatactacgatccgcgcgtatggctgcgtgccggtcagacttcgatgatcgctcgtctggagaaagcattccaggaactgaacgcgatcgacgttctgtaactcgagacccagctttcttgtacaaagttggcattataagaaagcattgcttatcccccaaatacccagcaaattggagctctgcagagctttcgttcgtatca

SEQ ID NO: 241 - DNA, 1937 bp, Saccharomyces cerevisiae
ttcatttatttgtcagctttcaaactctttgtttcttgtttgttgattaacccttaattaagatgagtaatacttcttcgtacgagaagaataatccagataatctgaaacacaatggtattaccatagattctgagtttctaactcaggagccaataaccattccctcaaatggctccgctgtttctattgacgaaacaggttcagggtccaaatggcaagactttaaagattctttcaaaagggtaaaacctattgaagttgatcctaatctttcagaagctgaaaaagtggctatcatcactgcccaaactccattgaagcaccacttgaagaatagacatttgcaaatgattgccatcggtggtgccatcggtactggtctgctggttgggtcaggtactgcactaagaacaggtggtcccgcttcgctactgattggatgggggtctacaggtaccatgatttacgctatggttatggctctgggtgagttggctgttatcttccctatttcgggtgggttcaccacgtacgctaccagatttattgatgagtcctttggttacgctaataatttcaattatatgttacaatggttggttgtgctaccattggaaattgtctctgcatctattactgtaaatttctggggtacagatccaaagtatagagatgggtttgttgcgttgttttggcttgcaattgttatcatcaatatgtttggtgtcaaaggttatggtgaagcagaattcgtcttttcatttatcaaggtcatcactgttgttgggttcatcatcttaggtatcattctaaactgtggtggtggtccaacaggtggttacattgggggcaagtactggcatgatcctggtgcctttgctggtgacactccaggtgctaaattcaaaggtgtttgttctgtcttcgtcaccgctgccttttcttttgccggttcagaattggttggtcttgctgccagtgaatccgtagagcctagaaagtccgttcctaaggctgctaaacaagttttctggagaatcaccctattttatattctgtcgctattaatgattggtcttttagtcccatacaacgataaaagtttgattggtgcctcctctgtggatgctgctgcttcacccttcgtcattgccattaagactcacggtatcaagggtttgccaagtgttgtcaacgtcgttatcttgattgccgtgttatctgtcggtaactctgccatttatgcatgttccagaacaatggttgccctagctgaacagagatttctgccagaaatcttttcctacgttgaccgtaagggtagaccattggtgggaattgctgtcacatctgcattcggtcttattgcgtttgttgccgcctccaaaaaggaaggcgaagttttcaactggttactagccttgtctgggttgtcatctctattcacatggggtggtatctgtatttgtcacattcgtttcagaaaggcattggccgcccaaggaagaggcttggatgaattgtctttcaagtctcctaccggtgtttggggttcctactgggggttatttatggttattattatgttcattgcccaattctacgttgctgtattccccgtgggagattctccaagtgcggaaggtttcttcgaagcttatctatccttcccacttgttatggttatgtacatcggacacaagatctataagaggaattggaagcttttcatcccagcagaaaagatggacattgatacgggtagaagagaagtcgatttagatttgttgaaacaagaaattgcagaagaaaaggcaattatggccacaaagccaagatggtatagaatctggaatttctggtgttaaatttaaatacccagcaaattggagctctgcagagctttcgttcgtatcatcggtttcgacaacgtt

SEQ ID NO: 242 - DNA, 1233 bp, Saccharomyces cerevisiae
aactctttgtttcttgtttgttgattaacccttaattaagatgaattgtatccctagtccaattagtgaaaggaaaatccaaattaataatgaagattgtataggcaaggaaaatgctttccataccattccaagagaaagttcaattaacttgacacctcactctacgaatgaaaaaaaagttctatccgaggtaaacagtaacaaaatcgattctttacaactccctcgaggtaaattgcaaagagattccacccatttggaaaaaacaagaaagagacaattatcaaatgattcaaccgatcctatagagccaaaaactgtgaaaaaaataaaatgtcatcaatggaaaaatttggattcgatagagatggatgatccattcatggtagcagaatatacagattctatattttctcatctttacgagaaggaaatccaaatgctaccgacacataactatttaatggacacgcaatctccctatcatttgaaaagctccatgagggcgctgttaattgactggttggttgaagttcatgagaaatttcactgcttacctgaaacattatttttagcgatcaacctgctagatcgatttttatcacaaaatgttgttaaattgaataaattacaactactatgcatcacttgcctgttcattgcctgtaaatttgaagaagttaaattaccaaaaataacaaattttgcgtatgtgactgacggtgctgccactgtcgaaggaattaggaaggctgagctattcgttctaagttctttaggttataacatatctctaccaaaccccctaaatttcattaggagaatttcaaaagctgacaattactgcattgaaacaaggaacatggccaaattcatcatggaatattcgatttgttgtaataaattcgtccacctgaagccatcatatttagctgcaatgtccatgtatatcgccagaaaaattaaaaatgaaaattccaaatgggatgaaacttttattcattatagtggcggcattgatattgaatcagatccagcgtttaaggattttatcagtgaactagttgaagatattgctgtacctgatacgaatctagattccttgagacttaaatacaaaaagcctaaacatggcatggtttatttcaaggtttttgactggtgtaaacaaaaacgttgaatttaaatacccagcaaattggagctctgcagagctttcgttcgtatcat

SEQ ID NO: 243 - DNA, 1424 bp, Glycine max
ttaattaaataacttgttgggacatatttgactcggtgcttttcttttggtgcttgcctcatgggaaacagtgaggatgagaaatctgttaagactggaagcccttcttcttcacctgcaacaactgatcagaccaaccaacctaatattcatgtctatcctgattgggctgccatgcagtattatgggccaagagtcaacattccaccatacttcaactcagctgtggcttcaggtcatgctccacacccatacatgtggggaccaccacagcctatgatgccaccttatgggccaccttatgcagcattttattcgcatggaggggtttatactcaccctgcagttgctattgggccacacttacatggtcaaggagtttcatcttcacctgctgttgggactcattcaagcatagaatcaccaaccaaattatctggaaatactgatcagggtttaatgaagaaatcaaaagggtttgatgggcttgcaatgtcaataggcaattgcaatgctgagagtgctgagcatggagctgagaacaggcagtcacagagtgtggatactgagggttacagcgacggaagtgatggcaacactgcaggggctaatcaaacaaaaaggaaaagatgccgagagggaacactgaccactgatggagaagggaaaactgagctacaaaatggtccggcttccaaagagacttcatcttccaaaaagattgtgtcagctactccagctagtgttgccggaacattagttggacctgtagtttcttcagttatggccacaacactggaactgaggaacccttcgactgttgattctaaggcaaattccacaagtgccccacaaccttgtgcaattgtgcctaatgaaacttgcttacagaatgagcgtgagctgaaacgggagaggagaaaacaatctaaccgtgaatctgctagaaggtccaggctgaggaagcaggccgagactgaagaattggcacgaaaagttgatatgttaactgctgagaatgtgtccctgaagtcagaaataattcaactgactgaaggttctgagcagatgaggatggaaaattctgcattgagggaaaaactgagaaatactcaactgggacaaagggaagagataattttgagtagcatcgagagtaagagggctgcacctgtaagtacagaaaacttgttatcaagagttaataattctagttctaatgacagaactacagagaatgagaatgatttctgtgagaacaaaccaaattctggtgcaaagctgcatcaactattggatacaaatcctagagcagatgctgtggcagctggttgaaaccagtaactgcactggctgattatgcaattttggcatattacaagcccaaaattacagcttggtgctaacagttttcagatttaaat

SEQ ID NO: 244 - DNA, 1045 bp, Glycine max
ttaattaaaaaggaacatggaaagtgagagagagattatgatgattccatgttttgattttggcaaggcattagaagaagggagtgaggagtggaaagaaatgagcaagaaagtgagagaagcatgtgagagtcacggttgcttcctcttggtttgtgatgagatgattcctaagggtgtacgtgaagagttttttagtaatatggaagcattgtttgatttgcctgaagaaagaaagatgaagcacataagtccaaagccttatagcagctacagtggcaagagccctgtcattcccctcagtgaaacctttgggatcgatgatgttcctctctctgcttcggctgaggccttcaccaacctcatgtggcctcaaggaaacccacctttctgcgagacactaaagatcatgagctcaaagatgttaaaattaagttctctcatcctgaaaatgattgtggaagattatggcattcaacaacattacatctcagatgttgaaaagatgaaaagctctagcaattcacgattgatcaaatacaaaattcctgaaaataataatgactccaatactggcctggtgtctcacacggacaaaaatgcgttaaccattatatgccaaaacgaagtccaaggactccaagtactgtccaaaacagacaattggattgaattggagatacctcagaatggctttgtggtcattgttggtgatatactaaaggcgtggagcaatgggaggcttcatgcagctacacacagagtgatgatgagtggagacaaagaaagatattcatttgggctttttacaatgccaaaggaagagatggacattgaggtacccattgagttggtggatgagaaaattcatccccttcgttatcattcattcaaatatggagagtacatctcttactttgtttcaaatctcaaagaaaatgctcttgaagtgtttgcaggtctttgaaagccctttatgcattatactagttgtttatgaataaatacaggagcaaggcaaaatatacaagaaattgatttaaat

SEQ ID NO: 245 - DNA, 1037 bp, Glycine max
ttaattaagtcacgcactcggcttgactcgtacgaactccgatccccccccgagtcacactcaaccagcaccaccgcccgatccgacgatgtctcgcgcctcctccgccgcagattccgccgcctccggtgagatcatactgttcggagtcagagtcgtcgtcgattccatgaggaagagcgtcagcatgagcaacctctcacagtacgagcatcctcaagacggcagcaacaacaaagacgctctcgccgccggttacgcctccgccgacgacgccgctcctcagaactccggccgcctccgggagcgcgagcgaaagcgaggagttccgtggacggaggaagagcacaagctgtttttggttggattgcagaaggtagggaaaggtgattggagaggaatctccaaaaactacgtcaaaacgcgaacgccaacgcaggttgcgagccatgctcagaagtactttctccgacgaagcaacctcaatcgccgtcgccgtagatccagcctctttgacatcaccaccgacacggtctctgcaattccaatggagggagaacaggtccagaatcaagacacgctgtctcattcacaacaacaatcacccttgtttcctgctgaaactagcaaaatcaatgggtttccaatgatgccagtgtatcagtttgggtttggttcttctggagtgatttcagtccaaggtggcaatggaaacccaatggaagaactcactctgggacaaggaaacgtggaaaaacataatgtgccaaacaaggtctctacagtgtctgatatcatcaccccgagttcttctagttctgccgttgacccaccgacactgtccctggggctatccttttcatctgaccaaagacagacatcatcaagacattcagctttacatgccatacaatgtttcagcaatggagaaagcatcattagtgttgcttgagattatggtccttggattcacatattaattacatatactaatctttctctagtttcctgtctttttggtgggagaaaatttaaat

SEQ ID NO: 246 - DNA, 942 bp, Arabidopsis thaliana
ttaattaactccggtgacggggagattcggaatttcggagagattttagatcatgtatagggagagaggtatggttggatcgaagtcggaggtggtcgatcggaaacgaataaacgagattcacgataacaggccttcgcattcgatgtctcagcctgtcaatggaaaaggcaaggtaacatcgacctccgttttgatggggaagcagcaattgcatgataaggaatcttcacgttctggttctatctctaagactaacatttccgacgctgtggatatatcagacacagacagcgaagaatcagaggtcagtggttctgatggagaggacacctcgtggatatcttggttctgcaaccttcgtgggaacgagttcttctgtgaagttgatgatgattacatccaggatgactttaacttgtgtggactcagccatcaagttccttactacgactatgcccttgatttgattttggatgtggagtcttcgcatgaggaacagaatgaattgatcgagtcagcagcagagatgctatatggaatgattcatgctcgtttcatattgactagcaaagggctggcttctatgttagacaaatacaaaaactatgactttggaagatgcccaagagtttattgttgtggccaaccttgtttaccagttggtcaatccgatatccctagagcaagcaccgtaaagatatactgcccaaaatgtgaagatgtctattacccacgatcaaaataccaaggaaacatagatggagcttactttgggacaacgtttccacatctgttcttgatgacgtacgggcatctgaagccacaaaaggcatcacaaagctacactcaaagagtgtttgggttcaagctacacaagccgtgaaggaaacaaggaagaagaaatgcacccttgggttttgagaaacaagaaggcgcgcc

SEQ ID NO: 247 - DNA, 1895 bp, Arabidopsis thaliana
tattcatttatttgtcagctttcaaactctttgtttcttgtttgttgattaacccttaattaaatgaggcttctaacgcttcttctgatctgtactttcttcttcttcttctcctttgcttattccgccgagtcagataacgagactgactcagttgttacacgtgagatcaatggaaccgtcgttgagtccaatgccacgagtgcgaaacctagggaagatagtttcgctgatatgatcgatcgagcactagagaaagagtttcctgataatgaccagaacgaagttcctgatccaggaagcttcaataatagtgttgctgatcagcaggcggttctagagactgttgcacgagttaagccaaagaaaaatgaaaccaagaccaaggaggagaaatccttctttaatttggataacgagaatggcgtagaggatactccaagactgatagataggaaggacaacgtttttataatgtccaatccaaaatccaagtaccctgtactgcagctagatttaaggctgatatcagatttggtcgtcgtcattgtttctgctacttgtggtggaattgcctttgcttgtgcgggtcaaccggtcattactgggtatctattggctggatctatcattggaccgggcgggttaagctttgttagtgaaatggtgcaggtcgaaacagtagctcagtttggtgttatctttctcctttttgctttaggattagaattttctgcagcgaagcttcgtgtggttcgtgcagtagctattccaggaggtcttcttcagatatttttgttcatgtgcttgagtggaataacagcctcgttatgtggcggtaaactaacagaaggaatattcgtaggcgcatttctatcgatgtcatcaacagcagtggttttgaaatttttaatggaaagaaatagcataagtgctctacatggccagataactgtaggaactcttattcttcaggattgtgctgtgggcttgctgtttgctctcctgccagttcttggtggcacatcaggtgtccttcaaggagtgttgtccatggcgaaatcgttggctattttgattgcgtttttgggagctttgtttgtattatcccgtacctgggtaccttggtttctaaaacttatgacaagcctttcttctcagactaatgagctctatcagttggccgctgtagcattttgtttacttgtcgcttggtgtagtgacaagctcggtctaagtctggagttgggttccttcgcggcaggagtgatgatctcaacaactgatctcgctcagcatactcttgaacaggtggaacccatccgcaacttttttgcagcactgttccttgctagtatcggcatgttgatacatatgcacttcttgtggaaccatgttgacattctgctagcagctgtgttactggtgatagtgataaagacggtggtagttgctatcgttgttaaagtctttggatacaataacaaaactgcagtacttgttggtatgtcccttgcacagattggggaatttgcttttgttctgctaagtcgagcatctaatcttcacctaattgagagcaaattgtacctcctgcttctgggaacaactgctttaagcctggtaacaacaccattgctattcaagttgataccagcagttgtacatttaggagtgctcttacggtggttctctcccgacagctcaaccgagattggtttcaaaggagagttgtatcactcagagagtgcaaagcgtatatcactgatgatccaaggttctcttcacgactcttgaagtgttgatggtatgttcacagcataacacgcaacaggcgcgccaaaaattggagctctgcagagctttcgttcgtatcatcggtttcgacaacgttc

SEQ ID NO: 248 - DNA, 1045 bp, Arabidopsis thaliana
ttaattaaatgagtttaggtgctttgatggaagagaagagaagagcaacaacttcatcttcttcttctcaggtacatatgtcaaatgatatagattggcaaatgcttgataaatcgaggtttttcttcctcggtgctgctcttttctccggtgtatccactgctctttaccctattgtagttctcaaaacaaggcaacaagtctctccgactcgtgtctcatgtgccaacatttctctggctattgctagacttgaaggtcttaaagggttttacaagggttttggaacatctttgcttggaaccatcccggctcgtgctctctatatgactgctctagagattacaaagagtagtgtaggtcaagcaactgttaggttaggattgtctgatactacgtctttggctgttgctaatggtgcagctggtttgacctcggctgtggctgcccagactgtctggactccgattgatattgtgagtcaagggcttatggttcaaggcgatgtctccttgagtaagcatcttcctggagtgatgaactcttgcagatacagaaatgggtttgatgcttttagaaagattctttacacagatggaccaagagggttctacagaggatttgggatctcgatcttgacttacgcaccttccaacgcggtttggtgggcgtcttattctttggctcaaaaatcaatttggtctcgatacaagcactcctacaaccacaaggaagatgctggtggctcagtggtggttcaagcgttgagtgcagctacagcaagcggttgctcggctttagtaactatgccagtagacacaatcaagacgcggttgcaagtcttagacgcagaagagaacgggaggagacgagcaatgacagtgatgcagtcagtgaagagcttgatgaaggaaggaggagttggtgcttgttacagaggattaggaccaagatgggtctcaatgtcgatgtccgcaacaacgatgatcacaacctacgagttcttgaagcgcctagcaacaaagaagcagaaatgaggcgcgcc

SEQ ID NO: 249 - DNA, 953 bp, Glycine max
gctttcaaactctttgtttcttgtttgttgattaacccttaattaagatgtacttattccttaaccctcctgttaccctttttagctatttctatttgtgctgctttcatagaattgctagttacgtgggagaattaagcaccaagaagatgggaaggggtagggttcagctgaagcggatcgagaacaaaacaagccagcaagtgacgtttttcaagcgtagatcgggacttctcaagaaagccagcgaaatctctgtgctatgtgatgctcaagttgctttgattatattttctaccaaaggcaaactttttgagtattcctctgaacgcagcatggaagacctccttgaacgttacgagagatgtagccatacagcacttgctggagctaacaatgtcgaatcaccgggattttggtctttcgaacatatcaagctcaccgctaaagttgaagtcttggagaggaacataatgaatttctttggaaatgatctggatcccttgagtttgaaagagcttcacagtttggagcagcagattgagacatctctgaagcgcatccgaactagaaagaatcaagttatgaatcaatccgtctcagacctgcataaaaaggcaaggacattacaagtgcaaaacagatggctaggaaagatgaaggagaaagcgaagacagtgactgaaggtccacacaacggcccagaaactctaggctttgattcatccacactcaacttatcttctccacagctaccaccaccaccatcaccacaaagactggttccttctctaactctcagtgagacaatgcaaggaggaacaccagtggaagaaacgggtgaggctcaaacagtccctagtggcaattctctcatcccaccatggatgctgcgctgcatgtctgactagatttaaatacccaacaaattggagctctgcagagctttcgtt

SEQ ID NO: 250 - DNA, 1679 bp, Saccharomyces cerevisiae
ttcatttatttgtcagctttcaaactctttgtttcttgtttgttgattaacccttaattaatccgggcgcgcctgatttatcacaagtttgtacaaaaaagcaggctcctgcaggaccatgtcttacaattttacaggtacgcctacaggcgaaggaacgggtggtaactcgttgacaacagatttgaatacacaatttgacttggccaacatgggatggatcggtgtggcttcagcaggtgtgtggattatggtcccaggtatcggtttattatattctggtttatccaggaaaaagcatgctttatccttgctttgggcctcgatgatggcttccgccgtgtgtattttccaatggtttttctggggatactcattagctttctcacacaacactagaggtaacggttttattggtaccttggaattctttgggtttcgtaacgttttaggagccccatctagtgtcagttctcttcccgatatactgtttgccgtttaccaaggtatgtttgccgcagtcaccggtgccctaatgctaggtggtgcctgcgagagggcaaggttgtttcctatgatggtgttcttgtttttatggatgactattgtttattgtcctattgcatgctgggtctggaatgccgagggttggttggtcaaattgggtagcttggactatgcaggtggtttatgtgtccatttaacatctggacatggtggtctagtttacgctttgatactgggtaagcgtaatgaccctgttacacgtaaagggatgcccaagtacaaaccacattccgtcacctcggtggttttaggcacagtgttcttatggtttggttggatgttctttaacggaggctctgcaggtaatgcaactatacgagcatggtactctattatgtccacaaacttagctgctgcttgcggtggcttgacatggatggttatcgattatttcagatgcggaagaaagtggactacagttggtttgtgttcaggtatcatcgccggcctagtgggtatcaccccagccgccgggttcgtgccaatctggtcagccgttgtcattggtgtggttactggtgcaggatgtaaccttgctgttgacttaaagagtctattgcgcatcgatgatggtctagattgttactctatccatggtgtgggtggttgtattggttctgtattaactggtatctttgctgcagactatgtaaatgccactgcaggctcttacattagtccaattgatggtggctggatcaatcatcactataaacaagttggttatcaattagcaggtatatgcgctgcactagcctggactgttactgtcacatctatcttgcttctaactatgaatgccattccatttttaaaactaagattaagtgctgatgaggaagaattaggtaccgacgctgctcaaattggtgaatttacatacgaggaatccactgcttacatcccagaaccaatcagatctaaaacatcggcacaaatgccacctcctcatgaaaacattgatgataagattgtgggtaacacagacgcagaaaagaattctacgccttccgacgcttcttctactaagaacactgaccatatagtataactcgagacccagctttcttgtacaaagtggtgataaattggagctctgcagagctttcgtt

SEQ ID NO: 251 - DNA, 2271 bp, Arabidopsis thaliana
ttatttgtcagctttcaaactctttgtttcttgtttgttgattaacccttaattaagactccggattaaatgacacttctgtaacttcctatatttactaaaatgccatctcgcctctctccgccagatattccgccgctgcaaccgacgcctacggttagtgacggccatcatcgtttccagactcttccacttatcatagccggttctctgactttaaccggagttttactcatcctcgtcactttacttatttaccgaagactctaccgaaaccgtacggctccttcagatcttatctccaactccaagtctcctcaacactaccaatgtcgacgcttctcttactctcagctccgccgcgctacaaactctttctccgagtcgactcacctcggtcacggcggattcggctctgtttacaaagctgatttcccgagtggcggcgattcactcgccgtcaaagtcatggatacctccgctggttctttacaaggcgaacgtgagtttcacaacgagctttctctctcttctcacttaattggctctcctcatgtcgtctctctccttggattctcctccgatcgtcgtggtcggaagcttatcctcgtctacgaacttatggctaatcgtagtttacaagacgcgcttttggatcgcaaatgtgtggagcttatggattggaacaaaaggtttgagattgccacggatatagcaaaaggcatcgagtttcttcaccattgttgtgatccaattataatccatggagatattaaacctagtaacatccttctcgattctgatttcaaagccaaaatcggagatttcggtctcgcgagagtaaagtcggaggatttcgatactaggattctgattgaggaagaagataagagcaaggatgttgttgaagataatgggtcgattcttgaggagactgaaagcgtgattactgtgtttgaagaaggtaataatgttgtcaatctctcgccggagacttgtgggattagtgtcttgacagagacggtggcctctccgggtgaaaaatctggactttcgccagagaattgtgcagtgagcattttgacggtggaggtgggagcagcatctccggcgatggcatcgataccgtcaccggagacttgtgcgattagcgttttgacggatactggattgtcaccggaaagtagcaagcttaaagtgggatcgaagagagattggtggtggaaacaggacaacaatggtggaagcagaggagggattgaatcagggagtgtgaaggattacgtgatggaatggattgggagtgagattaagaaagagagacctagcaacaataaggaatggatcaacaatggtgatgggtcatcatcagtctctaagaagaagaagaaagagaagaagagaaagcctagagagtggtggaaggaagagttttgtgaagagctgactagaaagaagaggaaaaagaagaagaagaagaaaagagggttaagctcaatctcaagcattgactcttggtttcatagagacgatggtgcttcctctgttcatgaccacaatcttaatcctaccaagaggaagaagaggaatagtatagattggtgggtagatgggttaagtggggagctgaagtcagtcatgggtaaaaaaaacagtcaagattctggtttgtggtgtgatgtgaatgttcagaagagtggtggagtcagcagcacaccgagtatgagaggtacggtgtgttacattgcaccagaatgtggaggaggaggtgtgttgtctgagaaatgcgatgtttatagttttggggttctgcttttggttcttgtctcaggaagacggccattgcaggtgactgcttcgccgatgtcggagtttgagagggctaacttgatttcatgggctaagcaattagcttgcaatggtaaattgttggagttagttgataaatctatacactctttggagaaagagcaagcggttctttgtattactattgcattgctttgtctgcaaagatctccggttaagagaccaacgatgaaggagattgttgagatgctttcgggtgtgtctgagccaccgcatttgccgtttgagttctcaccctcgccgcctatgggttttccgtttaagtcaaggaagaaagcacggtgaaattcgggtttggttatgacttatgagctcagtcatcatttaaatacccagcaaatacccagcaaattggagctctgcagagctttcgttcgtatcatcggtttcgacaacgttcgt

SEQ ID NO: 252 - DNA, 1053 bp, Bacillus subtilis subsp. subtilis str. 168
gctttcaaactctttgtttcttgtttgttgattaacccttaattaatccgggcgcgcctgatttatcacaagtttgtacaaaaaagcaggctcctgcaggaccatgaaaaaagtacgtaaagccataattccagcagcaggcttaggaacacgttttcttccggctacgaaagcaatgccgaaagaaatgcttcctatcgttgataaacctaccattcaatacataattgaagaagctgttgaagccggtattgaagatattattatcgtaacaggaaaaagcaagcgtgcgattgaggatcattttgattactctcctgagcttgaaagaaacctagaagaaaaaggaaaaactgagctgcttgaaaaagtgaaaaaggcttctaacctggctgacattcactatatccgccaaaaagaacctaaaggtctcggacatgctgtctggtgcgcacgcaactttatcggcgatgagccgtttgcggtactgcttggtgacgatattgttcaggctgaaactccagggttgcgccaattaatggatgaatatgaaaaaacactttcttctattatcggtgttcagcaggtgcccgaagaagaaacacaccgctacggcattattgacccgctgacaagtgaaggccgccgttatcaggtgaaaaacttcgttgaaaaaccgcctaaaggcacagcaccttctaatcttgccatcttaggccgttacgtattcacgcctgagatcttcatgtatttagaagagcagcaggttggcgccggcggagaaattcagctcacagacgccattcaaaagctgaatgaaattcaaagagtgtttgcttacgattttgaaggcaagcgttatgatgttggtgaaaagctcggctttatcacaacaactcttgaatttgcgatgcaggataaagagcttcgcgatcagctcgttccatttatggaaggtttactaaacaaagaagaaatctaactcgagacccagctttcttgtacaaagtggtgataaattggagctctgcagagctttcgttcgtatcatcg

SEQ ID NO: 253 - DNA, 2841 bp, Arabidopsis thaliana
ttgtttgttgattaacccttaattaattagttctgaagcaaaagctagggtttttcttcttcttcttgaaaatgccattgaaagaagatgattgttgtttattcgctgaagaatacgatggtccaccattatcatacaatatcccttgtgctgttcctattaacgtcgagaaaatcccagtcgccgccgttgtttctccggtttgtatttccgataacatgtctttccctgtgattcaaccgattttatcagtagagagtaaaaagtttctgatagattcggtttctcctacttctgttatagctaattgtggatctaatcagcttgaattggtttctgattcaatcactgtttctcctacttcggttattgaacatactgaggaagaagaagaagaagaaggtggtgatggtgaggattgtgaattgagtagctctggagagttattgttgaggtcttgttcagtgaaagagagtttagacttgaatgagtcgtcttcgaatccgttagtaccggattgggaatcgaatgagtcagttttgagtatggattacccgtcgtctcgtgttactggagattgtgttagtgagactaatggtgatggtaagaagcaaccagttgttactttcttgggtattgcttctgatgatggatttgaggaagaggagagttgtagtaacctgaggcgggttcgggttgtaccggttaagaaacagccgcagacgaaaggtaagaagggttcttgttatcggtgttttaaagggagtaggtttacggagaaggaagtgtgtttagtttgtgatgctaagtattgtaatagctgtgtgcttagagctatgggttctatgcctgaaggaaggaaatgtgttacttgtattggctttcctattgatgaatcgaagcgagggagtttagggaaatgctctaggatgcttaagaggttgcttaatgatttggaggttaaacagattatgaagactgagaggttttgtgaagctaatcagttaccagctgagtatgtgtatgttaatggacaacctctttaccctgaagagctggttacacttcagacttgttctaatcctcctaagaagctgaaaccaggggactattggtatgataaagtgtctggactttggggaaaggaaggagagaagccttatcagataattagtcctcatctgaatgttggaggtcctattagtccggaagctagcaacggaaacactcaagttttcataaacggtcgggagattacaaaagtggagctacgaatgctgcagttggcaggagttcaatgtgcgggtaacccacatttttgggttaacgaggatggatcgtatcaagaagaaggacagaagaataccaagggatacatatggggcaaggctgggactaagttactttgtgctgtattgtcacttcctgtaccgtcaaaatctaccgcgaatgcttctggggaacaactctatagcgcaaatagcagaagcattctggaccatcttgagcataggactttgcaaaaaattcttttggttggaaacagtggttctggaactagcacaatattcaagcaggcaaagatcctttataaggacgtaccattcttggaagatgagcgtgaaaacataaaggtgattatccagaccaatgtgtatggttatctcggtatgcttcttgagggccgggagcggtttgaagaagaagctcttgctctcaggaacacgaagcagtgtgtccttgaaaatatacctgcagatgaaggagatgcgaaaagcaacgacaaaaccgtcaccatgtactccattggcccgaggcttaaagcattttctgattggctattaaagactatggctgctggaaatcttggggtcattttccctgcagcctctcgtgagtatgcgccactagttgaggagttatggagggatgcagctatccaagctacatacaaacggagaagtgagctaggactccttcccagtgtcgctagttacttcttggagcgggctattgacgtgttgacaccagattacgagccatcagatttggatatattatatgcagaaggagtcacttcatccagtggtctagcttgtctcgatttctcatttccacagactgcatcagaagagaatcttgatccttctgatcaccatgattccctgctcaggtaccagttaattagagtaccctcgagaggcctcggggaaaactgcaagtggatagatatgtttgaagacgtcggaatggttgtgtttgttgtttccatgagtgactacgaccaggtgtcagaagatggaaccaacaagatgttactcacaaagaaactctttgaaagcattatcactcaccccatctttgagaacatggacttcctcttgattctcaacaagtacgatctcttggaagaaaaagtagaacgcgttcctttggcacgctgcgagtggttccaagacttcaatcccgtggtcagtcgtcaccgtggttccaacaacggtaaccccactttgggtcagcttgccttccacttcatggcggttaagttcaagcggttttactcttccttgaccgggaaaaagctgtttgtttcttcaagcaaaagtttggacccaaacagtgttgattcgtcgctgaagttagctatggagatactgaaatggagtgaggagagaacaaacatctgcatgagtgaatactctatgtatagcactgagccaagttccttctcaaattgatgtttttcacagtcaacaaaagagtctaatgtatatggatttaaatacccagcaaattggagctctgcagagctttcgttcgtatcatcggtttcgacaacgt

SEQ ID NO: 254 - DNA, 1845 bp, Saccharomyces cerevisiae
tttgtcagctttcaaactctttgtttcttgtttgttgattaacccttaattaagatggctttacatcaatttgactatatttttgccattgccatgttatttgcatttttggatgcctttaacatcggggcaaacgacgtggcgaactcattcgcgtcgtcgatctcttctagatctctaaaatactggcaagccatggttttggcgggtctctgtgagttcttgggtgctgtcttggcaggcgcaagagtttctggtactatcaagaacaacattatagattcctccatttttaccaacgaccccgctgttttaatgcttactatgaccagtgctttgattggctcgtcttgttggttaacatttgctactgcaatcggaatgccagtttctactacacattccattgttggtggtacaattggcgctgggattgcagccggtggagctaacggtgtcgtttggggttggagtggtgtttctcaaattattgcgtcatggttcattgctccgattttggcaggcgcgatcgcagctatagttttttcaatttctaggttttctgtccttgaagttaagtctttggaaagatcgattaagaatgctttactgctggttggtgttttagtattcgccactttctctatcttaacaatgttgattgtctggaagggttctccaaacctacacttggacgatttatctgaaactgaaactgccgtatctattgttctcacaggtgcaattgcttcgatcgtttacttcatctttttctacccattctacagaagaaaagttttggaccaagattggacactaaagttgattgatattttcagaggtccatctttttactttaagtccactgatgatatcccaccaatgccagaaggccatcaattaacaatcgattattacgagggcagaagaaatcttggaacaactgtttctgttgaagacgaagaaaataaggcagcgagtaattctaatgattccgtcaaaaacaaagaagacatccaggaagtggacctggttagaactgaaactgaaccagaaacaaagttgtcaacgaaacaatattggtggtcattattaaagcaaggacctaaaaaatggcccttattgttctggttagtaatctctcatggttggactcaagacgtcattcatgctcaagttaatgatagagatatgttatctggtgacctgaaaggaatgtacgaaagatctaaattttacgacaatagagtagaatatatctattcggttctccaagccattactgcagccactatgtcttttgctcatggagctaatgacgttgccaacgctactggtcctttgtctgctgtgtatgtgatctggaaaactaacactattggggcaaagtccgaagttcccgtgtgggttctggcttatggtggtgttgccttagttattggttgctggacttatggttacaatattatcaaaaatctaggtaataagatgattttgcagtcgccatcaagaggcttttcaattgaactagctgttgctattactactgtcatggctacccaattaggtattcctacctcaacaacccagatcgccgttggtggtattgtcgctgttggtttatgtaacaaggatctcaaatcagttaattggagaatggtagcctggtgttattctggttggtttttaactttaccaattgctggtttgattgccggtatcataaatggtatcattttgaatgctcctcgctttggtgtggaataccaaatgacataaatttaaatacccagcaaattggagctctgcagagctttcgttcgtatcatcggtttcgacaacgtt

SEQ ID NO: 255 - DNA, 701 bp, Bacillus subtilis subsp. subtilis str. 168
tcatttatttgtcagctttcaaactctttgtttcttgtttgttgattaacccttaattaatccgggcgcgcctgatttatcacaagtttgtacaaaaaagcaggctcctgcaggaccatggatttaaaacaatacgtaacaattgtaccggattacccgaaagagggcgtgcaatttaaagatattacgacactgatggataaaggcgatgtataccgctatgccacagatcaaattgttgaatatgcgaaagaaaagcaaattgatttggtcgttggccctgaagcgcgcggctttattatcggctgtcccgttgcttacgcgcttggcgtaggttttgcgccggtccgcaaagaaggcaagttgcctcgtgaagtaatcaaagtggattatggcttggaatacggaaaagacgtattaacgatccacaaagatgcgattaagcctggtcagcgtgtgcttattacagatgacctgcttgcgacaggcggcacaattgaagcgacaatcaaacttgttgaagaacttggcggcgttgttgctggtatcgctttcttaatcgagctttcttaccttgacggcagaaataagctcgaagattacgacatcttaacattgatgaaatactaactcgagacccagctttcttgtacaaagtggtgataaattggagctctgcagagctttcgttcgtatcatcg

SEQ ID NO: 256 - DNA, 2536 bp, Arabidopsis thaliana
ttcatttatttgtcagctttcaaactctttgtttcttgtttgttgattaacccttaattaagaacccaaaagaaactaggaagaggagtaaataatatttgttttaaagaaatgattctccacaaaatggcgttcttggccgttattctcttcttcttgataagcagcagcagcgtttgcgttcatagccgtgaaacgtttgcttgcgatacaaaggacgcagcaacagctacactgagattctgccagctttcagttcctataccggagagagtcagagatttgatcggacggttgacattggccgagaaagtgagcttgttagggaacactgcggcggcgataccacgtctaggaatcaaagggtacgagtggtggtcggaggctttacacggcgtttcaaatgtgggacccggtactaagttcggtggggtttaccctgcagccaccagtttccctcaagtcatcaccaccgttgcttctttcaatgcctccttgtgggaatccatcggacgggttgtgtcaaatgaggccagggccatgtacaacggtggagttggtgggcttacgtattggagcccaaacgttaacatattgagggacccacgttggggacgtggacaggaaactcccggtgaagatccagtagtagccggtaaatacgcagcgagctacgtcagagggttacagggaaacgaccgtagccggttaaaagtagctgcttgttgcaaacatttcacagcttacgatctcgataactggaacggcgtcgacagattccatttcaacgctaaggtaagcaagcaagacatagaagacacgttcgacgtaccgttccgtatgtgtgttaaagaaggtaacgttgcgagcattatgtgttcgtacaatcaagttaatggtgttcctacatgtgctgatcctaatctcctcaagaagaccatacgcaatcaatggggtctcaacgggtatatcgtgtctgattgtgactctgtcggtgttttgtacgatacccaacattacactggtactcctgaagaagctgccgctgattccatcaaagctggcttggatttagattgtgggccatttctaggagcccatacaatcgatgcggtgaagaaaaacttgttgcgtgagtccgatgttgataatgccttaatcaacacgctaacagtccaaatgagactaggaatgtttgatggcgatatagcggctcaaccgtacggacaccttggaccggcacacgtgtgtacaccggttcacaaaggactagctctcgaagcagctcaacaaggaatcgtcctactcaaaaatcacggctcgtctctacctctctcaagccaacgtcaccgaactgtcgccgtaattggacctaattcagacgctacggtcacaatgattggtaattatgcaggggttgcttgtggatataccagtccggttcaaggtattaccggttatgctcgaaccattcatcaaaagggttgcgtggacgtacactgcatggatgatagattgttcgatgccgcggttgaagcggctcgtggagctgatgcgacggttcttgtgatgggtttggatcagtctattgaagcggagttcaaggacagaaacagtttgcttttgcctgggaaacaacaagagcttgtctctagagttgctaaggccgctaaaggcccagttatcttagtattgatgtctggtgggcctatcgatatatcttttgctgagaaggatcggaaaattccagcgattgtttgggccgggtatccgggtcaagaaggtggtaccgcaatcgccgatatcttattcggcagtgctaatcccggaggaaagcttccgatgacttggtatccgcaagattatttaaccaatttaccaatgacagaaatgtcgatgcggccggtccattcgaagcggatcccgggtcggacttaccggttctacgacggtccagttgtttacccgttcgggcatggtttgagttacacgcgctttactcacaacatagccgacgcgccaaaagtgattcctatagctgttcgtggaagaaacggcaccgtttcagggaaatcaatccgtgtgacgcacgctaggtgtgatcgtctctctctcggagtccacgtggaagttactaacgttggctcgagagatgggacgcacacaatgcttgtgttctcggctccgccgggtggagaatgggctccgaagaaacagctggttgcttttgagagagtacacgtggcggttggggagaagaagcgtgtgcaggtgaatatacacgtgtgtaagtatttaagtgtagtggaccgagccgggaaccgaaggattccgatcggtgatcatgggattcatattggagatgagagtcatacggtgtcgcttcaagcttctactcttggagtcatcaagtcttgactctgtttttttcttttcacttttcttgttgttcccatttaaatacccagcaaatacccagcaaattggagctctgcagagctttcgttcgtatcatcggtttcgacaacgttcgtca

SEQ ID NO: 257 - DNA, 1638 bp, Agrobacterium tumefaciens str. C58
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaagagtttcataaggtccggcgtctgccgcaatacgtcttcgaacaggtcaaccgtttgaaagcgagcgcgcgagcggccggggccgatatcatcgatctcggcatgggtaatcccgaccttccgacccccaaggccatcgtcgacaagctctgcgaagtcgttcaggacccgcgcacccatcgttattcctcgtccaagggcattcccggccttcgccgcgcacaggccggctattatgcccgccgtttcggcgtgaagctgaaccccgatacgcaggtcgtcgccacgcttggctccaaggaaggtttcgccaatatggcgcaggccatcacggcaccaggtgacgtgatcctgtgcccgaacccgacctatccgatccatgccttcggcttcctgatggcgggcggcgttatccgttcgatgaatgtggagccggatgagagcttcttcgggcctttagagcgggcggtgcgtcactctattccaaagccgctggcgctaatcgtcaactatccgtcgaacccgacggcgcatgtcgcatcgctcgatttctacaaggatgtgatcgcgtttgcgaagaagcacgaaatcatagtgctctccgatcttgcctattcggaaatctacttcgacgacaacaatccgccgccttcggttctcgaagttcccggcgcgatcgacgttgcggtggagttcacctccatgtcgaagaccttctccatgcccggctggcgcatgggcttcgctgtcgggaacgagcggctgatcgcggcgctgacccgcgtgaagtcctacctcgattacggcgccttcacgccgatccaggtggcggcgacgcatgcgctgaacggtgacggttccgacatcgccgaagtgcgcagcgtctatcgccgccgccgcgatgtcatggtcgatacgttcggcaaggccggcttcgaggttccgccgccggcagcgacgatgttcgcctgggcgaagatcccggaaaaattccgccatctcggcagcctggagttttccaagcttctggtcgagaaggcagatatcgccgttgctcccggcatcggctttggcgaaatgggcgatgattacgtccgtcttgcgcttgtggaaaacgagcatcgaattcgtcaggcagcgcgcaatctgaagcgtttcctgtcgagtgctgacgaaacgatgcacaatgtcgtttcgctcaacgcccacagataactcgagacccagctttcttgtacaaagttggcattataagaaagcattgcttatcccccaaatacccagcaaattggagctctgcagagctttcgttcgtatcatcggttt

SEQ ID NO: 258 - DNA, 1328 bp, Arabidopsis thaliana
ttaattaaaaaactgatgggtgtgatcaatgttcagggctctccatcgttctctattcattcttcagagtcaaatcttcgaaagtctcgagctttgaagaaacccttttgctcaatccggaatagggtttattgtgctcagtcttcaagtgcagctgtagacgaatccaagaatataactatgggagactcttttatccgtccacatttgagacaattggctgcttatcagccaattttaccctttgaggtattgtctgctcaattaggaagaaagcctgaggatattgtcaagttagatgctaatgagaacccatatggtcctcctccagaggtttttgaagcattaggcaatatgaaattcccttacgtttatcctgatccacaaagtcgtagacttcgtgatgcactggctcaagactctggtttggagtctgaatacatacttgtaggctgtggtgctgacgaacttattgatttgatcatgagatgcgtgttagatcctggggagaagattatagattgtcctccaactttctcaatgtatgtgtttgatgcggctgtgaatggagcaggtgtcattaaagttccaagaaaccccgatttcagcttgaatgtagaccgcatcgctgaagttgtagaactagaaaaacccaaatgcatattcctaacttctcccaacaatccagatgggagtatcatcagcgaggacgatctgttgaagattctagaaatgccaatacttgttgttctagatgaagcttacatcgaattctcaggagttgaatcacgcatgaaatgggtgaagaagtatgaaaaccttatcgttctccgcacatttagcaaacgagctggtttagccgggcttcgagttggatatggagcgtttccgttgagtataatcgaatacctgtggagagcaaagcaaccgtacaatgtctctgttgcaggggaagtagctgctttagcagcactctcaaacgggaaatacttggaagatgtgagagacgccttggtacgggaaagagagagactgttcgggctattaaaagaagttcctttcttgaatccatatccgagctattcgaatttcattctctgtgaggttacatctggaatggatgcaaagaagctgaaagaggatttggcgaaaatgggtgtgatggttcgtcattacaacagtcaagagcttaaaggttatgttcgagtttctgctggaaagcctgaacatactgatgttctcatggagtgtcttaagcaattttattgacttccccatttgtttgggaattcttaaaacagccacacaaaaataaaattgggcgcgcc

SEQ ID NO: 259 - DNA, 1445 bp, Arabidopsis thaliana
ttaattaaactcgtttttaaaggcaaggaagaagaaagactttgtttttaaaatgccaatgtttcagccttctaagaacggtgggtttgatgggcatatcttagatctacactcggcggttaaagacggtgttcttggcggcggagatgggaaatttctggtggttgttaccgatgagaagaagaaattggatttgaaggagatgatttctgagctggaattacctgaaataccctctgttttcatctgtcctatctctctagagccgatgcaagatccagtgaccttgtgtactggtcaaacctacgagaggtccaacattctcaaatggttcaatatagggcattgtacttgcccaacgacgatgcaagagctttgggatgatttggtcactcctaacaagactcttcaccaattgatctacacttggttttcacagaagtatgttttgatgaagaaacgatctgaagatgtgcaaggacgtgctattgagattctgggtacgttgagaaaggctaaagggaaagcaaaggttcatgctttaagcgagcttaagcaagttgtgatggctcacgctattgctaagaagactgttgttgatgaaggtggagtctttgtgatctcttctcttttaagtccttttacttctcacgctgttggatctgaggctatagctattcttgttaatcttgagcttgactctgattccaaagctggattgatgcaaccagctagggtctcgttgatggttgatatgttgaatgatggttcgattgaaactaagatcaattgtgctagattgattggaaggttggtggaggagaaaggttttagagcagagcttgtttctagtcatagtttgcttgttggattaatgagattggttaaagataggagacgaagaaacggcgtttcgcctgcgttaacgctgctcaaatcggtttctgttcataaacaagttaggaacttgttggttaggattggtgcagttcctcaattggttgatgttttgccatgtttggatgtggagtgtttagagtcagctcttttcgtgttggattcgttatgtttagaaagcgaaggcagaattgctttgaaagattcggttaacacgattccgcataccgttaggttactgatgaaggtatcagagaaatgcacaaactatgcgatatcgattctttggtcagtttgcaaattagcttctgaagaatgttcatctcttgctgttgaagttggtttggctgcaaagcttttgcttgtgatacaaagtggatgtgatccagctttgaagcaacgttcagctgagctattgaagttatgtagtctacattattcagactcaatgtttatctccaaatgtaaactcacaagaactatccaataaaagactgatcaagttttcacctttcgggtcaaaatcacacaacggatctgggcgcgcc

SEQ ID NO: 260 - DNA, 587 bp, Arabidopsis thaliana
ttaattaagtctgatttgagctaagttctctcatcataaactctccttggagaatcatggctatttcaaaagctcttatcgcttctcttctcatatctcttcttgttctccaactcgtccaggctgatgtcgtacgtctttttcatcacaaactaattatactcaatataatacttatgttttcaaaaacatatttctcacatgttacaacaatattcttgcaggaaaactcacagaagaaaaatggttacgcaaagaagatcggtaattatatgatttttattaaacctaacgttaaatttagagtgagattaataatctgtgtttttctttcttgtatatatagattgtgggagtgcgtgtgtagcacggtgcaggctttcgaggaggccgaggctgtgtcacagagcgtgcgggacttgctgctacaggtgcaactgtgtgcctccgggtacgtacggaaactacgacaagtgccagtgctacgctagcctcaccacccacggtggacgccgcaagtgcccataagaagaaacaaagctcttaattgctgcggataatgggacgatgtcgttttgtggcgcgcc

SEQ ID NO: 261 - DNA, 1114 bp, Arabidopsis thaliana
ttaattaaatgggaagtgtagaagcaggagaaaagaaggctttaggatgggctgcaagagatccttctggtgttctctctccttactcctacactttaaggagcacaggagcagatgatgtgtatataaaggttatatgctgtggaatatgccatactgatattcaccaaattaaaaatgatcttggaatgtctaattatcctatggttcctgggcacgaggtagtaggtgaggtgttggaagtgggatcagatgtgagcaagttcaccgtaggagatgtagtcggagtcggcgtggtcgttggatgctgcggtagctgcaaaccatgcagctcagaacttgagcagtattgtaacaagagaatctggagttacaacgatgtctacaccgatggaaaacctactcaaggtggcttcgccgacaccatgatcgtcaatcaaaagtttgtggtgaagattccagaaggaatggcggtggagcaggctgcaccgctactctgcgcgggagtaacggtttatagtccgttgagccacttcggtctaatggcgagtgggcttaaaggagggattctagggttaggtggagtagggcacatgggtgtgaagatagctaaagcaatgggacaccatgtgactgtgataagctcatcagataagaaaaaagaagaagctatcgaacatttaggagctgacgactatgtggtgagctctgatccagcagagatgcaaagactcgcagattcccttgactacatcattgacaccgtaccggtgtttcaccctctcgacccttacttggcttgtcttaaactcgacgggaaattgattctcatgggtgttatcaacactcctcttcagttcgtgacccctctcgtcattcttgggaggaaagtgatatcagggagctttatagggagcattaaagagacagaagaagtgttggctttctgcaaagagaaagggcttacgtcgacgattgaaactgtgaagatcgatgagcttaacattgcgtttgagaggcttcgcaagaacgatgttcgttacagatttgtggttgatgttgcaggaagtaatctggtggaggaggctgcaacaactacaaactaaggcgcgcc

SEQ ID NO: 262 - DNA, 1396 bp, Bacillus subtilis subsp. subtilis str. 168
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggaattgttaaaacgagaaggcttgtcattaactgaggaaaaagcgctgtggatgtaccaaaagatgctggagatcaggggctttgaagacaaagtgcatgaactgttcgcccagggagtgcttcccggattcgttcatttatatgccggtgaggaagccgtggctgtaggggtgtgcgctcatttacatgatggcgacagcattacaagcacccacaggggacatggacattgtatcgccaaaggctgtgacctggacggcatgatggcggaaattttcgggaaagcgaccggattgtgcaaaggcaagggcggttctatgcacattgcggatcttgataaaggcatgttaggcgcaaatggaatcgtcgggggcggctttacgctcgcatgcggatcagcgctcacggctaaatataaacagactaaaaatgtaagcgtttgctttttcggggacggggcaaataaccaaggtaccttccacgaagggctgaatttagcggctgtatggaaccttcctgtcgtatttgttgctgaaaacaacggctatggcgaagctaccccatttgagtacgcatcagcctgtgattcaatcgccgatcgggcggctgcttataacatgccgggggttacagttgacggcaaagatattttagcagtttaccaggcagccgaggaagcgatagaaagagcaagaaacggcggcggcccgtctttgattgaatgtatgacctacagaaactacggccatttcgaaggagatgcccaaacctataaaacgaaggatgaaagagttgagcaccttgaagaaaaagatgccattcaaggttttaaaaactaccttttaaaagaaacagatgctaataagctgtcagacattgaacagcgtgtcagcgaatcgattgaaaaagccgtctcgttcagcgaagacagcccatatccaaaagattcggagctgctgacagatgtgtatgtgtcatatgaaaaaggaggaatgtaagagatggcgagagtcataagcatgtcagacgcgatcaatatttaaatacccagcaaatacccagcaaattggagctctgcagagcttt

SEQ ID NO: 263 - DNA, 1044 bp, Bacillus halodurans
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggggaaaagaccaatcatcatcggcgtagccggagggactggctctggaaaaacaaccgtagcgaaggaaatattttatcaatttaatgaaaaatcgatcgtattaattgagcaagatgcatattataaagatcaatcacagttaagcttagaagaacgcttgcagacgaactatgaccatcctcttgcatttgacaatgatttgttaattgaacatctgcatagcttattaaacggtcaagcgattgaaaagccagtatatgactacaagctgcatacacgttcaaatgaagtgatcctagtggaaccgaaagacgtgatcattcttgaggggatcttactacttgaagatgaacggttacgcgagctaatggacattaaactgtttgttgatacagatgcagatatccgcatcattcgccgaatggtgcgcgatattcgtgagcgtgggcgaacgttggaatcggtcatcgaacagtatacaaaggtcgtccggccaatgcatatgcaatttatcgaaccgacaaagcgttatgcagatgtaatcatccctgaagggggacaaaatcgggtagccattgatttaatggtgacaaaaattcgcgcaattattgaagaaaaagccgttttataatagcatagagggaagcgagggtgaatcaccccttgcttcttttctacataatttaaatacccagcaaatacccagcaaattggagctctgcagagctttcgttcgtatcatc

SEQ ID NO: 264 - DNA, 775 bp, Synechocystis sp.
ttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggttgccctaattgacactgttaaatccattgataatcagctttcccgtcgtcatattgacctagaccccgcaggttattggttggtcatggtggagcgggaagctggagtgttgaaggtggagcactacagtaacgatattaatgaccagggtttggcggtggatccggaaacgggggaagtgattgcctgtcaaggggggagaaaaagactacccagtttgactttaactggtcgcactgccaaggagttgtgcgtgaagatttttgaggagttggaatcctgtccagtgactatgctcaaccatgctgcttacttgggtcgggaattgatgcgggcggaattagctctaactgggggcggagaatatattcaggattagttaaaccgtcctaaataagcaaattttgtcagcggcaatcaatagatttaaataccaaatacccagcaaattggagctctgcagagctttcgttt

SEQ ID NO: 265 - DNA, 1046 bp, Bacillus subtilis subsp. subtilis str. 168
actctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggtaaaggttgcaccatctattctttccgctgattttgccgctttaggcaatgagattaaagatgtagaaaaaggcggagccgattgtattcatattgatgttatggacggccattttgtcccgaatatcacaatcggtccgctgattgtagaagcggtccggccggtaacggatctgccgcttgatgtccatttaatgatagaagagccggatcgttatatcccggcttttgcgaaagcaggcgcagatatcctgtctgtgcatgctgaggcatgtccgcacctgcaccgtaccatccagctcattaaagagcaaggagtgaaggccggagtagttctaaacccgcatacccctgtacaagtcatcgaacatgttttcgacgatcttgatcttgttcttttaatgacggtgaacccgggcttcggcgggcagaaatttattcattcagtccttcctaaaataaaagaggttaagcgaatggcggatgaaaaaggaaaaaaagatctgttaattgaagtagacggcggcgtcaacaaagaaaccgctccgctcgtcattgaagcgggcgcaaatttactcgttgccggttcagctgtttatggccagtctgaccgcaaaaaagcaatttctgaaatcagaggaagtaaataagcagctttagaaaagagctgggcatacaatagcctaagatttaaatacccagcaaatacccagcaaattggagctctgcagagcttt

SEQ ID NO: 266 - DNA, 1045 bp, Synechocystis sp.
aactctttgtttcttgtttgttgattaacccttaattaaacaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccggtggtcgcgtcaactgcatgcaggccatggcctcctattcctctgcaacggcccgcgctgaaatgagtgaactgcggcgcttgaaaagtttactgccgccggaactccaaagttgggtaatggtggaaggcagtaccgaagttaatccccctctgatccgttcggaagaattggggcgggatgagattgaaattcaggtggatttggccaaatgggaaaacctggccattgaccagcggaatttactcttttggcacgaagtggcccgcattcagagtgataccattccccgggaaggttgggaaatggctgccttggcgatcggtttggggggtgcagtgggggaactgtgggtgcaagatggattgctcttacttttagccctgggattatgtggcatttctggctaccggctctggcaaaaaaataacggtgaaaaacggatcaaagaggcgatcgaggcggatgaaaaggccattaccctggctacccgtttcggctataccttgcctaatgcctacaaaagtcttggcagtgctttcaaaacattaatcgaacaaacccccaaccgtcgtcaacgcaaacagtatgaaacccgtctccaagccctgcgccaaagtgcagccaaaatgaaagctaaaacccaaaaggccaaggctctctaaacatagttgattgtctagttagtcaaagtcccttgtctcggatttaaatacccagcaaatacccagcaaattggagctctgcagagctttcgttcgtatc

SEQ ID NO: 267 - DNA, 1702 bp, Escherichia coli K12
ttcttgtttgttgattaacccttaattaatccgggcgcgcctgatttatcacaagtttgtacaaaaaagcaggctcctgcaggaccatgaaaatccgttcacaagtcggcatggtgcttaacctcgacaaatgtatcggctgccatacctgttcggtgacctgtaaaaacgtctggaccgggcgcgaaggcatggagtacgcatggtttaacaacgtcgaaaccaaaccgggcattggttatccgaaaaactgggaagatcaggaagagtggcaaggcggctgggtgcgtgatgtgaatggcaagatacgcccgcgtctgggcaacaagatgggcgtaataaccaaaatcttcgccaacccggtggtgccgcagattgatgattactacgaacctttcaccttcgactacgaacatttgcatagcgcaccggaaggcaaacatattcctactgctcgcccgcgttcactgattgacggcaaacggatggacaaagtgatctgggggccaaactgggaagaactgctgggcggtgagttcgaaaaacgtgcccgcgaccgcaacttcgaggccatgcaaaaggagatgtacgggcagtttgaaaacaccttcatgatgtacctgccgcgcctgtgcgaacactgcctcaatcccagctgcgtggcgacctgcccaagcggcgctatctacaaacgcgaagaagacggcattgtgctgattgatcaggataaatgccgtggctggcgtttgtgcataagcggttgtccgtacaaaaaaatctacttcaactggaaaagcggcaagtcagaaaaatgcatcttctgttacccacgaattgagtccggtcaaccgaccgtgtgctcagaaacctgcgtgggtcgcatccggtatctgggcgtgctgctttacgacgccgaccgcatcgaggaagcggcgagcaccgagcgcgaagttgacctctatgaacgccagtgcgaagtgttcctcgatccacacgatccctcagtgatcgaggaagccctgaaacaaggtattccacaaaatgtgattgacgctgcccagcgttcgccagtctacaaaatggcgatggactggaaactggcactaccgttgcaccctgaataccgcaccctgccgatggtctggtacgttcctccgctgtcaccgattcagtcctacgcagatgcgggcggtttgccgaaaagcgaaggcgtgctgcccgccatcgaaagcctgcgtattccggtgcaatatctcgccaatatgttgagtgccggcgataccggtccggtactgcgggcgctgaaacggatgatggcgatgcgccactatatgcgttcacaaaccgtggaaggcgttactgatactcgtgccatcgacgaagtaggcctgagcgtcgcccaggtcgaagagatgtatcgctatctcgccattgccaactatgaagatcgttttgttatcccgaccagccatcgggaaatggcgggcgatgccttcgcagaacgcaacggctgcggttttacctttggcgacggttgccacggttcggacagtaaattcaacctgttcaacagtagccgtatcgatgccatcaacatcaccgaagtgcgcgacaaagcggagggcgaataactcgagacccagctttcttgtacaaagtggtgataaattggagctctgcagagctttcgttcgtatcatcg

SEQ ID NO: 268 - DNA, 1523 bp, Xenorhabdus nematophila
aaaaaagcaggctcctgcaggaccatgacaaaccatcttgatgctgtattacacgattccctgttattgcgtcagcagggttacattgacgggaaatggcttgatgcagacaataaagccacctttgctgtgaccaaccctgctactggtgacatcatcgccaatgtcagtgatatgggggcagcagaaactcatcgtgcgattaaagctgccgaaaaagcgcttcctgcatggcgcgacctgacagccaaaaaacgtagccagatactcaggcagtggttcaatctggtcatcgataaccagaaaacactggccgaactgctgagtatcgagcaagggaagtcccatgcagaggcgatgggtgaaattgcttatggtgcaagttttatcgaatggtttgcagaagaaggcaaacgcatttacggtgaaactatcccttcccccatgccgggttgccgcacatccaccatcaagcaacccatcggagtggttgcagccattacgccgtggaatttccctaatgccatgattacccgaaaagtcagcccggcactggccgcaggttgtactgtcgtcctgaagccggccgcagaaaccccgctttccgcactggctctggttgttctggctgagcaagcgggagttccagcgggtgtctttaatattgtcaccggaatggatgccaaagcgattggggaagccctgacttcaagccctatcgtacgcaaactctcttttaccggatcgacacgagtgggtaaattgctcatggcacaaagcgccgatacggtgaaaaaactctctcttgaattaggtggcaatgcaccttttattgtttttgatgatgccgacttagatgccgcagttaaaggtgcaatggcagcgaaattccgtaacagcggtcagacttgtgtctgcgcaaaccggatcctggttcaggaaaacatttacgaggcatttgctgagcgtctggctcaggcagccagagaactgcatgttggaccagccagtgatagctcctcacagcagggccctctgattaatcaggctgcgatagataaagttcaggcgcatgttagtgatgccgtttcccgtggtgcaaggcttctgaccggaggaaaatcccataaactgggtggcctgttctttgagccaaccgtactggctgatattgatgaaacaatgcaagtcgcccatgaagaaacattcggccctctggctgccctgttcaaattccgggatgaagaagaggccattcgcattgccaacagcacagagtacgggctggctgcctacttttattcccgcgatatcggcaggatttaccgtgtagcagaagcgctggaaagcggcatggtcggcattaacgaagggctgatttccaacgaagctgttccgttcgggggcataaaacagtctggtctggggcgtgaggggtcgcgctacggcatagaagattatctggaagtgaaatacctctgtttcggaggattataactcgagacccagctttcttgtacaaa

SEQ ID NO: 269 - DNA, 1882 bp, Bacillus subtilis subsp. subtilis str. 168
ttcttgtttgttgattaacccttaattaatccgggcgcgcctgatttatcacaagtttgtacaaaaaagcaggctcctgcaggaccatggcacacaaaactgcaggacaagcaatgacagagctgcttgagcaatggggagttgatcatgtatacggcatccccggagacagtataaatgagtttatcgaagaattaagacacgaaagaaatcaactgaagttcattcaaacccgccacgaagaggtagcggcactggcagccgcggctgaagcaaaactcaccggcaagatcggagtctgtctgtcaatcgcagggccgggagcggtgcacttattaaatggtttatatgatgctaaagccgacggcgcccctgtgctggcgattgcaggacaggtttcttctggcgaagtcggacgggactatttccaggagattaagctggagcaaatgtttgaggacgtggccgtgttcaacagagaggtacatagcgcggaatcacttccggatctcttaaatcaggcgatcaggaccgcctacagcaaaaaaggcgttgcggtattgagcgtgtcagatgatttgtttgcggagaaaatcaaacgggagcccgtgtatacttcaccggtgtatattgaagggaacctagaaccgaaaaaagaacagctcgtcacctgcgcccaatatattaataacgctaagaaaccgattatcctggcagggcagggaatgaaaaaggcgaaacgggagctcttagaatttgcggacaaagccgccgctccgatcgttgttacactcccggcaaagggtgttgttcccgataagcacccacattttctcggcaacctcggtcagatcggaacaaagccggcttacgaggcaatggaggaatgtgatttattaatcatgctcggaacgtcattcccgtaccgtgattatttgcctgatgacacgccggcgatacagctcgattcagacccggcaaaaatcggaaaacggtatccggtgacagcgggccttgtctgtgattcggctctcggtttgcgcgaattgacagagtatattgaacgcaaggaagacagaagattcctgaatgcctgcacagaacatatgcagcattggtggaacgaaattgaaaaagatgagacagaggcaacaacaccgcttaaacctcagcaggtcgtggcccgtcttcaggaagcggcagccgatgatgcggtgctctctgtagatgtcggcactgtgacagtctggatggcgcgtcatttcaaaatgaatgcgaatcaggatttcatcgtttccagctggcttgcgacaatgggctgcggcctgccgggagcgattgcagcgagcttgtccgaaccggaacgccaggcgatcgccgtctgcggtgacgggggattttccatggtcatgcaggaccttccgaccgccgttaaatataagctcccgatcacagtcgttattttaaacaacgaaaatctcggcatgattgagtacgagcagcaggtcaaaggcaatatcgactatgtcacaaaacttcaaaatgtcgactatgccgcatttgcagaaagctgcggagcaaagggcatcaaagtgaccaaagcggaagagcttgcgccggcttttcatgaggcgctgcactctgaccaaccggtcgtagtggatgtcatgattggaaacgaaccgccgcttcctggcaaaatcacctacgggcaggcgaaaggctttagcaagtacatgctgaaaaacttcttcgaaaaccaaaaatttgaaatgccgtcactgaagaaaagtttgaaacggttattttaactcgagacccagctttcttgtacaaagtggtgataaattggagctctgcagagctttcgttcgtatcatcg

SEQ ID NO: 270 - protein, 288 aa, Arabidopsis thaliana
MSSALPLKLLLPLTTTSLLPSPFRSDNPNFYRRRSSSSTSCSSQSQSFQLFSVRRRRSRSSSPSIPMCFPEQTRDQDDVDSWVNKEDNVTCRFDSDEDTTTTGLRIPTQAQAIVEGPGSLAVSELQRVPDVDYIQELLAIQQQGPRTIGFFGTRNMGFMHQELIQILSYAMVITKNHIYTSGAAGTNAAVIRGALRAERPELLTVILPQSLKKQPPESQELLSKVQNVIEKPHNDHLPLLEASRLCNMDIISQVQQIICFAFHDSKLLMETCQEARNLRKIVTLFYLD

SEQ ID NO: 271 - protein, 368 aa, Arabidopsis thaliana
MSSTTIGEHIRLRRARNQTIRHLHAADDDPPLSHVVLPISQPNRFCNSAMSSFFPLPTSSSNESTRKKPYQTSSFRGMGCYAAAAAAAQEVSVPSVIRYSADLDARIRKDKKKKKHKHKKKKKKNKGSYEDGSIRILSEEARDVIDVWCRPGLGFSTDAVIGRSVDPPRGRNIPSSRRKIDVDNNNYNHTLGSSVLPIRFLNQETHSHDIFNSDSTFVTSSRAEPTMLSSRCRGHLPRSYPDDLTEMRMLQNGFVMGRITDSRDNYHELRLDVDSMSYEQLLELGDRIGYVNTGLKESEIHRCLGKIKPSVSHTLVDRKCSICQDEYEREDEVGELNCGHSFHVHCVKQWLSRKNACPVCKKAAYGKP

SEQ ID NO: 272 - protein, 82 aa, Arabidopsis thaliana
MEGLIPLVYKAVMQIRYGNESQQLSSSYYVRLPGDSGRFVRSDLDVSGPGSNSSNRASSSTSTTTFAVYAGVQSPVSRQVVT

SEQ ID NO: 273 - protein, 250 aa, Arabidopsis thaliana
MGRGRVELKRIENKINRQVTFAKRRNGLLKKAYELSVLCDAEVALIIFSNRGKLYEFCSSSSMLRTLERYQKCNYGAPEPNVPSREALAELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 274 - protein, 313 aa, Arabidopsis thaliana
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 275 - protein, 225 aa, Arabidopsis thaliana
LINVMKSMRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLAPTNMVRLGLALNFSIFNYEIHKSIESACKLVKKAYDEAITELDGLDKNICEESMYIIEMLKYNLSTWTSGDGNGNKTDG

SEQ ID NO: 276 - protein, 244 aa, Arabidopsis thaliana
MPKILWKSLHLCFPSNLTKCYSSPCIPPSSADPDGIIQPNRPSIVLLNNFNLLYHNDNHHHPHRVIDLPSSSTTTTPAATSSSSTSSYESDISPDVSAAFASRRFFFSSPGRSNAITDSPEPRSREFSDNYDDATITSTKKKKKKVYDNSVTTTTTRLISGGTAVTQHVDSPDPLTDFRRSMQEMIDAAIDAGELSRDPNDGYDFLDELLLTYLSLNPADTHKFVIRAFSDILVSLLSEERRIC

SEQ ID NO: 277 - protein, 325 aa, Arabidopsis thaliana
MAALPVFIPAESFPSILSHETLINHFRTNLPKHSSTITSPVRQNYTVSSPSSLLLMPSWSSSSSLPYMGVKLVTYFPHNSSQNLPGIHGSYTLFSSTTGQTLATMDGTVLTLYRTSSVSGLGSKILARDDSQVLIMVGSGALAPHLIKSHLAAKPSLRRVIIWNRTPQRAQELAETLSKDPQHKEISFDSHDSLDQIIPLGDIISCATNSTVPLVKGEFLKPGTHLDLVGSFSHEMKECDDNAIQRGSVFVDNDTAMIEAGELAGAFERGVIKREDICGNLVELIKGDKEGRKSSTDITVFKSVGSGTVDLLTAQLVHETYLSRC

SEQ ID NO: 278 - protein, 359 aa, Arabidopsis thaliana
MAENYDRASELKAFDEMKIGVKGLVDAGVTKVPRIFHNPHVNVANPKPTSTVVMIPTIDLGGVFESTVVRESVVAKVKDAMEKFGFFQAINHGVPLDVMEKMINGIRRFHDQDPEVRKMFYTRDKTKKLKYHSNADLYESPAASWRDTLSCVMAPDVPKAQDLPEVCGEIMLEYSKEVMKLAELMFEILSEALGLSPNHLKEMDCAKGLWMLCHCFPPCPEPNRTFGGAQHTDRSFLTILLNDNNGGLQVLYDGYWIDVPPNPEALIFNVGDFLQLISNDKFVSMEHRILANGGEEPRISVACFFVHTFTSPSSRVYGPIKELLSELNPPKYRDTTSESSNHYVARKPNGNSSLDHLRI

SEQ ID NO: 279 - protein, 789 aa, Arabidopsis thaliana
MAPAESGVSPRRNPSQLSWMNLSSNLILAYQSFGVVYGDLSTSPLYVFPSTFIGKLHKHHNEDAVFGAFSLIFWTLTLIPLLKYLLVLLSADDNGEGGTFALYSLLCRHAKLSLLPNQQAADEELSAYKFGPSTDTVTSSPFRTFLEKHKRLRTALLLVVLFGAAMVIGDGVLTPALSVLSSLSGLQATEKNVTDGELLVLACVILVGLFALQHCGTHRVAFMFAPIVIIWLISIFFIGLYNIIRWNPKIIHAVSPLYIIKFFRVTGQDGWISLGGVLLSVTGTEAMFANLGHFTSVSIRVAFAVVVYPCLVVQYMGQAAFLSKNLGSIPNSFYDSVPDPVFWPVFVIATLAAIVGSQAVITTTFSIIKQCHALGCFPRIKVVHTSKHIYGQIYIPEINWILMILTLAMAIGFRDTTLIGNAYGIACMVVMFITTFFMALVIVVVWQKSCFLAALFLGTLWIIEGVYLSAALMKVTEGGWVPFVLTFIFMIAMYVWHYGTRRKYSFDLHNKVSLKWLLGLGPSLGIVRVPGIGLVYSELATGVPAIFSHFVTNLPAFHKVVVFVCVKSVPVPHVSPEERFLIGRVCPKPYRMYRCIVRYGYKDIQREDGDFENQLVQSIAEFIQMEASDLQSSASESQSNDGRMAVLSSQKSLSNSILTVSEVEEIDYADPTIQSSKSMTLQSLRSVYEDEYPQGQVRRRHVRFQLTASSGGMGSSVREELMDLIRAKEAGVAYIMGHSYVKSRKSSSWLKKMAIDIGYSFLRKNCRGPAVALNIPHISLIEVGMIYYV

SEQ ID NO: 280 - protein, 301 aa, Arabidopsis thaliana
MDKPSFVIQSKEAESAAKQLGVSVIQLLPSLVKPAQSYARTPISKFNVAVVGLGSSGRIFLGVNVEFPNLPLHHSIHAEQFLVTNLTLNGERHLNFFAVSAAPCGHCRQFLQEIRDAPEIKILITDPNNSADSDSAADSDGFLRLGSFLPHRFGPDDLLGKDHPLLLESHDNHLKISDLDSICNGNTDSSADLKQTALAAANRSYAPYSLCPSGVSLVDCDGKVYRGWYMESAAYNPSMGPVQAALVDYVANGGGGGYERIVGAVLVEKEDAVVRQEHTARLLLETISPKCEFKVFHCYEA

SEQ ID NO: 281 - protein, 695 aa, Arabidopsis thaliana
MAALLASQSCCYGGETARVTKAIGFSSSLENHFTGEATQCYGSKSKRFRIEMRQSELPSKVGINGRSVKMVPASEVVKRKDGVNGSAGKGVNGASLVSSRNINGAASTLVKAPKKTTESYLPPPVEGVRVLPSDEGFSWADENYSSLQRSIDVWSFVISLRIRILFDNSKWAYVGGFTEEKQKSRRRETASWLRESVLQLGPTFIKLGQLSSTRSDLFPREFVDELSKLQDRVPAFSPEKAKRFIEAELGAPISVMYKEFEEQPIAAASLGQVHRAVLHNGEKVVVKVQRPGLKKLFDIDLRNLKLIAEYFQKSESFGTNDWVGIYEECALILYQEIDYINEAKNADRFRRDFRNINWVRVPLVYWDYSAMKVLTLEYVPGVKINNLDALAARGFNRSRIASRAIEAYLIQILKTGFFHADPHPGNLAIDVDESIIYYDFGMMGEIKTFTRKRLLDLFYSVYEKGAKKVMQNLIDLEALQPTGDLSSVRRSVQFFLDNLLSQSPDQQQTLAAIGEDLFAISQDQPFRFPSTFTFVIRAFSTLEGIGYILDPEFSFVKVAAPYAQELLDLKQRQRSGTQLVQEIRKQADDARSSTLSMPYRVQRIEEFVKELDSGDLKLRVRVLESERAARKATILQMATMYTVLGGTLLNIGVTFSNQGSQLVANGSFIGAGIFMLLVLRSMQRVNKLDKFEKMI

SEQ ID NO: 282 - protein, 382 aa, Arabidopsis thaliana
ATMICIDNSEWMRNGDYSPSRLQAQTEAVNLLCGAKTQSNPENTVGILTMAGKGVRVLTTPTSDLGKILACMHGLDVGGEINLTAAIQIAQLALKHRQNKNQRQRIIVFAGSPIKYEKKALEIVGKRLKKNSVSLDIVNFGEDDDEEKPQKLEALLTAVNNNDGSHIVHVPSGANALSDVLLSTPVFTGDEGASGYVSAAAAAAAAGGDFDFGVDPNIDPELALALRVSMEEERARQEAAAKKAADEAGQKDKDGDTASASQETVARTTDKNAEPMDEDSALLDQAIAMSVGDVNMSEAADEDQDLALALQMSMSGEESSEATGAGNNLLGNQAFISSVLSSLPGVDPNDPAVKELLASLPDESKRTEEEESSSKKGEDEKK

SEQ ID NO: 283 - protein, 103 aa, Arabidopsis thaliana
MWSNKFFFLLPVVCIVVFATSQPLPSPQPSQLDCWSSLEVIPDCVPEIFRSITNGQFGNVGPSCCHAFIGLDTECIPQMFIFAPLIPPSRRLRDHCSHKIIVP

SEQ ID NO: 284 - protein, 270 aa, Arabidopsis thaliana
MQQGDSMLSLRPGGGRGGSRRFAPRFTLSSSSDLTNGGDAPSFARGNSRLLPQGSGGLLNDRPSALVQGNGSQQPKPVPSPTRQTVEKPKPQPQPQEVAPPTTTSLNTVELSRKTNSLLEEYFNVRLLDEALQCIEELKTPSYHPELVKEAISLGLEKNPPCVEPVAKLLEHLVSKNVLTPKDLRNGCLLYGSMLDDIGIDLPKAPNNFGEILGSLVMAKASDSELVKEILMKMGDEWFKKAVLEAVMRSVSESLLTTEAVEVEACRGLV

SEQ ID NO: 285 - protein, 334 aa, Xenorhabdus nematophilus
METLGEFIVEKQHDFPHATGELTALLSAIKLGAKIIHRDINKAGLVDILGTSGVSNVQGEVQMKLDLYANEKLKAALKARGEVAGIASEEEDDIVIFDGDRAENAKYVVLMDPLDGSSNIDVNVSVGTIFSIYHRITPIGQPVTEEDFLQPGHRQVAAGYVVYGSSTMLVYTTGCGVHTFTYDPSLGVFCLTHEKVQFPAKGNMYSINEGNYIKFPQGVKKYIKYCQEQDEETQRPYTTRYVGSLVADFHRNLLKGGIYIYPSTASHPTGKLRLLYECNPIAFLAEQAGGKASDGTNRILDIVPNQLHQRVPLFVGTKSMVEKAESFMAEFPEE

SEQ ID NO: 286 - protein, 486 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMEFEQSHVLKELPKQFFASLVQKVNRKLAEGHDVINLGQGNPDQPTPEHIVEEMKRAVADPENHKYSSFRGSYRLKSAAAAFYKREYGIDLDPETEVAVLFGGKAGLVELPQCLLNPGDTILVPDPGYPDYWSGVTLAKAKMEMMPLVKDRAFLPDYSSITAEIREQAKLMYLNYPNNPTGAVATSEFFEDTVRFAAENGICVVHDFAYGAVGFDGCKPLSFLQTEGAKDIGIEIYTLSKTYNMAGWRVGFAVGNASVIEAINLYQDHMFVSLFRATQEAAAEALLADQTCVAEQNARYESRRNAWITACREIGWDVTAPAGSFFAWLPVPEGYTSEQFSDLLLEKANVAVAAGNGFGEYGEGYVRVGLLTSEERLKEAAYRIGKLNLFTQKSIDKTL

SEQ ID NO: 287 - protein, 353 aa, Arabidopsis thaliana
MALSSKTLKSTLFFLSIIFLCFSLILAHGGIDDGDEEEETNQPPPATGTTTVVNLRSKSLVLVKIYCIIILFFSTFLAGVSPYFYRWNESFLLLGTQFSGGIFLATALIHFLSDANETFRGLKHKEYPYAFMLAAAGYCLTMLADVAVAFVAAGSNNNHVGASVGESREDDDVAVKEEGRREIKSGVDVSQALIRTSGFGDTALLIFALCFHSIFEGIAIGLSDTKSDAWRNLWTISLHKVFAAVAMGIALLKLIPKRPFFLTVVYSFAFGISSPIGVGIGIGINATSQGAGGDWTYAISMGLACGVFVYVAVNHLISKGYKPREECYFDKPIYKFIAVFLGVALLSVVMIWD

SEQ ID NO: 288 - protein, 203 aa, Arabidopsis thaliana
MGNTDKLMNQIFDLKFTSKSLQRQSRKCEKEEKAEKLKVKKAIEKGNMDGARIYAENAIRKRSEQMNYLRLASRLDAVVARLDTQAKMTTITKSMTNIVKSLESSLATGNLQKMSETMDSFEKQFVNMEVQAEFMENAMAGSTSLSTPEGEVNSLMQQVADDYGLEVSVGLPQPAGHAIPTKTEEKVDEDDLSRRLAELKARG

SEQ ID NO: 289 - protein, 196 aa, Saccharomyces cerevisiae
MKATIQRVTSVFGVPRASVFVPRISTPFILHNYISNGRMDLFSKEFHNGRVSKSDLWSSNKEEELLVSQRKKRPISPHLTVYEPEMSWYLSSLHRISGVLLALGFYAFTITLGVTTIMGMDTTFQDLNKWYHEKMPKWSQWVAKGSAAYLFAFHFGNGIRHLIWDMGYELTNRGVIKTGSIVLAGTLVLGTYLLAQ

SEQ ID NO: 290 - protein, 141 aa, Arabidopsis thaliana
MSGSVFVPGMAIGVPTLSRSSSVHRSLEPTKKMTMSSVKFVTSFRNPSNCSGTKRSFRVMASDDRSEQADNGQGIQEDLNYLLKIGVGSVAGAAIIKYGSVLFPQITRPNLTLALFIIIAPVVISVILLSLSSSSSSKKQN

SEQ ID NO: 291 - protein, 180 aa, Arabidopsis thaliana
MSHRRDYGSDAVHVRITHDPPPENCFPNSGDSSVWATEDDYSRVWAINSDGAESPSKKTRSSSSSEIGKSFFKTKLCFKFRAGTCPYSASSCHFAHSAEELRLPPPPPPNWQETVTEASRNRESFAVSLGPRGNVAQTLKSPNWKTRICNKWQTTGYCPFGSHCHFAHGPSGKATAFFIY

SEQ ID NO: 292 - protein, 607 aa, Arabidopsis thaliana
MMWKNIAGLSKAAAAARTHGSRRCFSTAIPGPCIVHKRGADILHDPWFNKDTGFPLTERDRLGIRGLLPPRVMTCVQQCDRFIESFRSLENNTKGEPENVVALAKWRMLNRLHDRNETLYYRVLIDNIKDFAPIIYTPTVGLVCQNYSGLYRRPRGMYFSAKDKGEMMSMIYNWPAPQVDMIVITDGSRILGLGDLGVQGIGIPIGKLDMYVAAAGINPQRVLPIMLDVGTNNEKLLQNDLYLGVRQPRLEGEEYLEIIDEFMEAAFTRWPKAVVQFEDFQAKWAFGTLERYRKKFCMFNDDVQGTAGVALAGLLGTVRAQGRPISDFVNQKIVVVGAGSAGLGVTKMAVQAVARMAGISESEATKNFYLIDKDGLVTTERTKLDPGAVLFAKNPAEIREGASIVEVVKKVRPHVLLGLSGVGGIFNEEVLKAMRESDSCKPAIFAMSNPTLNAECTAADAFKHAGGNIVFASGSPFENVELENGKVGHVNQANNMYLFPGIGLGTLLSGARIVTDGMLQAASECLASYMTDEEVQKGILYPSINNIRHITAEVGAAVLRAAVTDDIAEGHGDVGPKDLSHMSKEDTVNYITRNMWFPVYSPLVHEK

SEQ ID NO: 293 - protein, 418 aa, Arabidopsis thaliana
MSGATTASSGDHNNLRLPTPTLDAESQTLLQSISAEGGYAYARMAVLAVAGDQSAAEAARDMAWEQLHSGPWHSVLPVWRDAYSMACLHVAKIHFAAGEFGEALGALDMGLIMGGMLLRKDLHDSVLLVSSEARKMTKSLEEASGDFKGERLVPEVPVDVNEVLKILPCRSLTCKRVEKRSGLSLEGFLRDYYLPGTPVVITNSMAHWPARTKWNHLDYLNAVAGNRTVPVEVGKNYLCSDWKQELVTFSKFLERMRTNKSSPMEPTYLAQHPLFDQINELRDDICIPDYCFVGGGELQSLNAWFGPAGTVTPLHHDPHHNILAQVVGKKYIRLYPSFLQDELYPYSETMLCNSSQVDLDNIDETEFPKAMELEFMDCILEEGEMLYIPPKWWHYVRSLTMSLSVSFWWSNEAESSSS

SEQ ID NO: 294 - protein, 515 aa, Arabidopsis thaliana
  unsure (1)..(515): unsure at all Xaa locations
MIMILFLCLIILFIITILFFKKHKTVNKIINFPSPPRLPLIGNLHQLSQHPHRSLCYLSHRYGPLMLLHFGSVPVIVASTAEAARDVLKTHDRVFASRPRSKIFEKLLYKSRNMASAPYGEYWRQMKSVSVLHLLSNKMVRSFQDVRQEEITLMMETIRKSSSKPVNLSKILSSLTNDVICRVALGRKYGVGTDFKELIDRLMRQLGTFTIGSYVPWLAWTDWVSGLEARLEKTANDFDKLLERIVQDHEDGDGDKTDFVDVLLAAQRDKSFGFDIDRLSIKAIVLVREKIYIKFKSNXRLLYITINCFGLDFTFQDAFVGGTDTSSTLVEWEMTELLRHPTCLKKLQEEVRTICKGKSSVSEDDIQGMEYLKAVVKEALRLHPPVPLMVPHQSTQDVRLRDNHIPAGTQVIVNLWAVGREAATWGPDANEFRPERHLESPSDFRGQDFELIPFGAGRRMCPGISFAVVLNEVVLANLVHGFDWQSIDDETDVAESIGSVIRRMHPLYVIPSSTT

SEQ ID NO: 295 - protein, 651 aa, Arabidopsis thaliana
MDSKGVVSLPLIHNHQMMPWNDLRKGDCCGHFEAISDGYYCKRCDFFVHKTCGDGVSEYIEHPSHPNHTLELCSNLRFHCDLCGRRTNYLSYYCEICGFIVDLHCAMYPPPEFIENSERHHHKLTLLKERIAAFDCDAKCGKISGNEFAYKCQECDLTFHVDCVWHPSEVYHPLEVNHSYHPSHPLKLHTGQRPDYSDGACRLCARKIDDRYFYHCSSCNFTLDMRCVLHPPQQSLLNLKAHDHQLTLLPRLDSFTCNACGLKGDRSPYVCFQCGFMIHQDCLSLPRLININRHDHRVSRTSVLGVVNSVCEVCHRKVDWTCGGFSCQRCSGYVVHSKCATNKDVWNGKELEGVPEETEDIKPFVVIDNNTIQHFSHKKHYLRLHVNGVLCDDKKRCRACTHPICLQSFYGCMDCDFILHQNCAGFPRKRWHVLHNERLTLVSYEYDFFQCQACNRFSNGFSYQYSGITFDVGCGSISEPFVHPSHPDHPLYYTLLDEETKSSCNGCNKSSYSVLRCIEDDCRFAICFKCATFPQVVKHRVDDHPLSLCFDKEASGKYWCDICEKETNPETWFYTCKDYRASLHIKCVLGDFSWLMPGSTIDLSELSKVVLNNSISRPFCSGCKMHCIFPIILKIVGTSDKYFCSIECAFG

SEQ ID NO: 296 - protein, 587 aa, Saccharomyces cerevisiae
MSSVNKDTIHVAERSLHKEHLTEGGNMAFHNHLNDFAHIEDPLERRRLALESIDDEGFGWQQVKTISIAGVGFLTDSYDIFAINLGITMMSYVYWHGSMPGPSQTLLKVSTSVGTVIGQFGFGTLADIVGRKRIYGMELIIMIVCTILQTTVAHSPAINFVAVLTFYRIVMGIGIGGDYPLSSIITSEFATTKWRGAIMGAVFANQAWGQISGGIIALILVAAYKGELEYANSGAECDARCQKACDQMWRILIGLGTVLGLACLYFRLTIPESPRYQLDVNAKLELAAAAQEQDGEKKIHDTSDEDMAINGLERASTAVESLDNHPPKASFKDFCRHFGQWKYGKILLGTAGSWFTLDVAFYGLSLNSAVILQTIGYAGSKNVYKKLYDTAVGNLILICAGSLPGYWVSVFTVDIIGRKPIQLAGFIILTALFCVIGFAYHKLGDHGLLALYVICQFFQNFGPNTTTFIVPGECFPTRYRSTAHGISAASGKVGAIIAQTALGTLIDHNCARDGKPTNCWLPHVMEIFALFMLLGIFTTLLIPETKRKTLEEINELYHDEIDPATLNFRNKNNDIESSSPSQLQHEA

SEQ ID NO: 297 - protein, 571 aa, Saccharomyces cerevisiae
MSMSSKNENKISVEQRISTDIGQAYQLQGLGSNLRSIRSKTGAGEVNYIDAAKSVNDNQLLAEIGYKQELKRQFSTLQVFGIAFSIMGLLPSIASVMGGGLGGGPATLVWGWFVAAFFILLVGITMAEHASSIPTAGGLYYWTYYYAPEGYKEIISFIIGCSNSLALAAGVCSIDYGLAEEIAAAVTLTKDGNFEVTSGKLYGIFAGAVVVMCICTCVASGAIARLQTLSIFANLFIIVLLFIALPIGTKHRMGGFNDGDFIFGKYENLSDWNNGWQFCLAGFMPAVWTIGSFDSCVHQSEEAKDAKKSVPIGIISSIAVCWILGWLIIICLMACINPDIDSVLDSKYGFALAQIIYDSLGKKWAIAFMSLIAFCQFLMGASITTAVSRQVWAFSRDNGLPLSKYIKRVDSKYSVPFFAILAACVGSLILGLLCLIDDAATDALFSLAVAGNNLAWSTPTVFRLTSGRDLFRPGPFYLGKIWSPIVAWTGVAFQLFIIILVMFPSQQHGITKSTMNYACVIGPGIWILAGIYYKVYKKKYYHGPATNLSDDDYTEAVGADVIDTIMSKQEP

SEQ ID NO: 298 - protein, 626 aa, Saccharomyces cerevisiae
MNDDSQDKIIHDIRIQLRKAATELSRWKLYGSSKWAAEALAGLAEAIDVDQTHSLADESPLRNKQGVPKQMFEIPQNGFGLSETEYDLYLLGSTLFDAKEFDRCVFFLKDVTNPYLKFLKLYSKFLSWDKKSQESMENILTTGKFTDEMYRANKDGDGSGNEDINQSGHQRANLKMVSNEHESQSNISSILKEINTFLESYEIKIDDDEADLGLALLYYLRGVILKQEKNISKAMSSFLKSLSCYSFNWSCWLELMDCLQKVDDALLLNNYLYQNFQFKFSENLGSQRTIEFNIMIKFFKLKVFEELNGQLEDYFEDLEFLLQVFPNFTFLKAYNATISYNNLDYVTAESRFDDIVKQDPYRLNDLETYSNILYVMQKNSKLAYLAQFVSQIDRFRPETCCIIANYYSARQEHEKSIMYFRRALTLDKKTTNAWTLMGHEFVELSNSHAAIECYRRAVDICPRDFKAWFGLGQAYALLDMHLYSLYYFQKACTLKPWDRRIWQVLGECYSKTGNKVEAIKCYKRSIKASQTVDQNTSIYYRLAQLYEELEDLQECKKFMMKCVDVEELLEGIVTDETVKARLWLAIFEIKAGNYQLAYDYAMGVSSGTSQEIEEARMLARECRRHM

SEQ ID NO: 299 - protein, 307 aa, Synechocystis sp. PCC 6803
MAEVVCFGEMLFDCLADQLGVPLEQVKSWTNYAGGAPANVACALVKQGVSAAFVGRLGADQAGQELKNVLQQCQVNTDGLQIDPHRPTRLVYVTRTGDGDRHFAGFGEYHTGDFADTAMQGETIPESLFTSAQYLVMGTIALAYAPSRTATERLVALAKKHQVKIFLDVNWRSVFWDDEAQAKERIPALITHAQILKCTDEEAVWLFGHQDPVTIHQKLPHLQGVLVTAGDKGCSYSLGKNHGEVPAFKVNVRDTTGAGDSFVAGFLAQALTHGENLFIDPHLSCQAVTYASAIGALTTLHPGAIAR

SEQ ID NO: 300 - protein, 397 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMVCQHNDELEALVKKAKKVTDKGEVASYIPALAKADKHDLSVAIYYSNNVCLSAGDVEKTFTLQSISKVLSLALVLMEYGKDKVFSYVGQEPTGDPFNSIIKLETVNPSKPLNPMINAGALVVTSLIRGRTVKERLDYLLSFIRRLTNNQEITYCREVAESEYSTSMINRAMCYYMKQYGIFEDDVEAVMDLYTKQCAIEMNSLDLAKIGSVFALNGRHPETGEQVISKDVARICKTFMVTCGMYNASGEFAIKVGIPAKSGVSGGIMGISPYDFGIGIFGPALDEKGNSIAGVKLLEIMSEMYRLSIF

SEQ ID NO: 301 - protein, 370 aa, Agrobacterium tumefaciens str. C58
MTVRSLFLLPGDGIGPEAMTEVRKLIEYMNSAHNAGFTVSEGLVGGSAYDAHGVAISDADMEKALAADAILFGAVGGPKWDGVPYEHRPEAGLLRLRKDLELFANLRPAICYPALAAASSLKPELVEGLDILIVRELTGGVYFGEPKQIIDLGNGQKRGIDTQIYDTFEIERIASVAFELARSRDNRVCSMEKRNVMKSGVLWNQVVTETHAAKYKDVQLEHMLADAGGMQLVRKPKQFDVIVTDNLFGDMLSDVAAMLTGSLGMLPSASLGAPDAKTGKRKAMYEPVHGSAPDIAGKSIANPIAMIASFAMCLRYSFNMVDEATKLEAAIANVLDKGIRTADIMADGCRQVGTSDMGDAVLAEFKALSA

SEQ ID NO: 302 - protein, 320 aa, Bacillus subtilis subsp. subtilis str. 168
MRSHSVVCIGELLIDFFCTDVDVDLMEGRQFLKSAGGAPANVSAAIAKLGGDAAFSGKVGKDPFGYFLKRTLDAVHVDTSMLVMDEKAPTTLAFVSLKQNGERDFVFNRGADALFTLEDIDQEKLNEAKILHFGSATALLSDPFCSAYLRLMSIAKDNGQFISFDPNYREDLWRGRVSEFVSVAKKAIAVSDFVKVSDEELEIISGVKDHEKGVAILHEIGANIVAVTLGKSGTLLSNGKDREIIPSIPVTSIDSTGAGDAFVGAALYQLANTDQIQSVDADFVKLREIVAFANKVGALVCTKIGAIDALPSLDEIGVSL

SEQ ID NO: 303 - protein, 117 aa, Arabidopsis thaliana
MMMKSLICLSLILLPLVSVVEGLGGGGGLGSRKPIKNVSDPDVVAVAKYAIEEHNKESKEKLVFVKVVEGTTQVVSGTKYDLKIAAKDGGGKIKNYEAVVVEKLWLHSKSLESFKAL

SEQ ID NO: 304 - protein, 580 aa, Xenorhabdus nematophilus
MASSMLSSATMVASPAQATMVAPFNGLKSSAAFPATRKANNDITSITSNGGRVNCMQVWPPIGKKKFETLSYLPDLTDSGGRVNCMQAMARFGLQKLYIHGTYVNSVNPDKNTFDAINPANGEVIAQLQSATEQDVELAVKSAQKGQKIWATMTAIERSRILLKAVNILRERNDELAELETLDTGKPLSETQYVDIVTGADVLEYYAGLIHSLEGQQIPLRESSFVYTRREPLGVVAGIGAWNYPIQIALWKSAPALAAGNAMIFKPSEVTSLTALKLAEIYTEAGVPDGVFNVLTGAGHEVGHTLTVHPKIAKMSFTGGIVTGKKVMANASGSNLKEVTMELGGKSPLIIFDDADLDRAADIAMMANFFSSGQVCTNGTRVFVPKGLAPQFEAKIVERVKRIRIGSPLDPNTNFGPLVSFPHMESVLRYIESGKSTHARLLCGGERLLEGELAKGAFVAPTVFSDCTDDMLIAQEEIFGPVMCILTYETEDEVINRANNTDYGLAAGLVTQDLSRAHRVIHQLEAGICWINTWGESQAAMPVGGYKHSGIGRENGLVTLQNYTQTKSIQVELGNFESLF

SEQ ID NO: 305 - protein, 764 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMELAACFLTLLPGFAVAASWTSPGFPAFSEQGTGTFVSHAQLPKGTRPLTLNFDQQCWQPADAIKLNQMLSLQPCSNTPPQWRLFRDGEYTLQIDTRSGTPTLMISIQNAAEPVASLVRECPKWDGLPLTVDVSATFPEGAAVRDYYSQQIAIVKNGQIMLQPAATSNGLLLLERAETDTSAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGNEADLRTLVDSAHQRGIRILFDVVMNHTGYATLADMQEYQFGALYLSGDEVKKSLGERWSDWKPAAGQTWHSFNDYINFSDKTGWDKWWGKNWIRTDIGDYDNPGFDDLTMSLAFLPDIKTESTTASGLPVFYKNKMDTHAKAIDGYTPRDYLTHWLSQWVRDYGIDGFRVDTAKHVELPAWQQLKTEASAALREWKKANPDKALDDKPFWMTGEAWGHGVMQSDYYRHGFDAMINFDYQEQAAKAVDCLAQMDTTWQQMAEKLQGFNVLSYLSSHDTRLFREGGDKAAELLLLAPGAVQIFYGDESSRPFGPTGSDPLQGTRSDMNWQDVSGKSAASVAHWQKISQFRARHPAIGAGKQTTLLLKQGYGFVREHGDDKVLVVWAGQQ

SEQ ID NO: 306 - protein, 235 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMTNWLEHSVQVEVDAPIELVWQLWSDLEQMPRWMKWIDSVKVLEDNPDLSRWKLASGSLEFTWLSRITKLISQQIIQWESVDGLPNRGAVRFYDRHGKSIVRLTIAYSVPGWLALLMDNLFLGRVVESTIQADLERFREYINNLQAS

SEQ ID NO: 307 - protein, 419 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMAIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 308 - protein, 467 aa, Arabidopsis thaliana
LINTKSYVFPQMDQEEEEIEIPNYFICPISLEIMKDPVTTVSGITYDRQNIVKWLEKVPSCPVTKQPLPLDSDLTPNHMLRRLIQHWCVENETRGVVRISTPRVPPGKLNVVEEIKNLKKFGQEALGREETLQKLEVLAMDGNNRRLMCECGVHKSLILFVVKCTSEDEDGRRRIKGLDESLRLLHLIGIPSNDAKTILMENDRVMESLTWVLHQEDFLSKAYTIVLLRNLTEYTSSHIVERLNPEIFKGIIGFLKDVVNSVNRTSPTVRETVQSSSRPSLGKTEPSKLDHSLVIKQAVTAALMILLETSSWSRNRSLLVDLGAVSELIELEISYTGEKRITELMLGVLSRLCCCANGRAEILAHRGGIAVVTKRLLRVSPAADDRAISILTTVSKFSPENMVVEEMVNVGTVEKLCSVLGMDCGLNLKEKAKEILKDHFDEWKKFPCIDITLLTKLLSISPKGPKI

SEQ ID NO: 309 - protein, 654 aa, Arabidopsis thaliana
MAKSEKHKLAQTLIDSINEIASISDSVTPMKKHCANLSRRLSLLLPMLEEIRDNQESSSEVVNALLSVKQSLLHAKDLLSFVSHVSKIYLVLERDQVMVKFQKVTSLLEQALSIIPYENLEISDELKEQVELVLVQLRRSLGKRGGDVYDDELYKDVLSLYSGRGSVMESDMVRRVAEKLQLMTITDLTQESLALLDMVSSSGGDDPGESFEKMSMVLKKIKDFVQTYNPNLDDAPLRLKSSLPKSRDDDRDMLIPPEEFRCPISLELMTDPVIVSSGQTYERECIKKWLEGGHLTCPKTQETLTSDIMTPNYVLRSLIAQWCESNGIEPPKRPNISQPSSKASSSSSAPDDEHNKIEELLLKLTSQQPEDRRSAAGEIRLLAKQNNHNRVAIAASGAIPLLVNLLTISNDSRTQEHAVTSILNLSICQENKGKIVYSSGAVPGIVHVLQKGSMEARENAAATLFSLSVIDENKVTIGAAGAIPPLVTLLSEGSQRGKKDAATALFNLCIFQGNKGKAVRAGLVPVLMRLLTEPESGMVDESLSILAILSSHPDGKSEVGAADAVPVLVDFIRSGSPRNKENSAAVLVHLCSWNQQHLIEAQKLGIMDLLIEMAENGTDRGKRKAAQLLNRFSRFNDQQKQHSGLGLEDQISLI

SEQ ID NO: 310 - protein, 348 aa, Arabidopsis thaliana
MSKSGDNQPVDRYLRRQILGEGTYGVVYKATDTKTGKTVAVKKIRLGNQKEGVNFTALREIKLLKELNHPHIVELIDAFPHDGSLHLVFEYMQTDLEAVIRDRNIFLSPGDIKSYMLMTLKGLAYCHKKWVLHRDMKPNNLLIGENGLLKLADFGLARLFGSPNRRFTHQVFATWYRAPELLFGSRQYGAGVDVWAAGCIFAELLLRRPFLPGSTEIDQLGKIFQAFGTPVPSQWSDMIYLPDYMEFSYTPAPPLRTIFPMASDDALDLLAKMFIYDPRQRITIQQALDHRYFSSSPSPTEPGKLQIPASKGDALEPKASEQNQHGNSPAVLSPPGKMRRVMGPEGFT

SEQ ID NO: 311 - protein, 395 aa, Arabidopsis thaliana
MDGGSGQPAADTEMTEAPGGFPAAAPSPQMPGIENIPATLSHGGRFIQYNIFGNIFEVTAKYKPPIMPIGKGAYGIVCSAMNSETNESVAIKKIANAFDNKIDAKRTLREIKLLRHMDHENIVAIRDIIPPPLRNAFNDVYIAYELMDTDLHQIIRSNQALSEEHCQYFLYQILRGLKYIHSANVLHRDLKPSNLLLNANCDLKICDFGLARVTSESDFMTEYVVTRWYRAPELLLNSSDYTAAIDVWSVGCIFMELMDRKPLFPGRDHVHQLRLLMELIGTPSEEELEFLNENAKRYIRQLPPYPRQSITDKFPTVHPLAIDLIEKMLTFDPRRRITVLDALAHPYLNSLHDISDEPECTIPFNFDFENHALSEEQMKELIYREALAFNPEYQQ

SEQ ID NO: 312 - protein, 329 aa, Arabidopsis thaliana
LINSFSLLMRRLGSIKTQRRTSIQKGYVQFFDIKTLEKATGGFKESSVIGQGGFGCVYKGCLDNNVKAAVKKIENVSQEAKREFQNEVDLLSKIHHSNVISLLGSASEINSSFIVYELMEKGSLDEQLHGPSRGSALTWHMRMKIALDTARGLEYLHEHCRPPVIHRDLKSSNILLDSSFNAKISDFGLAVSLDEHGKNNIKLSGTLGYVAPEYLLDGKLTDKSDVYAFGVVLLELLLGRRPVEKLTPAQCQSLVTWAMPQLTDRSKLPNIVDAVIKDTMDLKHLYQVAAMAVLCVQPEPSYRPLITDVLHSLVPLVPVELGGTLRLTR

SEQ ID NO: 313 - protein, 485 aa, Arabidopsis thaliana
MKSFNTEGHNHSTAESGDAYTVSDPTKNVDEDGREKRTGTWLTASAHIITAVIGSGVLSLAWAIAQLGWIAGTSILLIFSFITYFTSTMLADCYRAPDPVTGKRNYTYMDVVRSYLGGRKVQLCGVAQYGNLIGVTVGYTITASISLVAVGKSNCFHDKGHTADCTISNYPYMAVFGIIQVILSQIPNFHKLSFLSIMAAVMSFTYATIGIGLAIATVAGGKVGKTSMTGTAVGVDVTAAQKIWRSFQAVGDIAFAYAYATVLIEIQDTLRSSPAENKAMKRASLVGVSTTTFFYILCGCIGYAAFGNNAPGDFLTDFGFFEPFWLIDFANACIAVHLIGAYQVFAQPIFQFVEKKCNRNYPDNKFITSEYSVNVPFLGKFNISLFRLVWRTAYVVITTVVAMIFPFFNAILGLIGAASFWPLTVYFPVEMHIAQTKIKKYSARWIALKTMCYVCLIVSLLAAAGSIAGLISSVKTYKPFRTMHE

SEQ ID NO: 314 - protein, 421 aa, Ralstonia metallidurans
MASSMLSSATMVASPAQATMVAPFNGLKSSAAFPATRKANNDITSITSNGGRVNCMQVWPPIGKKKFETLSYLPDLTDSGGRVNCMQAMAVLLPRIVVLATGGTIAGSSANPASSAHYQAATVPVSQLVQAVPALADVARVEAEQVAQVDSKDMMFDLWRMLAARIGYWSAQDDVAGIVITHGTDTLEETAMFLHLTQACPLPVVMTAAMRPSTSLSADGPLNLLDAVRVAASPVAVGKGALVVLNQQIHAARDVVKAHTSAVDAFHSPVAGPLGFVQDTYVHFSRTPGPDQAPRLPVPAAWPLVEIVASYAQPGRVGIDAMVAAGVLGFVVAAAGNGSVHETLTAALVDAAACGVAVARSSRTGAGHVAIPAPPRPAGGVFVSAGDLNPYKARVLLLLALAGDPSLGRDAARLQALFERY

SEQ ID NO: 315 - protein, 345 aa, Arabidopsis thaliana
MSGLLDGIPEAVALRCLAHVPLHLHPNLELVSRSWRAAIRSHELFRVRKELRSSEHLLCVCAFDPENIWQVYSPNCDRWLTLPLLPSRIRHLAHFGAVTTAGMLFVLGGGSDAVSPVTGDHDGTFATDQVWSYDFVQRQWTPRASMLVPRAMFACCVLQGKIVVAGGFTTCRKSISGAEMYDPENDVWTSIPDLHQTHNSACSGLVVNGKVHVLHKGLSTVQVLESVKLGWDVKDYGWPQGPMVVVEDVLYVMSHGLVFKQEGDTWKMVASASEFKRRIGMAMTSLSDEVLIVGGVIGPDRLNWDIKPLSDVDALTVGNDRPAWRSVAPMTRCRGTILGCTQLTI

SEQ ID NO: 316 - protein, 540 aa, Arabidopsis thaliana
MFSLNMRTEIESLWVFALASKFNIYMQQHFASLLVAIAITWFTITIVFWSTPGGPAWGKYFFTRRFISLDYNRKYKNLIPGPRGFPLVGSMSLRSSHVAHQRIASVAEMSNAKRLMAFSLGDTKVVVTCHPAVAKEILNSSVFADRPVDETAYGLMFNRAMGFAPNGTYWRTLRRLGSNHLFNPKQIKQSEDQRRVIATQMVNAFARNPKSACAVRDLLKTASLCNMMGLVFGREYELESNNNLESECLKGLVEEGYDLLGTLNWTDHLPWLAGLDFQQIRFRCSQLVPKVNLLLSRIIHEQRAATGNFLDMLLSLQGSEKLSESDMVAVLWEMIFRGTDTVAVLVEWVLARIVMHPKVQLTVHDELDRVVGRSRTVDESDLPSLTYLTAMIKEVLRLHPPGPLLSWARLSITDTSVDGYHVPAGTTAMVNMWAIARDPHVWEDPLEFKPERFVAKEGEAEFSVFGSDLRLAPFGSGKRVCPGKNLGLTTVSFWVATLLHEFEWLPSVEANPPDLSEVLRLSCEMACPLIVNVSSRRKIM

SEQ ID NO: 317 - protein, 416 aa, Ralstonia metallidurans
MYQHIKVPAGEKIKVNADLSLNVPDNPIIPYIEGDGTGVDITPVMLKVVDAAVAKAYGGKRKISWMEIYAGEKSTKVYGPDVWLPEETMEVVKEYVVSIKGPLTTPVGGGIRSLNVALRQQLDLYVCLRPVRYFKGVPSPVREPEKTDMVIFRENSEDIYAGIEWEAESEGAKKLIAFLQNEMGVKKIRFPETSGIGIKPVSKEGTQRLVRKALQYAIDNDKPSVTLVHKGNIMKFTEGGFRDWGYELAQQEFGAELVDGGPWCKFKNPKTGRDIVVKDAIADAFLQQILLRPAEYSVIATLNLNGDYISDALAAQVGGIGIAPGANMSDSVAMFEATHGTAPKYAGKDYVNPGSEILSAEMMLRHMGWTEAADLIIRSMEKSIQSKKVTYDFARLLEGATQVSCSGFGQVMIDNM

SEQ ID NO: 318 - protein, 171 aa, Glycine max
MADGPASPGGGSHESGDHSPRSNVREQDRYLPIANISRIMKKALPANGKIAKDAKETVQECVSEFISFITSEASDKCQREKRKTINGDDLLWAMATLGFEDYMDPLKIYLTRYREMEGDTKGSAKGGDSSAKRDVQPSPNAQLAHQGSFSQNVTYPNSQGRHMMVPMQGPE

SEQ ID NO: 319 - protein, 546 aa, Arabidopsis thaliana
MTMFASLTSKMLSVSTSDHASVVSLNLFVALLCACIVIGHLLEENRWMNESITALLIGLGTGVVILLISRGKNSHLLVFSEDLFFIYLLPPIIFNAGFQVKKKQFFRNFVTIMAFGAIGTVVSCTIISLGAIQFFKKLDIGTFDLGDFLAIGAIFAATDSVCTLQVLNQDETPLLYSLVFGEGVVNDATSVVLFNAIQSFDLTHLNHEAAFQFLGNFFYLFLLSTGLGVATGLISAYVIKKLYFGRHSTDREVALMMLMAYLSYMLAELFALSGILTVFFCGIVMSHYTWHNVTESSRITTKHAFATLSFLAETFIFLYVGMDALDIEKWRFVSDSPGTSVAVSSILMGLVMLGRAAFVFPLSFLSNLAKKHQSEKISIKQQVVIWWAGLMRGAVSMALAYNKFTRSGHTELRGNAIMITSTITVCLFSTMVFGMLTKPLIRYLMPHQKATTSTTSMLSDDSTPKSIHIPLLDGEQLDSFELPGSHQDVPRPNSLRGFLMRPTRTVHYYWRQFDDAFMRPVFGGRGFVPFVPGSPTERSSHDLSKP

SEQ ID NO: 320 - protein, 398 aa, Arabidopsis thaliana
MEEYQHDNSTTPQRVSFLYSPISSSNKNDNTSDTNNNNNNNNSSNYGPGYNNTNNNNHHHQHMLFPHMSSLLPQTTENCFRSDHDQPNNNNNPSVKSEASSSRINHYSMLMRAIHNTQEANNNNNDNVSDVEAMKAKIIAHPHYSTLLQAYLDCQKIGAPPDVVDRITAARQDFEARQQRSTPSVSASSRDPELDQFMEAYCDMLVKYREELTRPIQEAMEFIRRIESQLSMLCQSPIHILNNPDGKSDNMGSSDEEQENNSGGETELPEIDPRAEDRELKNHLLKKYSGYLSSLKQELSKKKKKGKLPKEARQKLLTWWELHYKWPYPSESEKVALAESTGLDQKQINNWFINQRKRHWKPSEDMQFMVMDGLQHPHHAALYMDGHYMGDGPYRLGP

SEQ ID NO: 321 - protein, 496 aa, Arabidopsis thaliana
MGKVAVGATVVCTAAVCAVAVLVVRRRMQSSGKWGRVLAILKAFEEDCATPISKLRQVADAMTVEMHAGLASDGGSKLKMLISYVDNLPSGDEKGLFYALDLGGTNFRVMRVLLGGKQERVVKQEFEEVSIPPHLMTGGSDELFNFIAEALAKFVATECEDFHLPEGRQRELGFTFSFPVKQTSLSSGSLIKWTKGFSIEEAVGQDVVGALNKALERVGLDMRIAALVNDTVGTLAGGRYYNPDVVAAVILGTGTNAAYVERATAIPKWHGLLPKSGEMVINMEWGNFRSSHLPLTEFDHTLDFESLNPGEQILEKIISGMYLGEILRRVLLKMAEDAAFFGDTVPSKLRIPFIIRTPHMSAMHNDTSPDLKIVGSKIKDILEVPTTSLKMRKVVISLCNIIATRGARLSAAGIYGILKKLGRDTTKDEEVQKSVIAMDGGLFEHYTQFSECMESSLKELLGDEASGSVEVTHSNDGSGIGAALLAASHSLYLEDS

SEQ ID NO: 322 - protein, 307 aa, Arabidopsis thaliana
MSMMSRTRSSIAMGTPSFLELKKQASFFFKEKLKTARLALTDVTPLQLMTEEATDGESCGPNTQTLGSISKAAFEFEDYLAIVEVLHKRLAKFDKRNWRMAYNSLIVVEHLLTHGPESVSDEFQGDIDVISQMQTFQQIDEKGFNWGLAVRKKAEKVLKLLEKGELLKEERKRARELSRGIQGFGSFNHKSSSHSLSEHEVLQESTVYRKCNSNFTKNYDEDDQENTMVSPNDANLFPQPLVADPSEESRTGMKENMDPEDDENTEVNPLLGFSKKEGQELAGEDENHPFTDGESKHTVVLLDENTD

SEQ ID NO: 323 - protein, 366 aa, Arabidopsis thaliana
MRRWICCGDKKGDSDLSNEEVHLKSPWQNSEANQKNQKPQAVVKPEAQKEALPIEVPPLSVDEVKEKTDNFGSKSLIGEGSYGRVYYATLNDGKAVALKKLDVAPEAETNTEFLNQVSMVSRLKHENLIQLVGYCVDENLRVLAYEFATMGSLHDILHGRKGVQGAQPGPTLDWLTRVKIAVEAARGLEYLHEKVQPPVIHRDIRSSNVLLFEDYQAKVADFNLSNQAPDNAARLHSTRVLGTFGYHAPEYAMTGQLTQKSDVYSFGVVLLELLTGRKPVDHTMPRGQQSLVTWATPRLSEDKVKQCVDPKLKGEYPPKSVAKLAAVAALCVQYESEFRPNMSIVVKALQPLLKPPAPAPAPVPES

SEQ ID NO: 324 - protein, 256 aa, Arabidopsis thaliana
MACTSSSGAHVRSTSWSEDVNPLSRAIEDHLLLLKKRPESARRKLGVLKNLYEVVEVFLRFQTTKTQKSFTGFEDVSDGFIEVLDICSTIRDVLMEIKEQVRELESSLRRRLIRSKSGEDQEAFVARETDAYVFKRRALSRTIVKQLKKTEEKMRKRKRDCGDVINVMKRVEKTSFDVLVSLLIEVVTKDQRDQKKGSRRGIVSRIFNKKNQEVDVDELKKLRETEHEIEETEKELECVYKKLLKTRVSFLNMLTL

SEQ ID NO: 325 - protein, 344 aa, Arabidopsis thaliana
MFGGGRGPMGGGGGMLRAAGRAMTRTGVANGGIQDPFASSSSSSTSSPAGNASVSHVQKQRSSSSGSNNLTYSAASGLLLNLPVAATSGWSGGGPFSFVNSGGYDDFEWVSEEEDDSLFGSVPSVDEVQDAVSALQQVFDASSYSQLVRDKYECYPENGGGNQSPIATGMVHQVPSFGSDSDWMEPSMHLCHSRTLKPHAYDQVYNAFDLLRTEPSVQKMVVSLSSDKAVWEAVMNNDVVREIRDLYNNGISQDEENSEDTPRENNAATDFIKWVFDNTMVKATEVFVKITKVVTELFNCYNGDGVNNKGKDAKFNNWLEEKLTTSVLLSIIVMLVVMVSRACN

SEQ ID NO: 326 - protein, 332 aa, Arabidopsis thaliana
MDQNGHNDEAETVSCGNGNCKSKIVPGDDHGGDESSGTKRRKKRKTQQKTMKRRELMSYCELPEYMKDNEYILNYYRADWSIRDAFFSVFSFHNESLNVWTHLIGFIFFVALTVANIIHHDGFFPVDAKSPGNVTRWPFFVFLGGSMFCLLASSICHLFCCHSKELNVFLLRIDYAGITAMIITSFFPPIFYIFQCTPRWYFIYLAGITSMGIFTIITLFTPSLSAPKYRAFRALLFASMGLFGIVPAAHALVVNWGNPQRNVTLVYELLMAVFYLVGTGFYVGRVPERLKPGWFDRVGHSHQIFHVFVLLGALSHYAAALLFLDWRDHVGC

SEQ ID NO: 327 - protein, 627 aa, Arabidopsis thaliana
MSGRLLKKVLQEHEDSKLQKHHEEEEEEDEEESGARSSINPFDLLNDGDEDPEEIDDETIAEKKNEDADHQSSVADHVQPVSKNKSKKKKKKKNKESGSNVPKAEMTLDETLEALGLNANSKQDKVQETKPNADSSKKASSRFVLEIDSKYLNLENELRRTYGSKAMRSFESESGSQGGSSSRRGGRRGVHHITKTVLVSPKENWSRWDRSFSMEFLETKDGNNYFRYTHSSSYEQAQRAFQAAQAIHDLNGVASVLIHNPYHIESLITMADYFKFVGENDMAADSIGKCLYGLERAWHPMFTPFQGNCRLEFNHDENKLFFKTLFTHMRNMDRRGCHRSALEVCKLLLSLDTSNPVGALFCVDYFALRAEEYAWLEQFSEEYRNDNSLWLFPNFSYSLAIARVYLEKMEPTSSSEATPRDTSKQSSLDLMTQALKLHPTVLNKLVEKVPLKDQAWTKILKHSYFRSDESKIPSLDHLIKIYVERNYLIWRLPDVQKLLRSAADLVIESLEQDGTEAESWLCVRLEAFSSENNQYSHLSTHDFSDSMPTLPPDNLQNFVADPRMVGGEQMAEGGGRGQHQAPPPRPRDLANRSPLAVLIESILPWANFGDGEDEIAHDAHHQPDNNG

SEQ ID NO: 328 - protein, 285 aa, Arabidopsis thaliana
MALFDTHNTWAFVFGLLGNLISFAVFLSPVPTFYRICKKKTTEGFQSIPYVVALFSAMLWLYYATQKKDVFLLVTINSFGCFIETIYISIFVAFASKKARMLTVKLLLLMNFGGFCLILLLCQFLAKGTTRAKIIGGICVGFSVCVFAAPLSIIRTVIKTKSVEYMPFSLSLTLTISAVIWLLYGLALKDIYVAFPNVIGFVLGALQMILYVVYKYCKTPSDLVEKELEAAKLPEVSIDMVKLGTLTSPEPVAITVVRSVNTCNCNDRNAEIENGQGVRNSAATT

SEQ ID NO: 329 - protein, 157 aa, Arabidopsis thaliana
MGLPTDFKELQIPGYVLKTLYVIGFFRDMVDALCPYIGLPSFLDHNETSRSDPTRLALSTSATLANELIPVVRFSDLLTDPEDCCTVCLSDFVSDDKIRQLPKCGHVFHHRCLDRWIVDCNKITCPICRNRFLPEEKSTPFDWGTSDWFRDEVESTN

SEQ ID NO: 330 - protein, 189 aa, Arabidopsis thaliana
MKVADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 331 - protein, 763 aa, Saccharomyces cerevisiae
MNDSQNCLRQREENSHLNPGNDFGHHQGAECTINHNNMPHRNAYTESTNDTEAKSIVMCDDPNAYQISYTNNEPAGDGAIETTSILLSQPLPLRSNVMSVLVGIFVAVGGFLFGYDTGLINSITDMPYVKTYIAPNHSYFTTSQIAILVSFLSLGTFFGALIAPYISDSYGRKPTIMFSTAVIFSIGNSLQVASGGLVLLIVGRVISGIGIGIISAVVPLYQAEAAQKNLRGAIISSYQWAITIGLLVSSAVSQGTHSKNGPSSYRIPIGLQYVWSSILAVGMIFLPESPRYYVLKDELNKAAKSLSFLRGLPIEDPRLLEELVEIKATYDYEASFGPSTLLDCFKTSENRPKQILRIFTGIAIQAFQQASGINFIFYYGVNFFNNTGVDNSYLVSFISYAVNVAFSIPGMYLVDRIGRRPVLLAGGVIMAIANLVIAIVGVSEGKTVVASKIMIAFICLFIAAFSATWGGVVWVVSAELYPLGVRSKCTAICAAANWLVNFTCALITPYIVDVGSHTSSMGPKIFFIWGGLNVVAVIVVYFAVYETRGLTLEEIDELFRKAPNSVISSKWNKKIRKRCLAFPISQQIEMKTNIKNAGKLDNNNSPIVQDDSHNIIDVDGFLENQIQSNDHMIAADKGSGSLVNIIDTAPLTSTEFKPVEHPPVNYVDLGNGLGLNTYNRGPPSIISDSTDEFYEENDSSYYNNNTERNGANSVNTYMAQLINSSSTTSNDTSFSPSHNSNARTSSNWTSDLASKHSQYTSPQ

SEQ ID NO: 332 - protein, 427 aa, Arabidopsis thaliana
MEMERVHEFPHTHMDRRPRKRARLGWDVLPQATKAQVGMFCGQEIGNISSFASSGAPSDNSSSLCVKGVARNGSPPWREDDKDGHYIFELGDDLTPRYKIYSKMGEGTFGQVLECWDRERKEMVAVKIVRGVKKYREAAMIEIEMLQQLGKHDKGGNRCVQIRNWFDYRNHICIVFEKLGSSLYDFLRKNNYRSFPIDLVREIGWQLLECVAFMHDLRMIHTDLKPENILLVSSDYVKIPEYKGSRLQRDVCYKRVPKSSAIKVIDFGSTTYERQDQTYIVSTRHYRAPEVILGLGWSYPCDVWSVGCIIVELCTGEALFQTHENLEHLAMMERVLGPFPQQMLKKVDRHSEKYVRRGRLDWPDGATSRDSLKAVLKLPRLQNLIMQHVDHSAGELINMVQGLLRFDPSERITAREALRHPFFARRR

SEQ ID NO: 333 - protein, 293 aa, Xanthomonas campestris
MHCSGMTNTSIPADLGDWIIAQAIAGHPPEHTLQPLLEAGWSEQDAIDAVEALVRAHVQAHAQAHGLPVPVPVRVPAPLQADASSLLDLGDRQVQVLVSLMLPRVVVLGGLLADDECDALIALARPQLARSRTVDNRDGSEIVHAARTSHSMALQPGQDALCQRIEARIAQLLEWPVEHGEGLQVLRYATGAQYAPHYDYFEPDAPGTPVLLQHGGQRVASLVMYLNTPERGGATRVPDVHLDVAAVKGNAVFFSYDRPHPMTRTLHAGAPVLAGEKWVATKWLRERPLHAPT

SEQ ID NO: 334 - protein, 417 aa, Arabidopsis thaliana
MEWPWSAIAASSSSSSSCFFASPNSCLSITRRTNLSCVNTSVKSLRHSRFDSKHNLVKRRINGDSVVRRSTTSNNSTEETESSSSSSSVDCVGMGSDVECVNNGEDEENRSSGILSGGEGTFLEWTVLISPFFFWGTAMVAMKEVLPITGPFFVAAFRLIPAGLLLVAFAVYKGRPLPEGINAWFSIALFALVDATCFQGFLAQGLQRTSAGLGSVIIDSQPLTVAVLASFLFGESIGIVRAGGLLLGVAGLLLLEVPSVTSDGNNFSLWGSGEWWMLLAAQSMAIGTVMVRWVSKYSDPIMATGWHMVIGGLPLLAISVINHDPVFNGSLQDLSTNDVIALLYTSIFGSAVSYGVYFYSATKGSLTKLSSLTFLTPMFASIFGYLYLNETFSSLQLVGAAVTLVAIYLVNFPEGND

SEQ ID NO: 335 - protein, 350 aa, Arabidopsis thaliana
MKTLHRTWIVDGPWISRNVKNASLSSALQIKDCGAYINCFNCSYRIDNSNVLTPWPGLPKGVKFEPTDEEVIEHLEAKCGIDGLKPHLLIQDFICSVTQDVGINYTHPQNLPGVSKDGTSVFFFNKTAHAYQNGQRKRRRITPTSLKDDTVRWHKTGQTKPVMLNGIQKGCKKIMVLYKSARKGFKPEKSNWVLHQYHLGTEEGEIGEYVVSKITYQQPKQQEKTIDESESSGVRGGPSTPKTSTITQVRPVISVDEDEIAFDDDSKMVLDSYAEGLENIQEASSGSTSDKIAKVGGNVSVIEDNLMSKKIEASSIPNHGNVDYGSGNFSVSDLENAELGTLPDLLSVRT

SEQ ID NO: 336 - protein, 450 aa, Arabidopsis thaliana
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKYKSVAVLTSPKLLDTLF

SEQ ID NO: 337 - protein, 314 aa, Arabidopsis thaliana
MEKVFSDEEISGNHHWSVNGMTSLNRSASEWAFNRFIQESSAAADDGESTTACGVSVSSPPNVPVDSEEYRAFLKSKLNLACAAVAMKRGTFIKPQDTSGRSDNGGANESEQASLASSKATPMMSSAITSGSELSGDEEEADGETNMNPTNVKRVKRMLSNRESARRSRRRKQAHLSELETQVSQLRVENSKLMKGLTDVTQTFNDASVENRVLKANIETLRAKVKMAEETVKRLTGFNPMFHNMPQIVSTVSLPSETSNSPDTTSSQVTTPEIISSGNKGKALIGCKMNRTASMRRVESLEHLQKRIRSVGDQ

SEQ ID NO: 338 - protein, 401 aa, Arabidopsis thaliana
MALKFNPLVASQPYKFPSSTRPPTPSFRSPKFLCLASSSPALSSGPKEVESLKKPFTPPREVHVQVLHSMPPQKIEIFKSMENWAEENLLIHLKDVEKSWQPQDFLPDPASDGFEDQVRELRERARELPDDYFVVLVGDMITEEALPTYQTMLNTLDGVRDETGASPTSWAIWTRAWTAEENRHGDLLNKYLYLSGRVDMRQIEKTIQYLIGSGMDPRTENNPYLGFIYTSFQERATFISHGNTARQAKEHGDIKLAQICGTIAADEKRHETAYTKIVEKLFEIDPDGTVMAFADMMRKKISMPAHLMYDGRNDNLFDNFSSVAQRLGVYTAKDYADILEFLVGRWKIQDLTGLSGEGNKAQDYLCGLAPRIKRLDERAQARAKKGPKIPFSWIHDREVQL

SEQ ID NO: 339 - protein, 410 aa, Glycine max
MQPQRLRQQAMMQPSLYHHPALLTPPQIEPILSGNLPPGFDSSSCRSVYVGNIHPQVTDSLLQELFSTAGALEGCKLIRKEKSSYGFVDYFDRSSAAFAIVTLNGRNIFGQPIKVNWAYASSQKEDTSGHFNIFVGDLSPEVTDATLYACFSVYPSCSDARVMWDQKTGRSRGFGFVSFRNQQDAQSAINDLTGKWLGSRQIRCNWATKGASASDEKQTSDSRSVVELTNGSSDGQETTNDDTPEKNPQYTTVYVGNLAPEVTSVDLHQHFHSLNAGTIEDVRVQRDKGFGFVRYSTHAEAALAIQMGNARILFGKPIKCSWGSKPTPPGTASTPLPPPTSANVSGFSLASLAAYERQMALSKMGGAHALMHQQGQHALKQVAMGMGAPGAGYDARFQNVATTQHLMYYQ

SEQ ID NO: 340 - protein, 280 aa, Arabidopsis thaliana
MGSINTSWQKGQLLRQGSFGSVYEAISEDGDFFAVKEVSLLDQGSQAQECIQQLEGEIALLSQLEHQNILRYRGTDKDGSNLYIFLELVTQGSLLELYRRYQIRDSLISLYTKQILDGLKYLHHKGFIHRDIKCATILVDANGTVKLADFGLAKVSKLNDIKSRKETLFWMAPEVINRKDNDGYRSPADIWSLGCTVLEMCTGQIPYSDLEPVEALFRIRRGTLPEVPDTLSLDARHFILKCLKLNPEERPTATELLNHPFVRRPLPSSGSGSTSPLIRR

SEQ ID NO: 341 - protein, 345 aa, Glycine max
MMKPSMLRSLHSAATRGASHLSRRGYASEPVPERKVAVLGAAGGIGQPLSLLMKLNPLVSSLSLYDIAGTPGVAADVSHINTGSEVVGYQGDEELGKALEGADVVIIPAGVPRKPGMTRDDLFNINAGIVKTLCTAIAKYCPHALVNMISNPVNSTVPIAAEVFKKAGTYDEKRLFGVTTLDVVRAKTFYAGKANVPVAGVNVPVVGGHAGITILPLFSQATPKANLDDDVIKALTKRTQDGGTEVVEAKAGKGSATLSMAYAGALFADACLKGLNGVPDVVECSFVQSTVTELPYFASKVRLGKNGVEEVLGLGPLSDFEQQGLESLKPELKSSIEKGIKFANQ

SEQ ID NO: 342 - protein, 291 aa, Glycine max
MFGSKKTPLRDAKPTSVDHAHNPFDSDEDTKDNKYNSSKKTLTNTNPFDDDHVNATGHSSSSSYGLSSTHRNRYKNDFRDSGGLESQSVQELENYAVYKAEETTNSVNSCLKIAEEMREDATKTLVMLHQQGEQITRSHHVAADIDHDLSRGEKLLGSLGGMFSKTWKPKKTGTITGPVVFGEDPVRKKGNHLEQREKLGLTSAPKGQSKSRTTLSEPSNVLEKVEVEKGKQDDALSDLSDLLGELKGMAIDMGSEIGSQNQALDGFDNDMEKLIVRVNGANQRGRRLLGK

SEQ ID NO: 343 - protein, 731 aa, Saccharomyces cerevisiae
MTEFYSDTIGLPKTDPRLWRLRTDELGRESWEYLTPQQAANDPPSTFTQWLLQDPKFPQPHPERNKHSPDFSAFDACHNGASFFKLLQEPDSGIFPCQYKGPMFMTIGYVAVNYIAGIEIPEHERIELIRYIVNTAHPVDGGWGLHSVDKSTVFGTVLNYVILRLLGLPKDHPVCAKARSTLLRLGGAIGSPHWGKIWLSALNLYKWEGVNPAPPETWLLPYSLPMHPGRWWVHTRGVYIPVSYLSLVKFSCPMTPLLEELRNEIYTKPFDKINFSKNRNTVCGVDLYYPHSTTLNIANSLVVFYEKYLRNRFIYSLSKKKVYDLIKTELQNTDSLCIAPVNQAFCALVTLIEEGVDSEAFQRLQYRFKDALFHGPQGMTIMGTNGVQTWDCAFAIQYFFVAGLAERPEFYNTIVSAYKFLCHAQFDTECVPGSYRDKRKGAWGFSTKTQGYTVADCTAEAIKAIIMVKNSPVFSEVHHMISSERLFEGIDVLLNLQNIGSFEYGSFATYEKIKAPLAMETLNPAEVFGNIMVEYPYVECTDSSVLGLTYFHKYFDYRKEEIRTRIRIAIEFIKKSQLPDGSWYGSWGICFTYAGMFALEALHTVGETYENSSTVRKGCDFLVSKQMKDGGWGESMKSSELHSYVDSEKSLVVQTAWALIALLFAEYPNKEVIDRGIDLLKNRQEESGEWKFESVEGVFNHSCAIEYPSYRFLFPIKALGMYSRAYETHTL

SEQ ID NO: 344 - protein, 122 aa, Arabidopsis thaliana
MNNSLKKEERVEEDNGKSDGNRGKPSTEVVRTVTEEEVDEFFKILRRVHVATRTVAKVNGGVAEGELPSKKRKRSQNLGLRNSLDCNGVRDGEFDEINRVGLQGLGLDLNCKPEPDSVSLSL

SEQ ID NO: 345 - protein, 170 aa, Arabidopsis thaliana
MNCVSAFEFVPSSALFPCAQSSIPAKFLHILSSKASISPRCRSFASSSSSTIRRKPLTLVSSKSSDAEEVSDTEDEWLKKLPEKNKPLYSHSLPCIEAWLRKLGFYQSKDDRAVWLIQKPDWHAQLSLDVTDLCIRYMKSGPGNLERDMERRFSYALSREDTENAILGGP

SEQ ID NO: 346 - protein, 318 aa, Arabidopsis thaliana
MKSSPRSEGRKFIIPSFFFIIALCVLAFINEIRFDSLLSFGRCALSNVPMNNGSSETPLLSSSPVDDEIRILIGILTLPDQYSRRHFLRMIYGTQNVPDGVKVDVKFVFCNLTKEDQKVLVALEIMRYDDIIILNCNENMNKGKTYTYFSSLPDIFNETDAQKPPYHYVMKADDDTYIRLESLVASLRPLPREDLYYGYVIPCPSMDPFVHYMSGMGYLVSWDIAVWLKDSEIPKKHLEGPEDKVFGDWIREGRRGKNRFNAKWSMYNFPEPPTRCTHELWPDTIAVHLLKNQEKWIRTLNYFNVTSNLKPSKLYHIP

SEQ ID NO: 347 - protein, 732 aa, Saccharomyces cerevisiae
MTTQIRSPQGLPYPIQIDKLIPSVGSYLHEGDRLLVYKFWYLVERASDTGDDDNEHDVSPGGSAGSNGVSPPTKQLRESIEFFESPYEGDLISWNVDVGDEVATANQVICEIKRPCNHDIVYGGLCTQCGKEVSADAFDGVPLDVVGDVDLQISETEAIRTGKALKEHLRRDKKLILVVDLDQTIIHCGVDPTIAEWKNDPNNPNFETLRDVKSFTLDEELVLPLMYMNDDGSMLRPPPVRKCWYYVKVRPGLKEFFAKVAPLFEMHIYTMATRAYALQIAKIVDPTGELFGDRILSRDENGSLTTKSLAKLFPTDQSMVVVIDDRGDVWNWCPNLIKVVPYNFFVGVGDINSNFLPKQSTGMLQLGRKTRQKSQESQELLTDIMDNEKKLQEKIDKEVKRQEEKLNHQLATAEEPPANESKEELTKKLEYSASLEVQQQNRPLAKLQKHLHDQKLLVDDDDELYYLMGTLSNIHKTYYDMLSQQNEPEPNLMEIIPSLKQKVFQNCYFVFSGLIPLGTDIQRSDIVIWTSTFGATSTPDIDYLTTHLITKNPSTYKARLAKKFNPQIKIVHPDWIFECLVNWKKVDEKPYTLIVDSPISDEELQNFQTQLQKRQEYLEETQEQQHMLTSQENLNLFAAGTSWLNNDDDEDIPDTASDDDEDDDHDDESDDENNSEGIDRKRSIEDNHDDTSQKKTKAEPSQDGPVQHKGEGDDNEDSDSQLEEELMDMLDD

SEQ ID NO: 348 - protein, 290 aa, Saccharomyces cerevisiae
MRDEKIYSIEALKKTSELLEKNPEFNAIWNYRRDIIASLASELEIPFWDKELVFVMMLLKDYPKVYWIWNHRLWVLKHYPTSSPKVWQTELAVVNKLLEQDARNYHGWHYRRIVVGNIESITNKSLDKEEFEYTTIKINNNISNYSAWHQRVQIISRMFQKGEVGNQKEYIRTEISYIINAMFTDAEDQSVWFYIKWFIKNDIVCKTLDEQEYLKMLKDLRENILLINNDEIEFSGKQNIWCLKILLVLEDILEEKEALTERSSEQYLVQLIDADPLRKNRYLHLLEQHK

SEQ ID NO: 349 - protein, 416 aa, Arabidopsis thaliana
LTSGNLRIVSMAENRQLVCRIGGGAGAELDDMDEGEIQRIGNEDEDDDEFIQVHANNSSAASPERWDVLGLGQAMVDFSGVVDDEFLKKLGLEKGTRKLINHEERGKLLQAMDGCSYKAAAGGSLSNTLVALARLGSQSICDRPLNVAMAGSIGGDPLGSFYGTKLRRANVNFLSAPIKDGTTGTVIVLTTPDAQRTMLAYQGTSSVVNYDSCLASLIAKTNVFVVEGYLFELPDTIRTITKACEEAHRNGALVAVTASDVSCIERHYDDFWDIVGNYADIVFANSDEARAFCHFSAEESPISATRYMSHFVPFVSVTDGINGSYIGVKGEAIYIPPSPCVPVDTCGAGDAYASGILYGILRGVSDLKGMGDMAATIAATVVGQQGTRLRVQDAVELARSHAFRLNGSGVRTDVGS

SEQ ID NO: 350 - protein, 308 aa, Glycine max
MGEVAVMHSEPLQFECNDISVNMTEKEVYPPESNVERLPGEESSQSTDHKNINDLQERGYMEYGCQHYRRRCRIRAPCCNEIFDCRHCHNEAKNDINIDQKHRHDIPRHQVKQVICSLCGTEQEVQQNCINCGVCMGKYFCGTCKLFDDDISKQQYHCSGCGICRTGGSENFFHCYKCGCCYSTLLKNSHPCVEGAMHHDCPVCFEYLFESRNDVTVMPCGHTIHKSCLNEMREHFQYSCPLCLKSVCDMSKVWEKFDIEIAATPMPEQYQNKMVWILCNDCGKTSHVQFHFVAQKCPNCKSYNTRQT

SEQ ID NO: 351 - protein, 263 aa, Glycine max
MDRHKCKLCSRSFSNGRALGGHMKAHLASLPLPLPPKLHSCFSSSDSEQEQSLRENPKKTLRILDPEDRESETESNKNPTRQRSKRNWKSTMPKLSLGHPEAEPLSSVSDTSPEEDLAMCLMMLSRDTWQEHKLANAGPPKTRCSSGSEIKLKSKVRSKHLCHACHKSFRSSRALGSHRTLCSPRQEAQNNSIISNNNIKVFECPFCYKLFGSGQALGGHKRSHLIPSSSSTVNHSVKLKQSFIDLNLPAPAEDDDLSVVSDA

SEQ ID NO: 352 - protein, 297 aa, Bacillus subtilis subsp. subtilis str. 168
MKIGLIGLGKMGINIGKQFIDRNHQVVGYDVNQAAVDELKAYGAEGTTNLKEFISLLHPPRILWVMVPHGIVDAVLRDVSPLLSKGDMIIEAGNSHYKESIRRYNQMKEAGIHYLDAGTSGGMEGARHGACFMVGGDHEAWEIVEPLFRDTAVENGYLYAGEAGSGHFLKMIHNGIEYGMMAAIGEGFEVLENSQFDFDYEKVARVWNHGSVIRSWLMGLTERAFAKDAKLDQIKGIMHSSGEGKWTVETALDLQTATPVIAMSLMMRYRSLTDDTFTGKVVAALRNEFGGHATEKK

SEQ ID NO: 353 - protein, 110 aa, Arabidopsis thaliana
MAKHHPDLIMCRKQPGIAIGRLCEKCDGKCVICDSYVRPCTLVRICDECNYGSFQGRCVICGGVGISDAYYCKECTQQEKDRDGCPKIVNLGSAKTDLFYERKKYGFKKR

SEQ ID NO: 354 - protein, 478 aa, Arabidopsis thaliana
MAAESTRNSSPPSTSQSSSPIINLPDDHLLTILLLLPVDSILSFSMTCKRYKSLACSDSLWEALCEREWGPTSVDALKLSSLRDGFSWMLMFQRVYKMDSVCCHKISDPDDDDEESSSFPIPRASHSLNFVNDHLVLFGGGCQGGRHLDDTWTSYVDKSNQSILKWKKVKSGTPSGRFGHTCIVIGEYLLLFGGINDRGERLNDTWIGQVFCHEGLSWKLLNVGSLQRPRPPPRGAHSACCIAEKKMVVHGGIGLNGVRLGDTWILELSEDFSSGTWHMVESPQLPPPRSGHTLTCIRENQVVLFGGRGLGYDVLDDVWILDIQEPCEEKWIQIFYDFQDVPEYASLPRVGHSATLVLGGRILIYGGEDSYRHRKDDFWVLDVKTIPSSGLKPQGLSLNGSSVWKKLDRISYGPKSRSFHRACADCSGRFLYVFGGMVDGLLQPAASSGLRFDGELFMVELVLGFSDLDHQQRPGKSM

SEQ ID NO: 355 - protein, 215 aa, Arabidopsis thaliana
MKNPSVISFLIILLFAATICTHGNEPVKDTAGNPLNTREQYFIQPVKTESKNGGGLVPAAITVLPFCPLGITQTLLPYQPGLPVSFVLALGVGSTVMTSSAVNIEFKSNIWPFCKEFSKFWEVDDSSSAPKEPSILIGGKMGDRNSSFKIEKAGEGARANVYKLTTFYGTVGAIPGVWLSAPQLIITKDTAKTLLVKFKKVDDATTATSNLYFPG

SEQ ID NO: 356 - protein, 287 aa, Arabidopsis thaliana
MALTEDKSDSDGRRWGKFKLPFRNSNSQAPSASSSSSMATSSSSVTSSHLNQNYIHQSRHFQYHGPPVVEGLGQNHHQSAATIPSMSSVARSLLPTKRRLKLDPSAKLYFPYEPGKQVRSAIKIKNTSKSHVAFKFQTTVPKSCFMRPAGAILAPGEEIIATVFKFVEPPENNEKPMEQKSGVKFKIMSLKMKVPTDYMPELFEEQKDHVSEEQVMRVVFLDPENPNSMMEKLKSQLAEADAADEARKKASEGIVGPKPIGEGLVIDEWKQRRERYLAQQQGGVDAA

SEQ ID NO: 357 - protein, 355 aa, Glycine max
METPSSTARRITRSQIASNNNIPVSRKKNEDCSEKSVSKTRQRSSVQQQERCALVDISNDSPIAGLANGKDIIETPLSSMAKKKRVKKTMKTPGSGEALLRGQVKTLLQRVEEEAVISKLSMEIVAPFLKLANSSPMSLLAPTPANTPQVPNLSEVALVSPPSSVVEEQLISRVVNEIFEGKKNENAECEKSVITRSLLLDFSDKSEVSECSSEVTYQEVTQGSVGSRGSTEDDGASIWSIQVNASTHDEDEDDEEMGEEEEEEEEDYCEDAEECYDYVGGLSLEELCAGMNNISVNENKGCGKHTRFVYDSEDEIVEKVIECCAESDVMRLKGLPTPKGKHLRFPQEEENSSDL

SEQ ID NO: 358 - protein, 375 aa, Glycine max
MGSKGKRKEQESIITRVMAHGGRYVQYNVYGNLFEVSSKYVPPIRPVGRGAYGIVCAAVNCDTHEEVAIKKIGNAFDNIIDAKRTLREIKLLRHMDHENIIAIRDIIRPPRKDAFNDVYIVYELMDTDLHQIIRSDQPLNDDHCQYFLYQLLRGLKYVHSANILHRDLKPSNLLLNSNCDLKIADFGLARTTSETDFMTEYVVTRWYRAPELLLNCSEYTSAIDVWSVGCIFGEIMTREPLFPGKDYVHQLRLITELLGSPDDASLGFLRSGNAKRYVRQLPQYRKQNFSARFPNMSPEALDLLEKMLIFDPNKRITVDEALCHPYLSSLHDINDEPVGPGQFNFDFEQPTCTEEHIKELIWRESVKYNPDPPSQ

SEQ ID NO: 359 - protein, 242 aa, Glycine max
  unsure (1)..(242): unsure at all Xaa locations
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELQNLENQLEISLHGVRMKKDQLLMGEIQELNRKGNLIHQENVELYKKVYGTQDDNETNRDSVLTNGLGIGEDLQXACESPAKPATATATTLQGIFRNYKIGIAIALIHIQDVCVSQYLN

SEQ ID NO: 360 - protein, 307 aa, Glycine max
MKGSNNRFFTVALVAAWYSSNIGVLLLNKYLLSNYGFKYPIFLTMCHMTACSLLSYVAIAWMKVVPLQSIRSRVQFFKISALSLVFCVSVVFGNISLRYLPVSFNQAIGATTPFFTAVFAYLMTFKREAWLTYLTLVPVVTGVIIASGGEPSFHLFGFIICVAATAARALKSVLQGILLSSEGEKLNSMNLLLYMSPMAVVFLLPATLIMEENVVGITLALARDDSKIIWYLLFNSALAYFVNLTNFLVTKHTSALTLQVLGNAKGAVAVVVSILIFRNPVSVTGMMGYSLTVFGVILYSEAKKRSK

SEQ ID NO: 361 - protein, 248 aa, Glycine max
MGRGRVELKRIENKINRQVTFAKRRNGLLKKAYELSVLCDAEVALIIFSTRGKLYEFCSTNSMLKTLERYQKCSYGAVEVSKPGKELESSYREYLKLKARFESLQRTQRNLLGEDLGPLNTKDLEQLERQLDSSLKQVRSTKTQFMLDQLADLQNKEHMLVEANRSLTMKLEEINSRNQYRQTWEAGEQSMPYGTQNAHSQGFFQPLECTPTLQIGSDYRYIPEASEQQLAATTQAQQVNGFIPGWML

SEQ ID NO: 362 - protein, 324 aa, Glycine max
MEENLPPGFRFHPTDEELITCYLTRKVSDSSFTSKAIAVVDLNKCEPWDLPGKASMGKKEWYFFSLRDRKYPTGLRTNRATESGYWKTTGKDKEIFRAGVLVGMKKTLVFYRGRAPRGEKSNWVMHEYRLENKHHFGPSKDEWVVCRVFQKSLQVKRPQQTPSSQPESPCDTASMVNEFGDVELPNLINNIANSSGGLTNNISGQTCFNADLINSVNTNMNLAMNWPVASEVIQVPTLPSLPWPSGLLNPSISVNSLLLKALQLRSYQQREAATDHLIASYVPQGVSHVGTDLSSNLTASSSKVLECMPQQQQLEQPFNLDSIW

SEQ ID NO: 363 - protein, 428 aa, Glycine max
MAARSDHQTVPLSVLLRRELANEKIEKPEIAHGQACQSKKGEDLTLLKTECQRVVGDGVSTYSVFGLFDGHNGSAAAIYSKENLLNNVLSAIPPDLNRDEWIAALPRALVAGFVKTDKDFQEKGQKSGTTVTFVIIEGWVVTVASVGDSRCVLESSDGELYYLSADHRLETNEEERVRITSSGGEVGRLNTGGGAEVGPLRCWPGGLCLSRSIGDMDIGEFIVPVPYVKQVKMSTAGGRLVICSDGVWDSLPAEVALDCCRGMPADAAAPHIVKEAVQAKGLRDDTTCIVVDILPQEKPPVSAPQTKRPVKGMLKSMFRKKSSESSSYIDKEYMEPDVVEELYEEGSAMLSERLDTKYPVCNMFKLFMCAVCQVEIKPGEGISIHEGAPDSRKFRPWDGPFLCSSCQEKKEAMEGKRSSGRISSGSDE

SEQ ID NO: 364 - protein, 109 aa, Arabidopsis thaliana
MDTNNTRTVKFAALAIVLAALVLMEEPTSITACNINANHLEKCRPAVIGDNPPSPIKECCELLQAANLKCICRFKSVLPVLAVYPSKVQALLSKCGLTTIPPACQALRN

SEQ ID NO: 365 - protein, 180 aa, Arabidopsis thaliana
MASTATNTDFFKTLLSPFSNGNAAQRSSRQNIVWLNRKQSGNNNRSLRVNGLFGGGKKDNKEDGQSKAGILGNMQNLYETVKKAQMVVQVEAVRVQKELAVAEFDGYCQGELVKVTLSGNQQPIRTDITDAAMELGSEKLSLLVTEAYKDAHSKSVLAMKERMSDLAQSLGMPPGLDGLK

SEQ ID NO: 366 - protein, 342 aa, Glycine max
MGCSFSGLNALYDSVNGGGDVWINENRFRIVRQLGEGGFAYVYLVKEAPDDSAAAGLAKKLKGSSHLSDDGTYAMKKVLIQNNEQLELVREEIRVSSLFNHPNLLPLLEHAIISVKPTHETSWNHEAYLLFPVHLDGTLLDNAKIMKAKKEFYSTSDVLQIFRQLCAGLKHMHSFDPPYAHNDVKPGNVLITHRKGQPPLAILMDFGSARPARKQISSRSEALQLQEWASEHCSAPFRAPELWDCPSQADIDERTDIWSLGCTLYAIMYGVSPFEYALGESGGSLQLAIVNAQVKWPAGPKPPYPEALHQFVSWMLQPTASMRPRIDDIIIHVDKLVAKFSQ

SEQ ID NO: 367 - protein, 167 aa, Arabidopsis thaliana
MQRISLDSSASKLHSYGGRKDDTYDIDDLKPASSSPSSSSSAVDYDDHELKDFKPRRLSSLQSPFVTTNQKQEKLVHFIPILTLICFIILYLTSYAPSQSDLAQFNGFMRPSKHLESSDENGDEISGFIRADTLSIRSSVRNLQETESFTTKSLPRRRTSHRKTADF

SEQ ID NO: 368 - protein, 318 aa, Arabidopsis thaliana
MLSFFSNQIDRQKDVSNEEKTLTNLEKSDGSQFPGDDYRPSDRKNWMAGLTLEKLTLNKIVWPGTHDSATNDIGIPLISRPLAECQSLSIYEQLVLGTRVLDIRVQEDRQICHGILTSYEIDVVIDDVIRFLSETHSEIVILEIRTEFGHKDPPGFETYLADKLGQFLIHQDDSLFNKPVSEILPKRVICIWKPRESPKPSRGGILWNSDYLKDNWIDTDLPWTKFQSNLKHLSEQQPTSSRKFFYRVENTVTPQADNPVVWVKPVTDRIRKHARLFISQCVSKGCGDKLQILSTDFIEGDFVDACVGLTHARIEGKV

SEQ ID NO: 369 - protein, 250 aa, Arabidopsis thaliana
MATSSITIPTIRTPIHRSKFLGQTHQFSTVNRSVFPPPKQQSKLYQVKAMGKFNLWEVMGGRGLCNGEKGIEKELQRNIEDEQETSKAENNETERESDDSNLSFKVPEDGFEKEMMGLTGGFPGGEKGLKTFIEKNPPPPPPPPPAKQGSDASAVATDKKPKAPKLPLLMPGMIAIVKNQNSPYHMYCGIVQRITDGKAGVLFEGGNWDRLITFRLEELERREKGPPGKNPKSCILEPLIEQMQKEEAAP

SEQ ID NO: 370 - protein, 373 aa, Arabidopsis thaliana
MLKQESNDIGSGENNRARPCDTCRSNACTVYCHADSAYLCMSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 371 - protein, 468 aa, Pseudomonas syringae pv. tomato str. DC3000
MAKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIYSEQGSWMSDQDVEGGNKGHRPGIKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSDIALYFIGGIIKHGKALNGFTNPATNSYKRLVPGFEAPVMLAYSARNRSASIRIPYVNSPRGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 372 - protein, 410 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMEKVLVIHTGGTIAMHEDEKGGVQPKETNPLFATVESLTSIASIEVDDFLNIPSPHMTPELMFQLAERLKSRVGNESFDGVVITHGTDTLEETAYLLDLLLDWEVPVVVTGAMRSSNELGADGPHNFISAVKTAATDEAKGKGVLVVFNDEIHTAKNVTKTHTSNVATFQSPQYGPIGIVTKRGVTFHHAPSYKESYTVSSIDHRVVLLKAYAGMDGSVVDAIADTGIDGLVIEAFGQGNLPPAVVPSIKRLHQANIPVVLVSRSVSGIVQETYAYEGGGRHLKDLGVIFTNGLNGQKARLKLLVALELTTDRKKLQEIFFK

SEQ ID NO: 373 - protein, 287 aa, Arabidopsis thaliana
MYRDRGTVNSRPEVVDRKRINDALERPSPSTSRQVNGKGKGTVTAATTTANLIGKQQSNNINHRDSRSASLSKNNTVSDDESDTDSEESDVSGSDGEDTSWISWFCNLRGNEFFCEVDDDYIQDDFNLCGLSSLVPYYEYALDLILDVESSQGEMFTEEQNELIESAAEMLYGLIHARYILTSKGLAAMLDKYKNYDFGRCPRVYCCGQPCLPVGQSDLPRSSTVKIYCPKCEDIYYPRSKYQGNIDGAYFGTTFPHLFLMTYGHLKPAKATQNYVQRVFGFKLHKP

SEQ ID NO: 374 - protein, 155 aa, Arabidopsis thaliana
MDLGRFPIISILEDMLEVPEDHNNEKTRNNPSRVYMRDAKAMAATPADVIEHPNAYAFVVDMPGIKGDEIKVQVENDNVLVVSGERQRENKENEGVKYVRMERRMGKFMRKFQLPENADLDKISAVCHDGVLKVTVQKLPPPEPKKPKTIQVQVA

SEQ ID NO: 375 - protein, 315 aa, Arabidopsis thaliana
MRNYKLRLSVMSPSEWFHKLKNMTKPRKKHSLPLYSINTTKKRKPSSESKSLPYSSTSYFFNRSRSRTSFESRILQISPRNSLHNIQSKRKTVYKPSPPSSSIVSAGFNKTFHQSHDSLSASSNLKVISSEDDIIIDMNNRDFKKKTFKEITKFDSTEKACRASNRTKETHIPHHLSVKVSKEKEDEEEDACRTKKKHQKTLVSSGRRSSAKSPRIKLRARSPRIQVSPRRSKSRSQNKQILDSFAVIKSSIDPSKDFRESMVEMIAENNIRTSNDMEDLLVCYLTLNPKEYHDLIIKVFVQVWLEVINSTFASK

SEQ ID NO: 376 - protein, 129 aa, Arabidopsis thaliana
MADPELEAIRQRRMQELMARQGMGKQGNQQNPEQEKQQEDAKREADERRQMMLSQVLSSQARERIARIALVKPEKARGVEDVILRAAQMGQIVEKVSEERLITLLEQINSQTTKQTKVTYQRRRGVDDD

SEQ ID NO: 377 - protein, 228 aa, Arabidopsis thaliana
MIFSSLPSRLVMKDLFMEGERETSSMTCLTPKDSVQSPNMLVRQPKKETTTQTPKTTRGRQKIEIKKIEEETKRQVTFSKRRRGLFKKSAELSVLTGAKIAVITFSKCDRIYRFGHVDALIDKYLRKSPVKLEGYSGDNAADEESRRPWWERPVESVPEEELEEYMAALSMLRENIGKKIVAMGNDRTVDMVPAWPINVMGWKPTMDMQKLENLTDGVNRCRVGQNGD

SEQ ID NO: 378 - protein, 231 aa, Arabidopsis thaliana
MAKDGGVSCLRRSEMIGIGIGELESPPLDSDQVHVLAVDDSLVDRIVIERLLRITSCKVTAVDSGWRALEFLGLDDDKAAVEFDRLKVDLIITDYCMPGMTGYELLKKIKESTSFKEVPVVIMSSENVMTRIDRCLEEGAEDFLLKPVKLADVKRLRSYLTRDVKVAAEGNKRKLTTPPPPPPLSATSSMESSDSTVESPLSMVDDEDSLTMSPESATSLVDSPMRSPGLA

SEQ ID NO: 379 - protein, 311 aa, Arabidopsis thaliana
MQSKNMIVASSHQQQQQQQPQQPQPQLKCPRCDSSNTKFCYYNNYSLSQPRHFCKACKRYWTRGGTLRNVPVGGSYRKNKRVKRPSTATTTTASTVSTTNSSSPNNPHQISHFSSMNHHPLFYGLSDHMSSCNNNLPMIPSRFSDSSKTCSSSGLESEFLSSGFSSLSALGLGLPHQMSHDHTINGSFINNSTTNKPFLLSGLFGSSMSSSSTLLQHPHKPMNNGGDMLGQSHLQTLASLQDLHVGGNNEDMKYKEGKLDQISGNINGFMSSSSSLDPSNYNNMWNNASVVNGAWLDPTNNNVGSSLTSLI

SEQ ID NO: 380 - protein, 320 aa, Arabidopsis thaliana
MATAVGGGSDVEVGFAKLQGEDFEYYMQSYSIILGRNSKKATVDVDLSSLGGGMNISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 381 - protein, 284 aa, Arabidopsis thaliana
MAAFTTKQSLLLLSLLLLISLSAGSFYDNFDITWGNGRANIVESGQLLTCTLDKISGSGFQSKKEYLFGKIDMKMKLVAGNSAGTVTAYYLSSKGETWDEIDFEFLGNVTGQPYVLHTNVFTGGKGNREMQFYLWFDPTADFHTYTVLWNPLNIIFLVDGIPIRVFKNNEANGVAYPKSQPMKIYSSLWEADDWATQGGKVKTDWTNAPFSASYKSFNDVDCCSRTSLLNWVTCNANSNSWMWTTLNSNQYGQMKWVQDDYMIYNYCTDFKRFPQGLPTECNLN

SEQ ID NO: 382 - protein, 144 aa, Arabidopsis thaliana
MMQELGLQRFSNDVVRLDLTPPSQTSSTSLSIDEEESTEAKIRRLISEHPVIIFSRSSCCMCHVMKRLLATIGVIPTVIELDDHEVSSLPTALQDEYSGGVSVVGPPPAVFIGRECVGGLESLVALHLSGQLVPKLVQVGALWV

SEQ ID NO: 383 - protein, 279 aa, Arabidopsis thaliana
MVSFRFPFSFSQPPRATTSFSGFSISAVAVSVTVGAAAAGAAIAASRNPSHPILEWAFSSHRSSLSPWGSITLADESVVEPKTGFSFPASIGDSRRLLGVGLRKKSLLGLKNIDVYAFGVYADCDDVKKLVGDKYANLPASEIRGNKSFMDDLMEADIKMTIRLQIVYGKLNIRSVRNAFQESVGNRLKKFGGSDNDELLQSFTSLFKDEYKIPRNSTIDLTKDPGHVLSVAIEGNHVGSVKSHLLCRSILDLYIGEEPFDKNAREDFLDNAASLAFDN

SEQ ID NO: 384 - protein, 242 aa, Synechocystis sp. PCC 6803
MRKIIIAGNWKMHKTQAEAQAFLQGFKPLIEDAAESREVVLCVPFTDLSGMSQQLHGGRVRLGAQNVHWEASGAYTGEISAAMLTEIGIHYVVIGHSERRQYFGETDETANLRVLAAQKAGLIPILCVGESKAQRDAGETEQVIVDQVKKGLVNVDQSNLVIAYEPIWAIGTGDTCAATEANRVIGLIREQLTNSQVTIQYGGSVNANNVDEIMAQPEIDGALVGGASLEPQSFARIVNFQP

SEQ ID NO: 385 - protein, 388 aa, Arabidopsis thaliana
LIKMVEQTQHPTILQKVSGQLLSSSVSQDIRGYASASKRPATYQKHAAYGNYSNAAFQYPLVAASQIATTTSPVFVQAPGEKGFTNFAIDFMMGGVSAAVSKTAAAPIERVKLLIQNQDEMLKAGRLTEPYKGIRDCFGRTIRDEGIGSLWRGNTANVIRYFPTQALNFAFKDYFKRLFNFKKDKDGYWKWFAGNLASGGAAGASSLLFVYSLDYARTRLANDSKSAKKGGGERQFNGLVDVYKKTLKSDGIAGLYRGFNISCAGIIVYRGLYFGLYDSVKPVLLTGDLQDSFFASFALGWLITNGAGLASYPIDTVRRRMMMTSGEAVKYKSSFDAFSQIVKKEGAKSLFKGAGANILRAVAGAGVLAGYDKLQLIVFGKKYGSGGA

SEQ ID NO: 386 - protein, 283 aa, Arabidopsis thaliana
MPKICCSRSATQVVVAQKSNSGKGRNGEGGIKYGFSLIKGKSNHSMEDYHVAKFTNFNGNELGLFAIFDGHKGDHVAAYLQKHLFSNILKDGEFLVDPRRAIAKAYENTDQKILADNRTDLESGGSTAVTAILINGKALWIANVGDSRAIVSSRGKAKQMSVDHDPDDDTERSMIESKGGFVTNRPGDVPRVNGLLAVSRVFGDKNLKAYLNSEPEIKDVTIDSHTDFLILASDGISKVMSNQEAVDVAKKLKDPKEAARQVVAEALKRNSKDDISCIVVRFR

SEQ ID NO: 387 - protein, 510 aa, Arabidopsis thaliana
MDSKTTFLTFLLCIFIFSHFSPSTSKSLTEKPLSFSPSASLPTLTAERLIKGFNLMPTRDVNVIDEEGSEAPRLVERAFDLPAAVDRRGSGGSPSVQDFGHHAGYYKLPNSKAARMFYFFFESRTNKADPVVIWLTGGPGCSSELALFYENGPFTVSNNSSLSWNEFGWDKASNLIYVDQPVGTGFSYTSDQSDLRHDEDGVSNDLYDFLQAFFKEHPQFVKNDFYITGESYAGHYIPALASRVHRGNKNKEGTHINLKGFAIGNGLTNPEIQYGAYADYALDMNLITQSDHDNLNRYYATCQQSIKECSADGGEGDACASSYTVCNNIFQKIMDIAGNVNYYDVRKQCEGSLCYDFSNMENFLNQKSVRKALGVGDIEFVSCSTAVYEAMQMDWMRNLEVGIPALLQDGIKLLVYAGEYDLICNWLGNSKWVHEMEWSGQKEFVAAATVPFHVDNKEAGLMKNYGSLTFLKVHDAGHMVPMDQPKAALQMLQNWMQGKLSTPTGRTAHQ

SEQ ID NO: 388 - protein, 214 aa, Arabidopsis thaliana
MEVLVGSTFRDRSSVTTHDQAVPASLSSRIGLRRCGRSPPPESSSSVGETSENEEDEDDAVSSSQGRWLNSFSSSLEDSLPIKRGLSNHYIGKSKSFGNLMEASNTNDLVKVESPLNKRRRLLIANKLRRRSSLSSFSIYTKINPNSMPLLALQESDNEDHKLNDDDDDDDSSSDDETSKLKEKRMKMTNHRDFMVPQTKSCFSLTSFQDDDDR

SEQ ID NO: 389 - protein, 328 aa, Arabidopsis thaliana
MLTLLFFSLGALLLIVLLFKFAFADGDFTLISKKHVKREAIQGKVVWITGASRGIGEILAKQFASLDAKLILSARNKAELDRVKSELKGKFAPEDVKVLPLDLASGEESLKHVVEQAVSLFPGAGVDYLVHNAAFERPKSKASDASEETLKTTFDVNVFGTISLTKLVAPHMLKQGGGHFVVISSAAGKVPSPGQAIYSASKHALHGYFHSLRSEFCQKGIKVTVVCPGPIETWNGTGTSTSEDSKSPEKRVSSERCAELTIIAASHNLKEAWISYQPVLLVMYLVQYMPSLGFWLMDKVGGKRVEVAEKKGNTYSWDLLFGKKTKTN

SEQ ID NO: 390 - protein, 221 aa, Arabidopsis thaliana
MSDAFDGYERQYCELSASLSKKCSSAISLDGEQKKQKLSEIKSGLENAEVLIRKMDLEARTLPPNLKSSLLVKLREFKSDLNNFKTEVKRITSGQLNAAARDELLEAGMADTKTASADQRARLMMSTERLGRTTDRVKDSRRTMMETEEIGVSILQDLHGQRQSLLRAHETLHGVDDNIGKSKKILTDMTRRMNKNKWTIGAIIIALIAAIFIILYFKLTK

SEQ ID NO: 391 - protein, 691 aa, Arabidopsis thaliana
MVSPLTLFLILFFFFLSSALSSSSSELDILLDIKSSLDPEKRFLTSWTPDADPCSSGSFDGVACDGNRRVANISLQGMGLTGTIPPSIGLLTSLTGLYLHFNSLTGHIPKDISNLPLLTDLYLNVNNLSGEIPPLIGNLDNLQVIQLCYNKLSGSIPTQFGSLKKITVLALQYNQLSGAIPASLGDIDTLTRLDLSFNNLFGPVPVKLAGAPLLEVLDIRNNSFSGFVPSALKRLNNGFQYSNNHGLCGDGFTDLKACTGLNGPNPNRPDPTNPTNFTTVDVKPESADLQRSNCSNNNGGCSSKSLKSSPLGIVMGLIGSILAVAIFGGSTFTWYRRRKQKIGSSLDAMDGRISTEYNFKEVSRRKSSSPLISLEYASGWDPLGRGQSSNNNSALSQEVFESFMFNLEEIERATQSFSEINLLGKSNVSSVYKGILRDGSVAAIKCIAKSSCKSDESEFLKGLKMLTLLKHENLARLRGFCCSKGRGECFLIYEFVPNGNLLQYLDVKDETGEVLEWATRVSIINGIARGIVYLHGENGNKPAIVHQNLSAEKILIDHWYNPSLADSGLHKLFTDDIVFSKLKASAAMGYLAPEYITTGRFTDKSDVYAFGMILLQILSGKSKISHLMILQAVESGRLNEDFMDPNLRKNFPEVEAAQLARLGLLCTHESSNQRPSMEDVIQELNNLAADY

SEQ ID NO: 392 - protein, 179 aa, Arabidopsis thaliana
MGGGKDKHHDEQEKGFHGFPGGGHYPPAQGGYPPQGYPPQQGYPPAGGYPPAGYPPGAYPAAPGGYPPAPGGYPPAGYPAPGAHHSGHSGGGLGGMIAGAAGAAAAAYGAHHVGHASHNPYGHAVGHGGYGHAPAHGFGHGGHGKFKHGKHGGKFKHGKHGKHGKHGMFGGGGKFKKWK

SEQ ID NO: 393 - protein, 309 aa, Arabidopsis thaliana
MEGTGVVAVYGNGAITEAKKSPFSVKVGLAQMLRGGVIMDVVNAEQARIAEEAGACAVMALERVPADIRAQGGVARMSDPQMIKEIKQAVTIPVMAKARIGHFVEAQILEAIGIDYIDESEVLTLADEDHHINKHNFRIPFVCGCRNLGEALRRIREGAAMIRTKGEAGTGNIIEAVRHVRSVNGDIRVLRNMDDDEVFTFAKKLAAPYDLVMQTKQLGRLPVVQFAAGGVATPADAALMMQLGCDGVFVGSGIFKSGDPARRARAIVQAVTHYSDPEMLVEVSCGLGEAMVGINLNDEKVERFANRSE

SEQ ID NO: 394 - protein, 510 aa, Arabidopsis thaliana
MFIESFKVESPNVKYTENEINSVYDYETTEVVHENRNGTYQWVVKPKTVKYDFKTDTRVPKLGVMLVGWGGNNGSTLTAGVIANKEGISWATKDKVQQANYFGSLTQASSIRVGSYNGEEIYAPFKSLLPMVNPEDVVFGGWDISDMNLADAMARARVLDIDLQKQLRPYMENMIPLPGIYDPDFIAANQGSRANSVIKGTKKEQVDHIIKDMREFKEKNKVDKLVVLWTANTERYSNVIVGLNDTTENLLASVEKDESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVADSKRAMDEYTSEIFMGGRNTIVLHNTCEDSLLAAPIILDLVLLAELSTRIQFKAEGEGKFHSFHPVATILSYLTKAPLVPPGTPVVNALSKQRAMLENILRACVGLAPENNMIMEYK

SEQ ID NO: 395 - protein, 247 aa, Glycine max
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQEQQETSSSNGSVVKGSILERCPDLNLELTISPPRQQQQTQKNLCFVCSLGLHNSKDCSCNVSNAVTVNNTTPSSAAAAAAYDFLGMKTSGVWDCTRLEMK

SEQ ID NO: 396 - protein, 634 aa, Arabidopsis thaliana
MGLVTVGELKPAFTGKRGFRLNSTIRHASEWPISDVSSDLTVQVGSSSFCLHKFPLVSRSGKIRKLLADPKISNVCLSNAPGGSEAFELAAKFCYGINIEINLLNIAKLRCASHYLEMTEDFSEENLASKTEHFLKETIFPSILNSIIVLHHCETLIPVSEDLNLVNRLIIAVANNACKEQLTSGLLKLDYSFSGTNIEPQTPLDWWGKSLAVLNLDFFQRVISAVKSKGLIQDVISKILISYTNKSLQGLIVRDPKLEKERVLDSEGKKKQRLIVETIVRLLPTQGRRSSVPMAFLSSLLKMVIATSSSASTGSCRSDLERRIGLQLDQAILEDVLIPINLNGTNNTMYDIDSILRIFSIFLNLDEDDEEEEHHHLQFRDETEMIYDFDSPGSPKQSSILKVSKLMDNYLAEIAMDPNLTTSKFIALAELLPDHARIISDGLYRAVDIYLKVHPNIKDSERYRLCKTIDSQKLSQEACSHAAQNERLPVQMAVQVLYFEQIRLRNAMSSSIGPTQFLFNSNCHQFPQRSGSGAGSGAISPRDNYASVRRENRELKLEVARMRMRLTDLEKDHISIKQELVKSNPGTKLFKSFAKKISKLNSLFSFSSLKPSLSGKASSESRFLFQRKRRHSVS

SEQ ID NO: 397 - protein, 329 aa, Arabidopsis thaliana
MSAAAHRTPKSGRQSLLFQDLASPVSARRGKFSSPGQAAAVSALWRENFGGSDLPPPPMYTLDDRSDFSPESGIADYSASPDAKSDRRTPFQSSGKNIVTPGKGKLEASPSFSLLNAQQSQQVSGSPSWWSQSKAGSSTEQDDKGKGSPVEGVVQPGALVTLPPPREVARPEVQRQIIPTGNLDEEEWVTVYGFSPGDTNLVLREFEKCGMVLKHVPGPRNANWMHILYQNRSDAHKALNKAGMMINGVVIVGVKPVDPIQKQALNERLNNQGFMPLPPPSSTRNTARPLSRPQYLQNGSAFSPQPSGGAMASPSKSMVSKFFDLMFGV

SEQ ID NO: 398 - protein, 313 aa, Arabidopsis thaliana
MGVKSFVEGGIASVIAGCSTHPLDLIKVRLQLHGEAPSTTTVTLLRPALAFPNSSPAAFLETTSSVPKVGPISLGINIVKSEGAAALFSGVSATLLRQTLYSTTRMGLYEVLKNKWTDPESGKLNLSRKIGAGLVAGGIGAAVGNPADVAMVRMQADGRLPLAQRRNYAGVGDAIRSMVKGEGVTSLWRGSALTINRAMIVTAAQLASYDQFKEGILENGVMNDGLGTHVVASFAAGFVASVASNPVDVIKTRVMNMKVGAYDGAWDCAVKTVKAEGAMALYKGFVPTVCRQGPFTVVLFVTLEQVRKLLRDF

SEQ ID NO: 399 - protein, 339 aa, Arabidopsis thaliana
MNWTRGKTLGRGSTATVSAATCHESGETLAVKSAEFHRSEFLQREAKILSSLNSPYVIGYRGCEITREPFHNNGEATTYSLLMEYAPYGTLTDVATKNGGFIDEARVVKYTRQILLGLEYIHNSKGIAHCDIKGSNVLVGENGEAKIADFGCAKWVEPEITEPVRGTPAFMAPEAARGERQGKESDIWAVGCTVIEMVTGSQPWIGADFTDPVSVLYRVGYLGELPELPCSLTEQAKDFLGKCLKKEATERWTASQLLNHPFLVNKEPELVTGLVTNSPTSVTDQMFWRSVEEEVSEDRSSWWECHEDERIGVLSWIGHVVVESTWDLDGEDWITVRRN

SEQ ID NO: 400 - protein, 217 aa, Arabidopsis thaliana
MARRPDEEYDYLFKVVLIGDSGVGKSNLLSRFTRNEFCLESKSTIGVEFATRTLQVEGRTVKAQIWDTAGQERYRAITSAYYRGALGALLVYDVTKPTTFENVSRWLKELRDHADSNIVIMLIGNKTDLKHLRAVATEDAQSYAEKEGLSFIETSALEALNVEKAFQTILSEVYRIISKKSISSDQTTANANIKEGQTIDVAATSESNAKKPCCSSS

SEQ ID NO: 401 - protein, 170 aa, Glycine max
MASDGSEEFRLVSPAFKNGGKLPRHYTDDGQGTKKNISPPLEWYNLPEGTKTLALVVEDIDATDSGGPMVPWTHWVVANILATVKGLPEGFSGKSAEMGGDYAAIKEGNNDLKVPGWNGPRLPTPGHRIQFRLYALDDELKLGNKLTKEKLLEDTIEGHVLGEATLMAIF

SEQ ID NO: 402 - protein, 122 aa, Arabidopsis thaliana
MGNGDKVMSHWSFHIPRLHHHEHDHEKVPKGCLAVKVGQGEEQERFVIPVMYFNHPLFGQLLKEAEEEFGFAQKGTITIPCHVEEFRYVQGLIDRENTRFLGTNLLDHHHHHHNHLIRCFRV

SEQ ID NO: 403 - protein, 635 aa, Xanthomonas campestris
MTVTCEMDALGRAPDIGRERGLLGRSLVSAGVITDEQLRAALALQQRWNSRLGDVILAQRGVPAQRFYAIVAAHFGLQFVDLVQQPPDPELLTATDLDVYAQRLILPWRREDGVLVLAVADPDPALFAWAREHYGAQVRFVGTAKFDIIWSLQRYADEQLTDNALNLLAAHAPTYSARQVVTRGQKFTLWAIAAVLVAAIAAFPIITLITINVLVALGFLATFGLKLLLVWFGSRHRIDIKVTEDEVAALRDDDLPVYTVLVPMYKEPEVLPILANALRKLDYPISKLDVKLVLEADDFDTIEAAKKLGLEAFFEIIRVPPSQPKTKPKACNYALHFARGELLTIYDAEDKPEPDQLKRVVAAFRKAEKDVVCIQARLNYYNADENWLTRMFTLEYTLWFDFYLPALEYLRIPIPLGGTSNHFRLDVLRQVRAWDPYNVTEDADLGVRLIQNGYRVNVVNSTTFEEANVSIPNWIRQRSRWLKGYMQTWLVHMRDPVHLYRSTGFKGFWGFQFFIGGNFFIALGVPVMWTLCLISMLSGARIFDATFPPWLATISLVNLLLANAFFVYVTLVAAFKRDYFKLAPYALTVPFYWLLQSIAAYKGLWQLIRNPFYWEKTTHGISKHSEQERRAALEE

SEQ ID NO: 404 - protein, 511 aa, Arabidopsis thaliana
MEILTSIAITVATTIFIVLCFTIYLMIRIFTGKSRNDKRYAPVHATVFDLLFHSDELYDYETEIAREKPTYRFLSPGQSEILTADPRNVEHILKTRFDNYSKGHSSRENMADLLGHGIFAVDGEKWRQQRKLSSFEFSTRVLRDFSCSVFRRNASKLVGFVSEFALSGKAFDAQDLLMRCTLDSIFKVGFGVELKCLDGFSKEGQEFMEAFDEGNVATSSRFIDPLWKLKWFFNIGSQSKLKKSIATIDKFVYSLITTKRKELAKEQNTVVREDILSRFLVESEKDPENMNDKYLRDIILNFMIAGKDTTAALLSWFLYMLCKNPLVQEKIVQEIRDVTFSHEKTTDVNGFVESINEEALDEMHYLHAALSETLRLYPPVPVDMRCAENDDVLPDGHRVSKGDNIYYIAYAMGRMTYIWGQDAEEFKPERWLKDGLFQPESPFKFISFHAGPRICLGKDFAYRQMKIVSMALLHFFRFKMADENSKVYYKRMLTLHVDGGLHLCAIPRTST

SEQ ID NO: 405 - protein, 54 aa, Arabidopsis thaliana
MVNNVVSIEKMKALWHSEVHDEQKWAVNMKLLRALGMFAGGVVLMRSYGDLMGV

SEQ ID NO: 406 - protein, 380 aa, Arabidopsis thaliana
MSMDFSPLLTVLEGDFNKDNTSSATEIDTLENLDDTRQISKGKPPRHLTSSATRLQLAANADVDVCNLVMKSLDDKSEFLPVYRSGSCAEQGAKQFMEDEHICIDDLVNHLGAAIQCSSLGAFYGVFDGHGGTDAAHFVRKNILRFIVEDSSFPLCVKKAIKSAFLKADYEFADDSSLDISSGTTALTAFIFGRRLIIANAGDCRAVLGRRGRAIELSKDHKPNCTAEKVRIEKLGGVVYDGYLNGQLSVARAIGDWHMKGPKGSACPLSPEPELQETDLSEDDEFLIMGCDGLWDVMSSQCAVTIARKELMIHNDPERCSRELVREALKRNTCDNLTVIVVCFSPDPPQRIEIRMQSRVRRSISAEGLNLLKGVLDGYP

SEQ ID NO: 407 - protein, 109 aa, Arabidopsis thaliana
MKESGLRLREITDKMATGTATEKPKIVWNEGRHRFETDDHEAFIEYKMKNDGKVMDLVRTFVPPSKAGLGLASHLCVAAFEHASEHSFSIIPTCSYVSVYISSFLKKLR

SEQ ID NO: 408 - protein, 519 aa, Arabidopsis thaliana
MTDISSLFRNRSRKDQLDYGLTVIVISTLCWCLWLYAKCKRRSPPLPPGPWGLPIIGNLPFLQPELHTYFQGLAKKHGPIFKLWLGAKLTIVVTSSEVAQEILKTNDIIFANHDVPAVGPVNTYGGTEIIWSPYGPKWRMLRKLCVNRILRNAMLDSSTDLRRRETRQTVRYLADQARVGSPVNLGEQIFLMMLNVVTQMLWGTTVKEEEREVVGAEFLEVIREMNDLLLVPNISDFFPVLSRFDLQGLAKRMRRPAQRMDQMFDRIINQRLGMDRDSSDGRAVDFLDVLLKVKDEEAEKTKLTMNDVKAVLMDMVLGGTDTSLHVIEFAMAELLHNPDIMKRAQQEVDKVVGKEKVVEESHISKLPYILAIMKETLRLHTVAPLLVPRRPSQTTVVGGFTIPKDSKIFINAWAIHRNPNVWENPLKFDPDRFLDMSYDFKGNDFNYLPFGSGRRICVGMAMGERVVLYNLATFLHSFDWKIPQGERVEVEEKFGIVLELKNPLVATPVLRLSDPNLYL

SEQ ID NO: 409 - protein, 258 aa, Saccharomyces cerevisiae
MGSRRYDSRTTIFSPEGRLYQVEYALESISHAGTAIGIMASDGIVLAAERKVTSTLLEQDTSTEKLYKLNDKIAVAVAGLTADAEILINTARIHAQNYLKTYNEDIPVEILVRRLSDIKQGYTQHGGLRPFGVSFIYAGYDDRYGYQLYTSNPSGNYTGWKAISVGANTSAAQTLLQMDYKDDMKVDDAIELALKTLSKTTDSSALTYDRLEFATIRKGANDGEVYQKIFKPQEIKDILVKTGITKKDEDEEADEDMK

SEQ ID NO: 410 - protein, 670 aa, Arabidopsis thaliana
MEGQGCCGGGGGKTEMIPTEEALRIVFGVSKRLPPVIVSLYEALGKVLAEDIRAPDPLPPYPASVKDGYAVVASDGPGEYPVITESRAGNDGLGVTVTPGTVAYVTTGGPIPDGADAVVQVEDTKVIGDVSTESKRVKILIQTKKGTDIRRVGCDIEKDATVLTTGERIGASEIGLLATAGVTMVKVYPMPIVAILSTGDELVEPTAGTLGRGQIRDSNRAMLVAAVMQQQCKVVDLGIVRDDRKELEKVLDEAVSSGVDIILTSGGVSMGDRDFVKPLLEEKGKVYFSKVLMKPGKPLTFAEIRAKPTESMLGKTVLAFGLPGNPVSCLVCFNIFVVPTIRQLAGWTSPHPLRVRLRLQEPIKSDPIRPEFHRAIIKWKDNDGSGTPGFVAESTGHQMSSRLLSMRSANALLELPATGNVLSAGSSVSAIIVSDISAFSIDKKASLSEPGSIRKEKKYDEVPGPEYKVAILTVSDTVSAGAGPDRSGPRAVSVVDSSSEKLGGAKVVATAVVPDEVERIKDILQKWSDVDEMDLILTLGGTGFTPRDVTPEATKKVIERETPGLLFVMMQESLKITPFAMLSRSAAGIRGSTLIINMPGNPNAVAECMEALLPALKHALKQIKGDKREKHPKHIPHAEATLPTDTWDQSYKSAYETGEKKEEAGCSCTH

SEQ ID NO: 411 - protein, 176 aa, Saccharomyces cerevisiae
MGRDICTLDNVYANNLGMLTKLAHVTVPNLYQDAFFSALFAEDSLVAKNKKPSSKKDVHFTQMAYYSEIPVGGLVAKLVPKKQNELSLKGIQIEFLGVLPNYRHKSIGSKLLKFAEDKCSECHQHNVFVYLPAVDDLTKQWFIAHGFEQVGETVNNFIKGVNGDEQDAILLKKHIS

SEQ ID NO: 412 - protein, 424 aa, Agrobacterium tumefaciens str. C58 [sequence omitted]

SEQ ID NO: 413 - protein, 366 aa, Glycine max
MGEIEREEMSSTRWEKEEEEEEEEAQMDIWKYIFGFVELAVIKCAIELGIAEAIEKHGSPMTLSEISSSLGCDTSHLKRIMRFLVQRKIFKGDGCSRGYSQSALSRRLMRNGEHSMASFLLLESSPVMLAPWHSLSARVMANGNPSFAKAHGEDVWRYAAANLDHSNLINEAMACDAKLVMPIIIQSCSEAFHGLKSLVDVGGGNGTAMRILAKACPSIRPINFDLPHVIALCDGDGDGVQHVSGDMFLSVPKADAAFLMWVLHDWSDEECIQILKKCREAISNSKENGRVIIVEAVIEGEGEGEGGKHDGLKDVGLMLDMVMMAHTNFGKERTLKEWEYVIKMAGFSSYTVKPIHAVQSVIMAFY

SEQ ID NO: 414 - protein, 335 aa, Glycine max
MRAGKGSQEEDEYEEEEFGSSKKQGTSSAPNTNKDGKAIDKASAIRSKHSVTEQRRRSKINERFQILRDLIPHSDQKRDTASFLLEVIEYVQYLQEKVQKYEGSYQGWGQEPSKLMPWRNSHWRVQSFAGQPTAVKNGLGPVSPFPGKFDESNVSISPTMLNGSQNTIDPDQSRDIVNKTAERQPDLVSKGIPLPLAMHANMSVPVRSDGVLAHPLQGTVSNAQSTECPTTSEPQNQQDELSVEGGTISISSAYSQGLLNNLTQALQSAGLDLSQASISVQINLGKRANKGLNCGTSSLKHHDNPSSNNQTIAHFRDAGSGEDSDQAQKRMKTYK

SEQ ID NO: 415 - protein, 342 aa, Glycine max
MAGIRLQPEDSDVSQQSRAVALSATDLVSDDDRSVAADSWSIKSEYGSTLDDDQRHADAAEALSNANLRPPSDYSSDKDEPDSEAVTSMLGFQSYWDSAYADELTNFREHGHTGEVWFGVDVMEVVASWTKALCVEISQGHIPNGVDEVKAEADKLGDKVLSTWSVLDIGTGNGLLLQELAKQGFSDLTGTDYSERAISLAQSLANRDGFSNVKFLVDDVLETKLEQEFRLVMDKGTLDAIGLHPDGPVKRMMYWDSVSRLVASGGILVITSCNNTKDELVQEVESFNQRKIATAQELGAVKDEEPCREPPFQYVNHVRTYPTFMFGGSVGSRVATVAFLRK

SEQ ID NO: 416 - protein, 396 aa, Arabidopsis thaliana
MAATSNSGEDPTLSYHHRSPFRFELLQSISSSDPRYSSLTPSSTNRPFSVSQSLPNSQLSPLISPHWDDSYSQITQKVQKSRKNHRIQLGSIANMSGGESIDIAKVIVKQESSPQNVKRVYNKSKGGTKLLKAGKRMANGEVQNGGLNGASINCRYDSSLGLLTKKFVKLIQEAEDGTLDLNYCAVVLEVQKRRIYDITNVLEGIGLIEKTTKNHIRWKGADNLGQKDLGDQISRLKSEVESMQSEESRLDDLIRERQEALRSLEEDDYCRRYMFMTEEDITSLPRFQNQTLLAIKAPTASYIEVPDPDEMSFPQQYRMVIRSRMGPIDVYLLSKYKGDSAETSDKLGNESDQKAPVGVDTPSLKIVTSDTDLKADYWFESDAEVSLTDLWSNFNS

SEQ ID NO: 417 - protein, 193 aa, Arabidopsis thaliana
MRFRYAMVCSSNQNRSMEAHALLKRQGLDVASYGTGSHVKLPGPSLREPNVYDFGTPYKQMFDELRRKDPELYKRNGILQMIKRNLSVKLAPQRWQDNAGDGVFDVVMTFEEKVFDSVLEDLNNREQSLTKTILVMNLEVKDNHEEAAIGGRLALELCQEIEGNETWEDTIDDIVAGFEKQHRRKLVYSISFY

SEQ ID NO: 418 - protein, 459 aa, Arabidopsis thaliana
MNVRDEGKTTAEKHGGGEENKSPENKWRFNSPLAQVSLMGFVCFCCPGMFNALSGMGGGGQVDPTAANNANTAVYTAFTVFGLLGGGFYNVLGPRLTLAAGCSTYVLYAGSFLYYNHHHHQAFAIVAGALLGCGAGLLWAGEGAVMTSYPPPHRKGTYIALFWSIFNLGGVIGGLIPFILNYQRSSAASVNDSTYIAFMCFMFAGVLLSFGILPATSVIRNDGSRCSAVKYSRPSTEAAAVLRLFLDRKMLLIVPAAWASNFFYSYQFNNVNGLLFNLRTRGFNNVFYWGAQMAGSIAIGYVMDFSFKSRRARGFTGISLVAVIGTIIWAGGLANQHGYSLDKLPEKKLDFKDSGIEFAGPFVLYMSYGLLDAMYQSMVYWLIGALADDSQTLSRYSGFYKGVQSAGAAVAWQVDTRKVPLMSQLIVNWSLTTVSYPLLVLLVYFYVKNDNDDDSNDKV

SEQ ID NO: 419 - protein, 103 aa, Arabidopsis thaliana
MSATPEEDKKPDQGAHINLKVKGQDGNEVFFRIKRSTQLKKLMNAYCDRQSVDFNSIAFLFDGRRLRAEQTPDELEMEDGDEIDAMLHQTGGGAKNGLKLFCF

SEQ ID NO: 420 - protein, 184 aa, Arabidopsis thaliana
  unsure (1)..(184): unsure at all Xaa locations
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQXDSLISMEEQLETALSVIRAKKTELMMEDMKSLQEREKLLIEENQILASQVGKKTFLVIEGDRGMSRENGSGNKVPETLSLLK

SEQ ID NO: 421 - protein, 141 aa, Arabidopsis thaliana
MTAAAVPATGSFQKQDEEWRAVLSPEQFRVLRLKGTDKRGKGEFTKKFEEGTYSCAGCGTALYKSTTKFDSGCGWPAFFDAIPGAIKQTPEAGGRRMEITCAVCDGHLGHVFKGEGYSTPTDQRHCVNSVSLKFSSAGSSQ

SEQ ID NO: 422 - protein, 592 aa, Arabidopsis thaliana
MKVVDKIKSVTEQGQTAFSFEFFPPKTEDGVENLFERMDRLVSYGPTFCDITWGAGGSTADLTLEIASRMQNVICVETMMHLTCTNMPIEKIDHALETIRSNGIQNVLALRGDPPHGQDKFVQVEGGFACALDLVNHIRSKYGDYFGITVAGYPEAHPDVIEADGLATPESYQSDLAYLKKKVDAGADLIVTQLFYDTDIFLKFVNDCRQIGINCPIVPGIMPISNYKGFLRMAGFCKTKIPAELTAALEPIKDNDEAVKAYGIHFATEMCKKILAHGITSLHLYTLNVDKSAIGILMNLGLIDESKISRSLPWRRPANVFRTKEDVRPIFWANRPKSYISRTKGWNDFPHGRWGDSHSAAYSTLSDYQFARPKGRDKKLQQEWVVPLKSIEDVQEKFKELCIGNLKSSPWSELDGLQPETKIINEQLGKINSNGFLTINSQPSVNAAKSDSPAIGWGGPGGYVYQKAYLEFFCSKDKLDTLVEKSKAFPSITYMAVNKSENWVSNTGESDVNAVTWGVFPAKEVIQPTIVDPASFKVWKDEAFEIWSRSWANLYPEDDPSRKLLEEVKNSYYLVSLVDNNYINGDIFSVFA

SEQ ID NO: 423 - protein, 210 aa, Arabidopsis thaliana
MASAHSIAAVSVLDAASKQATLPSSSSSSSALYPLSSLRSKPRQQLLSLRSVALKGRVKAQAKEAEASPSPVGVGDAFSNVKHLLLPVIDRNPYLSEGTRQAAATTTSLAKKYGADITVVVIDEEKRESSSEHETQVSNIRWHLSEGGFEEFKLLERLGEGKKATAIIGEVADELKMELVVMSMEAIHSKYIDANLLAEFIPCPVLLLPL

SEQ ID NO: 424 - protein, 165 aa, Saccharomyces cerevisiae
MKVKINEVHSVFAWSWHIPSTSDEDAANNDPNGNDEDEDVCGICRASYNGTCPSCKFPGDQCPLVIGLCHHNFHDHCIYRWLDTPTSKGLCPMCRQTFQLQKGLAINDAHVQKFVEIVSRRREEMIEEGVAEEFVDFDEPIRQNTDNPIGRQQVDTILDEDFLLR

SEQ ID NO: 425 - protein, 402 aa, Arabidopsis thaliana
MATENLTDKNVVFRKLKSKSENKVCFDCSAKNPTWASVPYGIFLCIDCSAVHRSLGVHISFVRSTNLDSWSPEQLRTMMFGGNNRAQVFFKQHGWNDGGKIEAKYTSRAADMYRQTLAKEVAKAMAEETVLPSLSSVATSQPVESSENGFTSESPKESSLKQEAAVVSSPKASQKVVASTFKKPLVSRKSGKTGGLGARKLTTKSKDNLYEQKPEEPVPVIPAASPTNDTSAAGSSFASRFEYFDDEQSGGQSGTRVLSHVAPPKSSNFFNEFGMDSAFPKKSSSSSSKAQVEETDEARKKFSNAKSISSAQFFGNQNRDADLDSKATLQKFSGSAAISSSDLFGHGPDDSNIDITASDLINRISFQAQQDMSSIANLAEETKNKLGTFASSIFSDLQDRML

SEQ ID NO: 426 - protein, 196 aa, Arabidopsis thaliana
MVTSPTNSTIKFLCSYGGKILPRYPDGKLRYNGGHTRVLAVPRSVSFSELASKMAEMCGGVGGSITVTIRCQLPTEDLDALVSITSDEDLVNLIEEYDLVSSSSPMKIRVFLNPPKSAAGSKKSPPPLALPSSTTTSSSSTTSSTSSSPRSPSLSKPPLPPSPPRITTVTKNPCYGCYVHRNSRNIYLVHNGNHWQ

SEQ ID NO: 427 - protein, 890 aa, Xenorhabdus nematophilus
MASSMLSSATMVASPAQATMVAPFNGLKSSAAFPATRKANNDITSITSNGGRVNCMQVWPPIGKKKFETLSYLPDLTDSGGRVNCMQAMEQPKLDKAVFQAALTRQWQRFGLSSAQEMTPHQWWQAISAALLELLPSSSQNHAHQFHNPKRHVNYISMEFLIGRLTANNLLNLGWYDDVQAYLAEDGLTLSDLLEQEADPALGNGGLGRLAACFLDSMATIDQPATGYGLNYQYGLFRQSFDQGLQIEAPDDWKRGSYPWFRHNAQLKVDVGLGGKIVMTAEGHETWLPAFTLIGEAWDLPVIGYGNGVTQPLRLWQATHDNPFDLSLFNDGQFLNAEQQGIEATSLTKVLYPNDNHQAGKRLRLMQQYFQCACAMADILRRHQQAGRKVEELPRYEVIQLNDTHPTIAIPEMMRLLLDEYQLDWETAWEITGQTFAYTNHTLLPEGLERWDEHLVSELLPRHHRIIQEINRRFQKTVEQTWPGNQQVWEKLAVIHENQVRMANLCVVACFAVNGVAALHSSLIVTDLFPEYYHLWPEKFHNVTNGVTPRRWLKQCNPALSSLIDQTLNHEWVNDLESLKQLEPYANDAAFCEAYRSIKQENKIRLSNYVNKVMGLKIDPHAIFDVQIKRLHEYKRQHLNLLHILSLYRQIQENPSLDIHPRVFLFGAKAAPGYYLAKNIILAINHAAEKINHDPIVRDRIKIAFIPDYNVSTAELMIPAADVSEQISTAGKEASGTGNMKLALNGALTIGTLDGANVEIAEQVGNDNIFIFGNNVEEAKALLKSGYNPREILQQNPHLQGILDALASGEFSHGDTQAFDLMLHSLVDGGDPYLVLADFDSYCHAHTQIDTLYRNPQHWTHRTILNTARMGKFSSDRAIQDYQQRIWQAK

SEQ ID NO: 428 - protein, 586 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMKKISTNDSKLNPRLVAFLNGGPKKLFINGEWVDSFSGQSFETMNPATGETLALVAEAGSEDIDFAVKAARKAFDEGPWSKMSAAERSRLIYKLADLIEDHKEALAQLETLDNGKPIRETANADIPLVIEHFRYFAGWATKIVGQTIPVQGHYFNYTRHEAIGVVGQIIPWNFPLLMAAWKLGAALATGCTVVLKPAEQTPLSALYLGELINEAGFPKGVVNIVPGFGHSAGTPLVNHPAVDKVAFTGSTDVGKLIMKQASESLKRVTLELGGKSPNIILPDADLSKAVPGSLMGIMFNQGQVCCAGSRLYVQKKQYDHVVADLVSLTNEIQQGDGLLEQTTMGPLISNQQQSRVKNYIDRGVEEGAELLTGGNIPYDQGYFVAPTIFADVDHSMTIAKEEIFGPVVAAMPFDSIDDLIDKANDSDYGLAAGVWTQDIKKAHYIAHRIKAGTIWVNCYNVFDAASPFGGYKQSGIGREMGSYALENYTEVKSVWVNMD

SEQ ID NO: 429 - protein, 574 aa, Rhodobacter sphaeroides
MASSMLSSATMVASPAQATMVAPFNGLKSSAAFPATRKANNDITSITSNGGRVNCMQVWPPIGKKKFETLSYLPDLTDSGGRVNCMQAMDTKTTEIKGKERYKAGVLKYAQMGYWDGDYVPKDTDVLALFRITPQEGVDPVEAAAAVAGESSTATWTVVWTDRLTACDSYRAKAYRVEPVPGTPGQYFCYVAYDLILFEEGSIANLTASIIGNVFSFKPLKAARLEDMRFPVAYVKTYKGPPTGIVGERERLDKFGKPLLGATTKPKLGLSGKNYGRVVYEGLKGGLDFMKDDENINSQPFMHWRDRFLYVMEAVNLASAQTGEVKGHYLNITAGTMEEMYRRAEFAKSLGSVIVMVDLIIGYTAIQSISEWCRQNDMILHMHRAGHGTYTRQKNHGISFRVIAKWLRLAGVDHLHCGTAVGKLEGDPLTVQGYYNVCREPFNTVDLPRGIFFEQDWADLRKVMPVASGGIHAGQMHQLLSLFGDDVVLQFGGGTIGHPMGIQAGATANRVALEAMVLARNEGRNIDVEGPEILRAAAKWCKPLEAALDTWGNITFNYTSTDTSDFVPTASVAM

SEQ ID NO: 430 - protein, 210 aa, Arabidopsis thaliana
MTLSRVHQQVIAFPAVNTAPVGYLPDPASINKLQIPTSSKVSMLQKKKTDSFTNGARDQDKLGPKLTETVKRKLSLGAKILQMGGLEKIYKRLFKVCDKEKLFKAYQCYLSTTEGSIAGLLFISSKKIAFCSERSIKVTSPQGDLTRVHYKVSIPLCKINGVNQSQNTKKPSQRYLEVVTVDNYDFWFMGFVSYQKAFNCLEKALNEDEQ

SEQ ID NO: 431 - protein, 159 aa, Arabidopsis thaliana
MGSEEEKVVVPRNFRLLEELERGEKGIGDGTVSYGMDDADDILMQSWTGTILGPHNTAYEGKIFQLKLFCGKDYPESPPTVRFQSRINMACVNPENGVVDPSHFPMLSNWRREFTMEDLLIQLKKEMMSSQNRKLAQPLEGNEEGRTDPKGLVVKCCVM

SEQ ID NO: 432 - protein, 504 aa, Arabidopsis thaliana
MVSLLSFFLLLLVPIFFLLIFTKKIKESKQNLPPGPAKLPIIGNLHQLQGLLHKCLHDLSKKHGPVMHLRLGFAPMVVISSSEAAEEALKTHDLECCSRPITMASRVFSRNGKDIGFGVYGDEWRELRKLSVREFFSVKKVQSFKYIREEENDLMIKKLKELASKQSPVDLSKILFGLTASIIFRTAFGQSFFDNKHVDQESIKELMFESLSNMTFRFSDFFPTAGLKWFIGFVSGQHKRLYNVFNRVDTFFNHIVDDHHSKKATQDRPDMVDAILDMIDNEQQYASFKLTVDHLKGVLSNIYHAGIDTSAITLIWAMAELVRNPRVMKKAQDEIRTCIGIKQEGRIMEEDLDKLQYLKLVVKETLRLHPAAPLLLPRETMADIKIQGYDIPQKRALLVNAWSIGRDPESWKNPEEFNPERFIDCPVDYKGHSFELLPFGSGRRICPGIAMAIATIELGLLNLLYFFDWNMPEKKKDMDMEEAGDLTVDKKVPLELLPVIRISL

SEQ ID NO: 433 - protein, 183 aa, Arabidopsis thaliana
MAGEGEEDVPRDAKIVKSLLKSMGVEDYEPRVIHQFLELWYRYVVEVLTDAQVYSEHASKPNIDCDDVKLAIQSKVNFSFSQPPPREVLLELAASRNKIPLPKSIAGPGVPLPPEQDTLLSPNYQLVIPKKSVSTEPEETEDDEEMTDPGQSSQEQQQQQQQTSDLPSQTPQRVSFPLSRRPK

SEQ ID NO: 434 - protein, 473 aa, Glycine max
MGSEQNRFPLHERRKRWGGCWGAFSCFNSQKGGKRIVPASRIPDSSGPASQPNGPQVIGLTNQATGLAPSLLAPPSSPASFTHSALPSTAQSPSCFLSLSANSPGGPSSTMYATGPYAHEMQLVSPPVFSNFTTEPSTAPLTPPPELAHLTTPSSPDVPFAHFLSSSVDLKNSDKGNYITANDLQATYSLYPGSPASSLISPISRNSGDCLSSSFPEREFRPQWDSSLSPENGKYQRTGSGRVSGHDTNGVTMASQDTNFFCPATYAQFYLDQNPPFPHNGGRLSVSKDSDVQSNGGNGHQSRHARSPKQDVEEIEAYRASFGFSADEIISTSQYVEISDVMEDSFTMMPFASDKSTMEESIEPSLMKGFKAQETQVALQSLRSLRSDPGPVGKEAHNQAPICPGCEDHTSQGHCSNNSGLSTPEKRTLVDDEDIFSKMESSRICRKYQMGLSCSDAEVDYRRGRSLREGKGM

SEQ ID NO: 435 - protein, 491 aa, Pseudomonas fluorescens PfO-1
MDKTSKFLPEELWSNCVFDGTWINISPDVSQVIEPATGASLGCIGMANAASVSAAARVANEVQADWFLTAYEERAAIMRKAAEIAELHFGDIVEWLVRESGSTQLKAAFETRVTIKALQESAMMPGKSQGDVLPNAPGSGRLSLARRRPLGVVGIISPFNFPLYLAMRSVAPALAVGNSVVLKPDPRTAVSGGLVIGRLFELAGLPKGVLHVLPGGGDAGAALVESPDVAMIQFTGSTAAGRKVGEAAGRNLKKVSLELGGKNSLIILDDANLDLAVANAIWGTFLHQGQICMATGRILVQRSLYPAFLKALTAKVGKLSVGDPATTKVSLGPLINAHQRDQVAKIVREAQQAGAKLEVGGRYEELFFQPTVLSDVKPDNPAFREEIFGPVAVVVPFNSDEEAIRLANDTEYGLAAGIISSNIGRAMKVGDKLRTGMLHINDQTVNDEVVNPFGGWGASGNGTSVGGAANWEEFTQWQWLTIKDEATPYAL

SEQ ID NO: 436 - protein, 273 aa, Glycine max
MSAVVAGSSSSFSATFTPIRSPSLKNSQLSHSKALTSPQCQKTSLQGLSLHEAKRGVSESFLVENNNGSSIAGRRLEITARTAGASKTIEVEVDKPLGLTLGQKSGGGVVITAVDGGGNAARAGLKAGDQVLYTSSFFGDELWPADKLGFTKTAIQAKPDSVYFVVSRGAEVDVKKLTKRPAPPRFGRKLTETQKARATHICLDCGYIYTLQKPFDEQPDTYGCPQCQAPKKRFARYDVNTGKAIGGGLPPIGVIIGLLAGVGAVGALLVYGL

SEQ ID NO: 437 - protein, 488 aa, Xenorhabdus nematophilus
MTTINHWINGKNVGSSTYFETVNPATGEVLAEVASGGKEEIDQAVAAAKDAFPKWANTPMKERARLMRRLGELIDQNVPEIAAMETSDTGLPIHQTKNVLIPRASHNFDFFAETCQQMNGRTYPVDDKMLNYTLIQPVGVCALISPWNVPFMTATWKVAPCLALGNTAVLKMSELSPLTANRLGELALEAGIPAGVLNVVQGYGNTAGDALVKHHDVRAVSFTGGTATGRLIMQNSGLKKYSMELGGKSPVLIFEDADIERALDAALFTIFSLNGERCTAGSRIFIQESIYPEFVKRFAERASRLRVGDPQDLNTQVGSLISHQHWEKVSGYIQLGIEEGATLLTGGPDKPADLPDHLKNGHFLRPTVLADVDNRMRVAQEEIFGPVACLLPFKSEEDGLRMANDVEYGLASYIWTQDVSKVLRLAQGIEAGMVFVNSQNVRDLRQPFGGVKASGVGREGGEYSFEVFAEVKNVCISMGNHPIPRWGL

SEQ ID NO: 438 - protein, 692 aa, Saccharomyces cerevisiae
MNGKEVSSGSGRTQSNNNKKNNNGGSTGISHASGSPLTDGNGGNSNGNSRSRSRSRKSSGTTGGLLKKPPLLVNNEAVHASVPDASHTSCNNGTLEVSINNPEPHVVDAVARHLIRNPSNSLQLQGGDITRDLYKWTNDHPSSPSQYQYPSQPALSTSIPSQAPSFSNRKRSMSFSAASIASSSHLNNNSEANGNPLAAIGLAPAPMTHEEIRAPGGFRRSFIIQKRRKHNVDAPIPNFFTRNFIEFLTLYGHFAGEDLSEEEEEEEETEEEPEEEALETESTQLVSREHGRHPHKSSTVKAVLLLLKSFVGTGVLFLPKAFHNGGWGFSALCLLSCALISYGCFVSLITTKDKVGVDGYGDMGRILYGPKMKFAILSSIALSQIGFSAAYTVFTATNLQVFSENFFHLKPGSISLATYIFAQVLIFVPLSLTRNIAKLSGTALIADLFILLGLVYVYVYSIYYIAVNGVASDTMLMFNKADWSLFIGTAIFTFEGIGLLIPIQESMKHPKHFRPSLSAVMCIVAVIFISCGLLCYAAFGSDVKTVVLLNFPQDTSYTLTVQLLYALAILLSTPLQLFPAIRILENWTFPSNASGKYNPKVKWLKNYFRCAIVVLTSILAWVGANDLDKFVSLVGSFACIPLIYIYPPLLHYKASILSGTSRARLLLDLIVIVFGVAVMAYTSWQTIKMWSQ

SEQ ID NO: 439 - protein, 492 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKCVIKKENNFKQAGDRYRSWAPDRQDRFVKRWVEILSEPRLTHEIRGIWISYWSQADRSLGQKLASRLNVRPSI

SEQ ID NO: 440 - protein, 372 aa, Arabidopsis thaliana
MAEQETTSNINTINDQAEEETRTKSQPLISGLPNDIAELCLLRLPYPYHALYRSVSSSWNKTITNPRFLFSKQSLSISSPYLFVFAFNKSTARIQWQSLDLASGRWFVLPPMPNSFTKISSPHALSCASMPRQGKLFVLGGGDVNRSAVVYTALTNRWSCISPMMSPRTYFVSGNVNGKIMAVGGSVGGNGEATTEVESYDPDNDTWTVVKKLPMVLAKYDSAVIGKEMCVTEGWAWPFMFPPMGQVYDSDEGTWREMSGGMKEGWTGVSVVIRDRLFVISEHGDFPMKVYCSDDDTWRYVSGEKLQGEKMRRPFAVTGADDRVFVVASGINVAEGRVSEGQNGDFSVEWRMVSSPKSSIQFSPASCHVLYV

SEQ ID NO: 441 - protein, 455 aa, Saccharomyces cerevisiae
MFDYVISRRQRTKQVLRYLEQQRSVKNVSNKVLNEEWALYLQREHEVLRKRRLKPKHKDFQILTQVGQGGYGQVYLAKKKDSDEICALKILNKKLLFKLNETNHVLTERDILTTTRSDWLVKLLYAFQDPESLYLAMEFVPGGDFRTLLINTRILKSGHARFYISEMFCAVNALHELGYTHRDLKPENFLIDATGHIKLTDFGLAAGTVSNERIESMKIRLEEVKNLEFPAFTERSIEDRRKIYHNMRKTEINYANSMVGSPDYMALEVLEGKKYDFTVDYWSLGCMLFESLVGYTPFSGSSTNETYENLRYWKKTLRRPRTEDRRAAFSDRTWDLITRLIADPINRVRSFEQVRKMSYFAEINFETLRTSSPPFIPQLDDETDAGYFDDFTNEEDMAKYADVFKRQNKLSAMVDDSAVDSKLVGFTFRHRDGKQGSSGILYNGSEHSDPFSTFY

SEQ ID NO: 442 - protein, 492 aa, Agrobacterium tumefaciens str. C58
MKGIASAALKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 443 - protein, 141 aa, Arabidopsis thaliana
MMINAKKLMKLAKKWQQRAALKRKRISFQRSSITTSSQTAVEKGCFVVYTADKIRFSFPLSYLSNTIVQELLKISEEEFGLPTEGPITLPFDSAFLEYLINLIQRRMDEDTEKALLLSISSARSSFQPQQHCSATQQLLVF

SEQ ID NO: 444 - protein, 573 aa, Saccharomyces cerevisiae
MPIRSISSASQMNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEDNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAECLGVPWEPVDLEGYAKTWYIASAN

SEQ ID NO: 445 - protein, 469 aa, Arabidopsis thaliana
MAATTENLPQLKSAVDGLTEMSESEKSGFISLVSRYLSGEAQHIEWSKIQTPTDEIVVPYEKMTPVSQDVAETKNLLDKLVVLKLNGGLGTTMGCTGPKSVIEVRDGLTFLDLIVIQIENLNNKYGCKVPLVLMNSFNTHDDTHKIVEKYTNSNVDIHTFNQSKYPRVVADEFVPWPSKGKTDKEGWYPPGHGDVFPALMNSGKLDTFLSQGKEYVFVANSDNLGAIVDLTILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKASSDLLLVQSDLYTLVDGFVTRNKARTNPSNPSIELGPEFKKVATFLSRFKSIPSIVELDSLKVSGDVWFGSSIVLKGKVTVAAKSGVKLEIPDRAVVENKNINGPEDL

SEQ ID NO: 446 - protein, 776 aa, Arabidopsis thaliana
MQPNSHIFVIITISSLIITVSAYGSTGTIAAAFGENGFFCAIDASGKQEVICWDRGNTNRSLNRPPGEISGYSPPMTSLSGGEGFLCAITSNTSRAFCWNLEDPSENLVPRAFQYNSYLQIASGNNHVCAISGLYYSGPDYGPVHCWEYSDNTNFTSGLLWNSSFHNPYIDSLMFRKIVSGDGFSCGVTKDGDLVCWGPKSNLLNFSNNEEFEVLASGRNSVCGVSKDSGQLHCFGDETEFGSLPNRPRFIALSAGANHYCGIREDDHGVECWGRNLNSSSSSSAPNTSGFVAISSSDSTTCGVRELDLVLDCWRVHDSSKADYSPPLELCSPGMCSPRGNCGDGWFAFNASILKESELTSLCSFHNLNICLRCGISCLEGYFPSSTCNPNADRVCTPCSLCQNSSCYGICKIRATKSKEHEQKEQREVRRLVIIIGCSVLGFLVMLIGLSFIPKMTKGSKRDDEERSKMTCCFCFDKNSVEADPDPVPHQSVLLPTAVSLGETKIFRLSELKDATHGFKEFNELGRGSFGFVYKAVLSDGIHVAVKRANAATIIHSNNRGFESELEILCKIRHNNIVNLLGYCSEMGERLLVYEYMPHGTLHDHLHGDLSQLDWSMRLKIMLQAARGLDYLHNEVDPPIIHRDVKTSNILLDGEMCARIADFGLVSSNERDSSNSDREGDVYDFGIVLLEILSGRKAIDRESDPAGIAEWAVPLIRKGKAAAIIDRNICLPRNVEPLLKLAELAELAVRENSNERPNIRNILCFLDLIVKSGLTF

SEQ ID NO: 447 - protein, 335 aa, Rhodopseudomonas palustris
MAVRVAINGFGRIGRNVLRAIYESGRKDIEVVAINDLGPVETNAHLLRFDSVHGRFPFEVKVDGDTIDAGRGKIKVTAIKDPSALPYKEVGVDIALECTGIFTARDKAATLLTAGAKRVLVSAPSDGADATIVYGVNHETLSKDHMVVSNGSCTTNCLAPVAKVLNDTVGIETGFMTTIHAYTGDQPTLDTMHKDLYRGRAAAMSMIPTSTGAAKAIGLVLPELKGKLDGVAIRVPTPNVSVVDLKIIAKKATTKEEINEAIKRAAEQELKGILGYTNAPNVSIDFNHDPHSSTFHMDQTKVQNGTLVRVMSWYDNEWGFSNRMADTAVAIGKLI

SEQ ID NO: 448 - protein, 351 aa, Arabidopsis thaliana
MVLLPAFLDGLARTVSTKKGKKLSEDEDGGREIAKSMIKDSKKNSTLLGTSGFVSSESSKRFTSICSNRGEKGINQDRAIVWEGFGCQEDITFCGMFDGHGPWGHVIAKRVKKSFPSSLLCQWQQTLASLSSSPECSSPFDLWKQACLKTFSIIDLDLKISPSIDSYCSGCTALTAVLQGDHLVIANAGDSRAVIATTSDDGNGLVPVQLSVDFKPNIPEEAERIKQSDGRLFCLDDEPGVYRVGMPNGGSLGLAVSRAFGDYCLKDFGLVSEPEVTYRKITDKDQFLILATDGMWDVMTNNEAVEIVRGVKERRKSAKRLVERAVTLWRRKRRSIAMDDISVLCLFFRPS

SEQ ID NO: 449 - protein, 570 aa, Saccharomyces cerevisiae
MNSTPDLISPQKSNSSNSYELESGRSKAMNTPEGKNESFHDNLSESQVQPAVAPPNTGKGVYVTVSICCVMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEASVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQDQPSSKGAGNCMIVFACFYIFCFATTWAPIAYVVISECFPLRVKSKCMSIASAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 450 - protein, 538 aa, Agrobacterium tumefaciens
MASSMLSSATMVASPAQATMVAPFNGLKSSAAFPATRKANNDITSITSNGGRVNCMQVWPPIGKKKFETLSYLPDLTDSGGRVNCMQAMNTSQDITVAAGGLDATAAIQQAIDAVSSAGGGRVSLSAGRHVSAGLHLKSGVELHLAEDAVLAPVSDYDAYALTRVSVIAEDSDRGMIIANGASNIAVTGPGRIEAGGENFIIGDDAAMGTYVPAKKRPRVMVLEACRNVRLENLNVSASPMWTLHMVNCEDLHFRNLRIENDRRLPNTDGIVLDACRRALIEDCFISTADDGICLKTSAGPDGKAVGVCADITVRGCTVSSMSCALKLGTESFGDFTNVVFEDCKVVQSNRGIGLFSRDGGAMRNIRFSRIETECHETPGGFWGSGEAVTVTVVDRRPERQAGRVENLVVEDLGGSMEGAINLVSTSKAGIHNVRLERITLAQQPGKLGTGLQYDLRPTNADIAPSAEAAGRANAWTQDAEGRIVGMEDYPGGMPAIYLSGVHRFSADNVAIKRAMPLPEGWNIKEIVATTGSDEGSM

SEQ ID NO: 451 - protein, 420 aa, Agrobacterium tumefaciens
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEALRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 452 - protein, 359 aa, Arabidopsis thaliana
MDWNFKLSSGYLSGFDQEPDLSPMDGSISFGGSSQSKADFSFDLKLGRNIGNSSSVFGDTEQVISLSKWKDSALAKPEGSRSSSSKRTRGNGVGTNQMPICLVDGCDSDFSNCREYHKRHKVCDVHSKTPVVTINGHKQRFCQQCSRFHALEEFDEGKRSCRKRLDGHNRRRRKPQPEHIGRPANFFTGFQGSKLLEFSGGSHVFPTTSVLNPSWGNSLVSVAVAANGSSYGQSQSYVVGSSPAKTGIMFPISSSPNSTRSIAKQFPFLQEEESSRTASLCERMTSCIHDSDCALSLLSSSSSSVPHLLQPPLSLSQEAVETVFYGSGLFENASAVSDGSVISGNEAVRLPQTFPFHWE

SEQ ID NO: 453 - protein, 331 aa, Arabidopsis thaliana
MGLYSLITGRRGPSGFGSASTAEEVTQGIDATNLTAIITGGTGGIGMETARVLSKRGAHVVIGARNMGAAENAKTEILRQNANARVTLLQLDLSSIKSIKAFVREFHALHLPLNLLINNAGVMFCPYQLSEDGIELQFATNHIGHFLLTNLLLDTMKNTAKTSGVEGRILNVSSVAHIYTYQEGIQFDSINDICSYSDKRAYGQSKLANILHANELSRQLQEEGVNITANSVHPGLILTNLFQHTALLMRFLKFFSFYLWKNIPQGAATTCYVALHPSVKGVTGKYFADCNEVTPSKLARDETLAQKLWDFSVKLINSVSKKNYLGFDDTT

SEQ ID NO: 454 - protein, 587 aa, Glycine max
MGVLQEKLSSFYKSRWLVFVAAMWLQSWAGIGYLFGSISPVIKSSLGYNQKQLAMLGVAKDLGDAVGFMTGLLCEILPIWGALLVGAALNLVGYGWVWLVVTSQVPVLPLWAMCALIFVGTNGETYFNTVSLVSCVQNFPKSRGPVVGILKGFAGLSGAILTQIYALFHAPNQASLIFMVAVGPSLVGIGLMFIVRPVGGHKQVRPSDGKCFTLIYGVCLLLAAYLLGVMVVQDLVEVSETVISIFTGVLLLILLVPIVIPITLSFGPEQRHPEVEALLPPPQNKEAGKSQLDSDEVILSELEDEKPKEVDMLPASERQKRIAHLQQRLLQAAAEGAVRVKRRRGPHRGEDFTLTQALIKADFWLLFISMIMGSGSGLTVIDNLGQMSQSLGYDNAHIFVSMISIWNFLGRVGGGYISELVVRDHAYPRPVALAVFQLIMTLGHVFLGMGWPGSMYVGTLLVGLGYGAHWAIVPATASELFGLRNFGALYNFITIANPAGTLVFSSLIASTIYDAEAEKQHRQNMMLRVLNASEPLKCEGSVCFFLTSMIMAGLCVVGAGLCMVLVLRTRIVYANLYGKASSSRLRL

SEQ ID NO: 455 - protein, 516 aa, Arabidopsis thaliana
MSSSSYNTSVIPSSSSSAQPFFITSSGTGDNDFNRKDTFMSMIQQPNSSAPPPKKRRNQPGNPNPDAEVVALSPKTLMATNRFICDVCNKGFQREQNLQLHRRGHNLPWKLKQKSTKEVKRKVYLCPEPTCVHHDPSRALGDLTGIKKHYYRKHGEKKWKCEKCSKRYAVQSDWKAHSKTCGTKEYRCDCGTIFSRRDSYITHRAFCDALIQETARNPTVSFTSMTAASSGVGSGGIYGRLGGGSALSHHHLSDHPNFGFNPLVGYNLNIASSDNRRDFIPQSSNPNFLIQSASSQGMLNTTPNNNNQSFMNQHGLIQFDPVDNINLKSSGTNNSFFNLGFFQENTKNSETSLPSLYSTDVLVHHREENLNAGSNVSATALLQKATQMGSVTSNDPSALFRGLASSSNSSSVIANHFGGGRIMENDNNGNLQGLMNSLAAVNGGGGSGGSIFDVQFGDNGNMSGSDKLTLDFLGVGGMVRNVNRGGGGGGRGSARGGVSLDGEAKFPEQNYPFGRG

SEQ ID NO: 456 - protein, 360 aa, Arabidopsis thaliana
MSKFLPEELAIEILVRLSMKDLARFRCVCKTWRDLINDPGFTETYRDMSPAKFVSFYDKNFYMLDVEGKHPVITNKLDFPLDQSMIDESTCVLHCDGTLCVTLKNHTLMVWNPFSKQFKIVPNPGIYQDSNILGFGYDPVHDDYKVVTFIDRLDVSTAHVFEFRTGSWGESLRISYPDWHYRDRRGTFLDQYLYWIAYRSSADRFILCFNLSTHEYRKLPLPVYNQGVTSSWLGVTSQKLCITEYEMCKKEIRISVMEKTGSWSKIISLSMSSFISVQDRIYDYQVEFVSFTRKNDLVVTFTGYNDHFEMEPEERTKKKMFLYKTGNERSEEVRFCNPLAGLRFLCECVETLKIVNRIFI

SEQ ID NO: 457 - protein, 284 aa, Arabidopsis thaliana
MNNNHSYDDRSFHIPLHPSNTSNPNPNLQFALSSSYDHSPKKKRTKTVASSSSSSPKSASKPKYTKKPDPNAPKITRPCTECGRKFWSWKALFGHMRCHPERQWRGINPPPNYRVPTAASSKQLNQILPNWVSFMSEEDHEVASCLLMLSNGTPSSSSIERFECGGCKKVFGSHQALGGHRASHKNVKGCFAITNVTDDPMTVSTSSGHDHQGKILTFSGHHKCNICFRVFSSGQALGGHMRCHWEKEEEPMISGALDLNVPPTIQDLSTSDTSGCCLDLRLGL

SEQ ID NO: 458 - protein, 247 aa, Arabidopsis thaliana
  unsure (1)..(247): unsure at all Xaa locations
MPVHDEQEHEVYGGEIPEEEEGEMDTEEYEEHGGEEGAAAGDEELEPGSSSRDLEDMKKRIKEIEEEAGALREMQAKAEKDMGASQDPSGGVSAAEKEEVDSRSIYVGNVDYACTPEEVQQHFQSCGTVNRVTILTDKFGQPKGFAYVEFVEVEAVQNSLILNESELHGRQIKVSAKRTNVPGMRQFRGRGRPFRPMRGFMPGVPFYPPYAYGXSSQVQTAYALQTVLIRQIGVKKVAAASPFSGGA

SEQ ID NO: 459 - protein, 650 aa, Arabidopsis thaliana
MLRKSVLELSSRLSIKRFPRNLGAQRFHLSSSRNASTSGKNGLPGAKPVGKPDASKVDPPKVTPPPPTKGNSSKVVIGGVAIAGAFLVAYQTGYLDQYLGKEQQKLSERIHSDALTEKLEEAHHLNVPSGVEDSTEKDGKVETQPQVTHSEASEGVQSDIELQPESDLSSDRFTYISSNQEETPQETVIDRAEINLPISASEDSGAKPDMPSEIISEAESVKLEAVPKPGDSPIIVNAQSSSVHRESETESASPKDPAALKTPEDGIEREVQLPGSLLKEYNLEGSDTESTGSSSIGEQITKETEAFPNSTEGLKDSYMTEDGKLVLDFLAAIHAAEKQQAHLDAQVFAEELRALKEKYENELRDLRARELMRIEEAAILDKELKRERTKAAAAIKAIQERMEDKLKAELEQKETEAQLALSKAEELAKAEMISTIAKEKAAQIEKMAEADLNIKALSMAFYARSEEARQSHSVHKLALGALALDDTLSKGLPVQKEIDTLQTYLEGTHKDSILGLVLSSLPEEARSNGTDTVLQLNQKFDTLKGTLRHFSLIPPGGGGILAHSLAHVASSLKFKEVDQANGGIESVIKKVDNYLAEGKLAEAAATLEEGVKGSKAEEIVSDWVRRARNRAITEQALTLLQSYATCVSLT

SEQ ID NO: 460 - protein, 368 aa, Arabidopsis thaliana
MARRSVSIFNRLLANPPSPFTSLSRSITYMPRPGDGAPRTVTLIPGDGIGPLVTGAVEQVMEAMHAPVHFERYEVLGNMRKVPEEVIESVKRNKVCLKGGLATPVGGGVSSLNMQLRKELDIFASLVNCINVPGLVTRHENVDIVVIRENTEGEYSGLEHEVVPGVVESLKVITKFCSERIARYAFEYAYLNNRKKVTAVHKANIMKLADGLFLESCREVAKHYSGITYNEIIVDNCCMQLVAKPEQFDVMVTPNLYGNLIANTAAGIAGGTGVMPGGNVGAEHAIFEQGASAGNVGNDKMVEQKKANPVALLLSSAMMLRHLRFPTFADRLETAVKQVIKEGKYRTKDLGGDCTTQEVVDAVIAALE

SEQ ID NO: 461 - protein, 247 aa, Arabidopsis thaliana
MYKWNLPYRKDDVETGREGGERSLYPTMLESPELRWGFIRKVYSIIAFQLLATIAVASTVVFVRPIAVFFATTSAGLALWIVLIITPLIVMCPLYYYHQKHPVNYLLLGIFTVALAFAVGLTCAFTSGKVILEAAILTTVVVLSLTVYTFWAAKKGYDFNFLGPFLFGALIVLMVFALIQIFFPLGRISVMIYGCLAAIIFCGYIVYDTDNLIKRYSYDEYIWAAVSLYLDIINLFLALLTIFRAAE

SEQ ID NO: 462 - protein, 443 aa, Arabidopsis thaliana
MGQGPSGGLNRQGDRKPDGGEKKENKFEPAAPPARVGRKQRKQKGPEAAARLPTVTPSTKCKLRLLKLERIKDYLLMEEEFVANQERLKPQEEKAEEDRSKVDDLRGTPMSVGNLEELIDENHAIVSSSVGPEYYVGILSFVDKDQLEPGCSILMHNKVLSVVGILQDEVDPMVSVMKVEKAPLESYADIGGLEAQIQEIKEAVELPLTHPELYEDIGIKPPKGVILYGEPGTGKTLLAKAVANSTSATFLRVVGSELIQKYLGDGPKLVRELFRVADDLSPSIVFIDEIDAVGTKRYDANSGGEREIQRTMLELLNQLDGFDSRGDVKVILATNRIESLDPALLRPGRIDRKIEFPLPDIKTRRRIFQIHTSKMTLAEDVNLEEFVMTKDEFSGADIKAICTEAGLLALRERRMKVTHVDFKKAKEKVMFKKKEGVPEGLYM

SEQ ID NO: 463 - protein, 611 aa, Arabidopsis thaliana
MEKEGVCDTINLSDQMYPDEPFCSEMKTETIASSQKFEGGEGSKVVFSREAPLIGKDSAGTNSGECCGCSAKKLNFKGDDDLVEKENIEQQKKLNRQERIELGRLFQGAVTSLDWELAERLIQLADPQTLNDLLCVGLDSVWFLSTKPEFQGITGLIKKIICHGAHDFTRATLRTSFLASCVSACQSRTMSLSDTVTVMAQRLHERLQECNGDEILKAEAGAKVQKFTEWALKCIGFHSRCQGAKDRVSQNSAAEIELQLSAFKMFLDLAGNHLSGRDFTEAFDAACFPLTLFSNSFDPGWASGMSATVIQGLLGMLVEGGADNVNQCFLEASRFGSTELVRVLLQIAQRNSLDVDVDLALGFASHYCKIGTMKCLVEEGNAIAFLGPLMRAAERGCMQVVQWFVKRGCRDMELCLALTAATSSCQVEVAAYLLPRVPPPVLTALSIEILKAAGERSGGSLQGVEFLLKSDFLGDSTATYSVADSIARSSEDESVPSDLKSFLQEHWSESAFEKGMRESHDDFMNFMRVLKKGESAISLRDLPAPLRVAIAYMPLYRECMKADGRLLSQRLRGQLVEAVRQLQGCAVAVVEVSQTRNLMAVLEHHLTAIFD

SEQ ID NO: 464 - protein, 407 aa, Arabidopsis thaliana
MASLPLGPQPHALAPPLQLHDGDALKRRPELDSDKEMSAAVIEGNDAVTGHIISTTIGGKNGEPKQTISYMAERVVGTGSFGIVFQAKCLETGESVAIKKVLQDRRYKNRELQLMRPMDHPNVISLKHCFFSTTSRDELFLNLVMEYVPETLYRVLRHYTSSNQRMPIFYVKLYTYQIFRGLAYIHTVPGVCHRDVKPQNLLVDPLTHQVKLCDFGSAKVLVKGEPNISYICSRYYRAPELIFGATEYTASIDIWSAGCVLAELLLGQPLFPGENSVDQLVEIIKVLGTPTREEIRCMNPNYTDFRFPQIKAHPWHKVFHKRMPPEAIDLASRLLQYSPSLRCTALEACAHPFFNELREPNARLPNGRPLPPLFNFKQELGGASMELINRLIPEHVRRQMSTGLQNS

SEQ ID NO: 465 - protein, 127 aa, Arabidopsis thaliana
MTNIGKCMQGYLDEQFMELEELQDDANPNFVEEVSALYFKDSARLINNIDQALERGSFDFNRLDSYMHQFKGSSTSIGASKVKAECTTFREYCRAGNAEGCLRTFQQLKKEHSTLRKKLEHYFQASQ

SEQ ID NO: 466 - protein, 394 aa, Arabidopsis thaliana
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSQALITSIDTAEKKKNPYDDAQGTEIGEHKLGQETIKKKRAGFFHRMIQKFVKKIHLCSSISRT

SEQ ID NO: 467 - protein, 272 aa, Arabidopsis thaliana
MANASPLSPTNQHFFQPLLPGFQSNLKIPVNYFSEHIEGKHEGKTVTLRTDASERTWEVKMEGHRLTEGWKEFVEAHDLRIGDFVVFRHEGDMVFHVTALGPSCCEIQYPQSSRHEEGEESGENEISEKEGEENVQKESDKSSSDLNCFSQSVTHSNISRDAVSVPRDFVKRSGFSKGRHEIVLMNEEGKSWESEVKSYMSGAVYLVGGWTTFCTENKLDVGDSCTFKLLQKAKTPVFQLCSRTKVESMNITGESKFVKLTPTPSSLALGKR

SEQ ID NO: 468 - protein, 267 aa, Arabidopsis thaliana
MEASPNDRLHFGKMGFGCKHYKRRCQIRAPCCNEVFDCRHCHNESTSTLRNIYDRHDLVRQDVKQVICSVCDTEQPAAQVCSNCGVNMGEYFCSICIFYDDDTEKQQFHCDDCGICRVGGRENFFHCKKCGSCYAVGLRNNHRCVENSMRHHCPICYEYLFDSLKDTNVMKCGHTMHVECYNEMIKRDKFCCPICSRSVIDMSKTWQRLDEEIEATAMPSDYRDKKVWILCNDCNDTTEVHFHIIGQKCGHCRSYNTRAIAPPVLPQ

SEQ ID NO: 469 - protein, 273 aa, Arabidopsis thaliana
MAATTLYNSCLLQPKYGFTTRRLNQSLVNSLTNPTRVSVLWKSRRDVIAKASIEMAESNSISSVVVNSSGPIIVIDNYDSFTYNLCQYMGELGCHFEVYRNDELTVEELKRKKPRGLLISPGPGTPQDSGISLQTVLELGPLVPLFGVCMGLQCIGEAFGGKIVRSPFGVMHGKSSMVHYDEKGEEGLFSGLSNPFLVGRYHSLVIEKDSFPSDELEVTAWTEDGLVMAARHRKYKHIQGVQFHPESIITTEGKTIVRNFIKLVEKKESEKLA

SEQ ID NO: 470 - protein, 206 aa, Saccharomyces cerevisiae
MPSHRNSNLKFCTVCASNNNRSMESHKVLQEAGYNVSSYGTGSAVRLPGLSIDKPNVYSFGTPYNDIYNDLLSQSADRYKSNGLLQMLDRNRRLKKAPEKWQESTKVFDFVFTCEERCFDAVCEDLMNRGGKLNKIVHVINVDIKDDDENAKIGSKAILELADMLNDKIEQCEKDDIPFEDCIMDILTEWQSSHSQLPSLYAPSYY

SEQ ID NO: 471 - protein, 384 aa, Arabidopsis thaliana
LIKVVGWAFGHHLMICTEPIVKDNKLVISAESISYGLQTLHDIQNENKSLKKSLKDVVTENEFEKKLLSDVIPPSDIGVSFDDIGALENVKETLKELVMLPLQRPELFDKGQLTKPTKGILLFGPPGTGKTMLAKAVATEAGANFINISMSSITSKWFGEGEKYVKAVFSLASKIAPSVIFVDEVDSMLGRRENPGEHEAMRKMKNEFMVNWDGLRTKDRERVLVLAATNRPFDLDEAVIRRLPRRLMVNLPDATNRSKILSVILAKEEIAPDVDLEAIANMTDGYSGSDLKNLCVTAAHFPIREILEKEKKEKTAAQAENRPTPPLYSCTDVRSLTMNDFKAAHDQVCASVSSDSSNMNELQQWNELYGEGGSRKKTSLSYFM

SEQ ID NO: 472 - protein, 587 aa, Saccharomyces cerevisiae
MDILKRGNESDKFTKIETESTTIPNDSDRSGSLIRRMKDSFKQSNLHVIPEDLENSEQTEQEKIQWKLASQPYQKVLSQRHLTMIAIGGTLGTGLFIGLGYSLASGPAALLIGFLLVGTSMFCVVQSAAELSCQFPVSGSYATHVSRFIDESVGFTVATNYALAWLISFPSELIGCALTISYWNQTVNPAVWVAIFYVFIMVLNLFGVRGFAETEFALSIIKVIAIFIFIIIGIVLIAGGGPNSTGYIGAKYWHDPGAFAKPVFKNLCNTFVSAAFSFGGSELVLLTSTESKNISAISRAAKGTFWRIAIFYITTVVIIGCLVPYNDPRLLSGSNSEDVSASPFVIALSNTGSMGAKVSNFMNVVILVAVVSVCNSCVYASSRLIQALGASGQLPSVCSYMDRKGRPLVGIGISGAFGLLGFLVASKKEDEVFTWLFALCSISSFFTWFCICMSQIRFRMALKAQGRSNDEIAYKSILGVYGGILGCVLNALLIAGEIYVSAAPVGSPSSAEAFFEYCLSIPIMIVVYFAHRFYRRDWKHFYIKRSEIDLDTGCSVENLELFKAQKEAEEQLIASKPFYYKIYRFWC

SEQ ID NO: 473 - protein, 417 aa, Saccharomyces cerevisiae
MAGDNPENKDASMLDVSDAASNTTINGKHSADSTNEASLAYTFSQMNVDNPNELEPQHPLRHKSSLIFNDDDDDEIPPYSNHAENGSGETFDSDDDIDASSSSSIDSNEGDIHDADMTGNTLQKMDYQPSQQPDSLQNQGFQQQQEQQQGTVEGKKGRAMMFPVDITWQQGGNKVYVTGSFTGWRKMIGLVPVPGQPGLMHVKLQLPPGTHRFRFIVDNELRFSDYLPTATDQMGNFVNYMEVSAPPDWGNEPQQHLAEKKANHVDDSKLSKRPMSARSRIALEIEKEPDDMGDGYTRFHDETPAKPNLEYTQDIPAVFTDPNVMEQYYLTLDQQQNNHQNMAWLTPPQLPPHLENVILNSYSNAQTDNTSGALPIPNHVILNHLATSSIKHNTLCVASIVRYKQKYVTQILYTPLQ

SEQ ID NO: 474 - protein, 347 aa, Synechocystis sp. PCC 6803
MAVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 475 - protein, 493 aa, Pseudomonas fluorescens PfO-1
MTLARFQMCIGGEWVDALSGKTFESLNPALAEPWAELPDADEADVERAVQAAQTAFDSPAWRGLTATARGKLLRRLGDLIAENKEQLAQLESRDNGKLIRETRGQVGYLPEFFHYTAGLADKLEGGTLPLDKPDLFAYTVHEAMGVVAAIIPWNSPLYLTAIKLAPALAAGNTIVIKPSEHASATILELARLALEAGIPPGVVNVVTGYGPSTGAALTRHPLVRKIAFTGGAATARHVVRSSAENFAKLSLELGGKSPNIIFADADLDSAINGAIAGIYAASGQSCVSGSRLLVQDDIYDEFVSRLVERAQRIRIGNPQDDSSEMGPMATAQQLAVVEGLVADAIAEGARLRLGGKRPSGVGDGWFYEPTLFECDRNSMKIMQEEVFGPVASVIRFKDEAEALAIANDSQFGLAAGIWTRDLGRAHRLARDVRSGIIWVNTYRAVSAMAPIGGFKNSGYGRESGIDSVLAYTELKTVWINLSQAPMPDPFVMR

SEQ ID NO: 476 - protein, 436 aa, Sinorhizobium meliloti
MASSMLSSATMVASPAQATMVAPFNGLKSSAAFPATRKANNDITSITSNGGRVNCMQVWPPIGKKKFETLSYLPDLTDSGGRVNCMQAMTPRKSASVSSRKTAAKPAKKDFAGGTIAEFSKEDDLKAYREMLLIRRFEEKAGQLYGMGFIGGFCHLYIGQEAVVVGMQLALKEGDQVITGYRDHGHMLACGMSARGVMAELTGRRGGLSKGKGGSMHMFSKEKHFYGGHGIVGAQVSLGTGLAFANRYRGNDNVSLAYFGDGAANQGQVYESFNMAALWKLPVIYIVENNRYAMGTSVSRASAQTDFSQRGASFGIPGYQVDGMDVRAVKAAADEAVEHCRSGKGPIILEMLTYRYRGHSMSDPAKYRSKDEVQKMRSEHDPIEQVKARLTDKGWATEDELKQIDKEVRDIVADSADFAQSDPEPDVSELYTDILL

SEQ ID NO: 477 - protein, 586 aa, Xenorhabdus nematophilus
MASSMLSSATMVASPAQATMVAPFNGLKSSAAFPATRKANNDITSITSNGGRVNCMQVWPPIGKKKFETLSYLPDLTDSGGRVNCMQAMVSEITLLKPVTDFLQRPHGHYINGLSIPGQGNNTFSVVNPASDEVIAKVNRGEEAEINLAMEAASKAFHGSWAQTSPMERGKCLNRLADLLQKHGEELAQLESLCSGKPIQLARMLDVGASADYLRYFAGWSSKISGETLNVSLPSLKGEKYTAFTRREPIGVVVGIIPWNFSIMIAIWKLGAALACGCTLVLKPSEYTPLTMLRVAELAKEAGIPDGVINVVNGSGARVGSALLAHPKCAKVTFTGSVPTGTIIGKSAIEYGLTRATLELGGKNAAAFLSDMSVEKIVEGVLEAGYLNQGQICAAAERFYIPSVHMDAVLKLLSERLSAMKIGSPLDESTEMGPLANKEHYEKILSLFEKARQDGSEIVYGGHALEGEGFFVAPTIIRAKSAEDTLMQEETFGPIGTFLSYDDEEELIVMMNATPFGLSASLWTNDLSKAMRMIPRIQVGTLWINMHTFLDPAVPFGGVKSSGIGREFGSAFIEHYTELKSVMVRY

SEQ ID NO: 478 - protein, 479 aa, Synechocystis sp. PCC 6803
MASSMLSSATMVASPAQATMVAPFNGLKSSAAFPATRKANNDITSITSNGGRVNCMQVWPPIGKKKFETLSYLPDLTDSGGRVNCMQAMGKNLLEQLRQFTVVVADTGDIQAIETFTPRDSTTNPSLITAAAQMPQYQEIVDSTLLKAKDEAGENASIKDIVRLAFDRLAVAFGLKILQIIPGRVSTEVDARLSYDTEATIAKARYLIGEYAKAGIDKKRILIKIASTWEGIKAAEVLEQEGIHCNLTLLFGLHQAIACAEAKVTLISPFVGRILDWYKKSTGKEYDSHEDPGVQSVTTIYNYYKRFGYKTEVMGASFRNIGEIIELAGCDLLTISPQLLDQLRNTEGDLPRKLDPATVPQDIEKIVMDKATFDKMHAEDPMASEKLAEGIAGFTKALEVLEHLLEERLKVLDGQEHIKHGAEEIFHAYDLDGDGFITREEWAGTDVVFDALDRDHDGKITAAEMSAGLGAAFRLASVG

SEQ ID NO: 479 - protein, 197 aa, Arabidopsis thaliana
MDLSPVKEALAAKSFDKIADICDTLMLQVASEGIEYHDDWPYAIHLLGYFYVDDCDSARFLWKRIPTAIKERKPEVVAAWGIGQKLWTHDYAGVYEAIRGYDWSQEAKDMVAAFSDLYTKRMFQLLLSAYSTITIHDLALFLGMTEDDATTYVVENGWTVDAASQMASVKKQAVKREQKVDSSKLQRLTEYVFHLEH

SEQ ID NO: 480 - protein, 325 aa, Arabidopsis thaliana
MKGTQVINITAIPNWELSGFVEYIPSGHKQGDMILVVPKGAFAVRLGNEASIKQKISVKKGSYYSITFSAARTCAQDERLNVSVAPHHAVMPIQTVYSSSGWDLYSWAFKAQSDYADIVIHNPGVEEDPACGPLIDGVAMRALFPPRPTNKNILKNGGFEEGPWVLPNISSGVLIPPNSIDDHSPLPGWMVESLKAVKYIDSDHFSVPQGRRAVELVAGKESAVAQVVRTIPGKTYVLSFSVGDASNACAGSMIVEAFAGKDTIKVPYESKGKGGFKRSSLRFVAVSSRTRVMFYSTFYAMRNDDFSSLCGPVIDDVKLLSARRP

SEQ ID NO: 481 - protein, 308 aa, Arabidopsis thaliana
MASWMKAVLISTGVVATAMHLKVIVPVAMDFSQNPIILSSFLTWLKPPYLYVITNVIIIVVGVSYRITTVSSHVDGKDYEASYSGDNKFQTDHQQIVQEAPLRRRTETKDADFGFIGKVLQIVKEPEVVYEEKERPATVEEEEKKCIIVVSKSENQPPVEKPLVTARIGQKKPVVKTTPAERNSMRALRVAKPKRNETLENTWKMIMEGNKSTLPLTSYYKRPDTFGLGEETKQSGVLKKSETFSDRTNCYQSLPPPPPPLVKVKKVKVSRSRDELNRKVEAFIKKCNDERFASMKLDNEVARHGLSY

SEQ ID NO: 482 - protein, 255 aa, Arabidopsis thaliana
MEAGGAYNPRTVEEVFRDFKGRRAGMIKALTTDVQEFFRLCDPEKENLCLYGHPNEHWEVNLPAEEVPPELPEPVLGINFARDGMAEKDWLSLVAVHSDAWLLAVAFFFGARFGFDKADRKRLFNMVNDLPTIFEVVAGTAKKQGKDKSSVSNNSSNRSKSSSKRGSESRAKFSKPEPKDDEEEEEEGVEEEDEDEQGETQCGACGESYAADEFWICCDLCEMWFHGKCVKITPARAEHIKQYKCPSCSNKRARS

SEQ ID NO: 483 - protein, 304 aa, Arabidopsis thaliana
MPLEAVVYPQDPFGYLSNCKDFMFHDLYSQEEFVAQDTKNNIDKLGHEQSFVEQGKEDDHQWRDYHQYPLLIPSLGEELGLTAIDVESHPPPQHRRKRRRTRNCKNKEEIENQRMTHIAVERNRRKQMNEYLAVLRSLMPSSYAQRGDQASIVGGAINYVKELEHILQSMEPKRTRTHDPKGDKTSTSSLVGPFTDFFSFPQYSTKSSSDVPESSSSPAEIEVTVAESHANIKIMTKKKPRQLLKLITSLQSLRLTLLHLNVTTLHNSILYSISVRVEEGSQLNTVDDIATALNQTIRRIQEET

SEQ ID NO: 484 - protein, 348 aa, Arabidopsis thaliana
MEKAENEKKPSAVSDVGAWAMNVTSSVGIIMANKQLMSSSGFGFSFATTLTGFHFALTALVGMVSNATGLSASKHVPLWELLWFSLVANISIAAMNFSLMLNSVGFYQISKLSMIPVVCVMEWVLHSKHYSREVKASVMVVVVGVGICTVTDVKVNAKGFICACTAVFSTSLQQISIGSLQKKYSIGSFELLSKTAPIQAISLLIFGPFVDYFLSGRFISTYKMTYSAMLCILLSCALAVFCNISQYLCIGRFSATSFQVLGHMKTVCVLTLGWLIFDSEMTFKNIAGMVLAVVGMVIYSWAVELEKQRKSKVIPHGKHSMTEDEIKLLKEGIEHMDLKDMELGNNKA

SEQ ID NO: 485 - protein, 369 aa, Arabidopsis thaliana
MSKITLGNESIVGSLTPSNKKSYKVTNRIQEGKKPLYAVVFNFLDARFFDVFVTAGGNRITLYNCLGDGAISALQSYADEDKEESFYTVSWACGVNGNPYVAAGGVKGIIRVIDVNSETIHKSLVGHGDSVNEIRTQPLKPQLVITASKDESVRLWNVETGICILIFAGAGGHRYEVLSVDFHPSDIYRFASCGMDTTIKIWSMKEFWTYVEKSFTWTDDPSKFPTKFVQFPVFTASIHTNYVDCNRWFGDFILSKSVDNEILLWEPQLKENSPGEGASDVLLRYPVPMCDIWFIKFSCDLHLSSVAIGNQEGKVYVWDLKSCPPVLITKLSHNQSKSVIRQTAMSVDGSTILACCEDGTIWRWDVITK

SEQ ID NO: 486 - protein, 357 aa, Arabidopsis thaliana
MMNVKPMEQIMIPNNNTHQPNTTSNARPNTILTSNGVSTAGATVSGVSNNNNNTAVVAERKARPQEKLNCPRCNSTNTKFCYYNNYSLTQPRYFCKGCRRYWTEGGSLRNVPVGGSSRKNKRSSSSSSSNILQTIPSSLPDLNPPILFSNQIHNKSKGSSQDLNLLSFPVMQDQHHHHVHMSQFLQMPKMEGNGNITHQQQPSSSSSVYGSSSSPVSALELLRTGVNVSSRSGINSSFMPSGSMMDSNTVLYTSSGFPTMVDYKPSNLSFSTDHQGLGHNSNNRSEALHSDHHQQGRVLFPFGDQMKELSSSITQEVDHDDNQQQKSHGNNNNNNNSSPNNGYWSGMFSTTGGGSSW

SEQ ID NO: 487 - protein, 369 aa, Glycine max
MESELKDLNSKPPNGNGNSVRDDRPLLKPEPPVSADSIADMEKKFAAYVRRDVYGTMGRGELPTKEKLLLGFALVTLLPIRVVLAVTILLFYYLICRVCTLFSAPTGEEEQEDYAHISGWRRTIIVSCGRALSRLMLFIFGFYWIPESNSASQEDKSRQPEELRRPGVIISNHVSYLDILYHMSSSFPSFVAKRSVAKLPLVGLISKCLGCVYVQRESRSSDFKGVSAVVTDRIREAHQNESAPLMMLFPEGTTTNGEFLLPFKTGGFLAKAPVLPVILQYHYQRFSPAWDSISGVRHVIFLLCQFVNYMEVIRLPVYHPSQQEMDDPKLYANNVRRLMATEGNLILSDIGLAEKRIYHAALNGLFSQC

SEQ ID NO: 488 - protein, 526 aa, Arabidopsis thaliana
MTGGGFATSANGVEFEAKITPIVIISCIMAATGGLMFGYDVGVSGGVTSMPDFLEKFFPVVYRKVVAGADKDSNYCKYDNQGLQLFTSSLYLAGLTATFFASYTTRTLGRRLTMLIAGVFFIIGVALNAGAQDLAMLIAGRILLGCGVGFANQAVPLFLSEIAPTRIRGGLNILFQLNVTIGILFANLVNYGTAKIKGGWGWRLSLGLAGIPALLLTVGALLVTETPNSLVERGRLDEGKAVLRRIRGTDNVEPEFADLLEASRLAKEVKHPFRNLLQRRNRPQLVIAVALQIFQQCTGINAIMFYAPVLFSTLGFGSDASLYSAVVTGAVNVLSTLVSIYSVDKVGRRVLLLEAGVQMFFSQVVIAIILGVKVTDTSTNLSKGFAILVVVMICTYVAAFAWSWGPLGWLIPSETFPLETRSAGQSVTVCVNLLFTFIIAQAFLSMLCHFKFGIFIFFSAWVLIMSVFVMFLLPETKNIPIEEMTERVWKKHWFWARFMDDHNDHEFVNGEKSNGKSNGFDPSTRL

SEQ ID NO: 489 - protein, 353 aa, Arabidopsis thaliana
AKVFVLTFGRDVFFYFDDQEIVVKPLEEIVTNTCPKPQPQPLQPQQPPSVGGERKARPEKDQAVNCPRCNSTNTKFCYYNNYSLTQPRYFCKGCRRYWTEGGSLRNIPVGGGSRKNKRSHSSSSDISNNHSDSTQPATKKHLSDHHHHLMSMSQQGLTGQNPKFLETTQQDLNLGFSPHGMIRTNFTDLIHNIGNNTNKSNNNNNPLIVSSCSAMATSSLDLIRNNSNNGNSSNSSFMGFPVHNQDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 490 - protein, 724 aa, Arabidopsis thaliana
MEFGSFLVSLGTSFVIFVILMLLFTWLSRKSGNAPIYYPNRILKGLEPWEGTSLTRNPFAWMREALTSSEQDVVNLSGVDTAVHFVFLSTVLGIFACSSLLLLPTLLPLAATDNNIKNTKNATDTTSKGTFSQLDNLSMANITKKSSRLWAFLGAVYWISLVTYFFLWKAYKHVSSLRAQALMSADVKPEQFAILVRDMPAPPDGQTQKEFIDSYFREIYPETFYRSLVATENSKVNKIWEKLEGYKKKLARAEAILAATNNRPTNKTGFCGLVGKQVDSIEYYTELINESVAKLETEQKAVLAEKQQTAAVVFFTTRVAAASAAQSLHCQMVDKWTVTEAPEPRQLLWQNLNIKLFSRIIRQYFIYFFVAVTILFYMIPIAFVSAITTLKNLQRIIPFIKPVVEITAIRTVLESFLPQIALIVFLAMLPKLLLFLSKAEGIPSQSHAIRAASGKYFYFSVFNVFIGVTLAGTLFNTVKDIAKNPKLDMIINLLATSLPKSATFFLTYVALKFFIGYGLELSRIIPLIIFHLKKKYLCKTEAEVKEAWYPGDLSYATRVPGDMLILTITFCYSVIAPLILIFGITYFGLGWLVLRNQALKVYVPSYESYGRMWPHIHQRILAALFLFQVVMFGYLGAKTFFYTALVIPLIITSLIFGYVCRQKFYGGFEHTALEVACRELKQSPDLEEIFRAYIPHSLSSHKPEEHEFKGAMSRYQDFNAIAGV

SEQ ID NO: 491 - protein, 330 aa, Arabidopsis thaliana
MTMRSSSPSSSSSYSLAFTSLSNRLETIFKKASELCTLCDIEACVIYYGPDGELKTWPKEKEKVRDIALRYSLLNEALRRKKSVNLHGFLNKKKNKGLKNPNKKMKTSLKNVNILKYPLADHYPPDQVSPLIQSLELHVSKFQERLRFLESQKQNQTKPDHQSLTPSSLNHYTQSLNPSQFSLFMYNHGDNTLSQIPVSASNFNQDYFSALLEESELKNQLMKPEICGYDQNQNMSMGDITNNKFQDPCVSNKEAVQESVNNFGLNQLMYKEFYGCDQNMSMGNINSNSFQNPCVSNTQHYSAVEESVKNPWLNQLMQNELYGYGYAGFC

SEQ ID NO: 492 - protein, 807 aa, Arabidopsis thaliana
MPASEDRRGKWKRKKRGGLSAARKPKQEEEDMEEEDEENNNNNNEEMDDVENADELQQNGGATPDPGLGIGEVVEDSGSRISDFPAVVKRVVIRPHASVMAVVAAERAGLIGETRGQGSLPALENISFGQLQALSTVPADSLDLERSDGSSSAYVISPPPIMDGEGVVKRFGDLVHVLPMHSDWFAPNTVDRLERQVVPQFFSGKSPNHTPESYMEFRNAIVSKYVENPEKTLTISDCQGLVDGVDIEDFARVFRFLDHWGIINYCATAQSHPGPLRDVSDVREDTNGEVNVPSAALTSIDSLIKFDKPNCRHKGGEVYSSLPSLDGDSPDLDIRIREHLCDSHCNHCSRPLPTVYFQSQKKGDILLCCDCFHHGRFVVGHSCLDFVRVDPMKFYGDQDGDNWTDQETLLLLEAVELYNENWVQIADHVGSKSKAQCILHFLRLPVEDGLLDNVEVSGVTNTENPTNGYDHKGTDSNGDLPGYSEQGSDTEIKLPFVKSPNPVMALVAFLASAVGPRVAASCAHESLSVLSEDDRMKSEGMQGKEASLLDGENQQQDGAHKTSSQNGAEAQTPLPQDKVMAAFRAGLSAAATKAKLFADHEEREIQRLSANIVNHQLKRMELKLKQFAEIETLLMKECEQVEKTRQRFSAERARMLSARFGSPGGISPQTNNLQGMSLSTGGNNINSLMHQQHQQQQASATSQPSIIPGFSNNPQVQAQMHFMARQQQQQQQQQQQQQQAFSFGPRLPLNAIQTNAGSTASPNVMFGNNQLNNPAAAGAASINQPSFSHPMVRSSTGSGSGSGLGLN

SEQ ID NO: 493 - protein, 532 aa, Arabidopsis thaliana
MENQEDSCECEELPLNHLGDEEEFRSCCGDEELWLKGSDDIAKVVEEEKKDDLDDEFSVKMVFKGVSIFERGDLGSGYSGIGVVLERSGDLELIQVQKKLDFYVEESVANYLALMDGLEVALQNNLSSVVAVTDSELLYNQITREEQLEIPLLVALRERVLEKTSNLNGFVLKLAPFCDLDEALSLAQVAVGIVSSNLDGDKPIENCSICCEDRQSEMMLSLKCTHKFCSHCMKTYVEGKVKTSEVPIRCPQVQCKHYLSAAECKSFLPVTTFKSFEEANVCSKNNGKIYCPYPNCSFLLDPQECLSSGRASSSSSTQSENSCCVECPVCERFVCVDCGVPWHASMSCEEFQILPVDERYPDDITLHRLARYKRWRRCQQCRIMIELAQGCNHMTCRCGHEFCYSCGAEYREGQQTCTCAFWDDDEEEQENAVEENTIQEVEQWPWDTFNSIPTVMDAYSEQERSQLALIQRFLAGGGFSLSDHHTTYQSPPPPCTESSYVEAAMKDLHQLPWLERFVSVISDDYYEEYNSQ

SEQ ID NO: 494 - protein, 569 aa, Arabidopsis thaliana
MAMEVGEMSQPEATASLLSLASATQQPYVSELLSFTLDRLHKEPELLRVDAERIQRQMQEVAVGNYRAFITAADALLAIRQEVSSIDKHLESLIGEVPKLTSGCTEFIDSAENILEKRKMNQALLANHSTLLDLLEIPQLMDTCVRNGNFDEALDLEAFVSKLATLHPKLPVIQALAAEVRQTTQSLLSQLLQKLRSNIQLPECLRIIGYLRRIGVFGEYEMRLQFLRCREAWLTGILEDLDQKNAYEYLKGMINCHRMHLFDVVNQYRAIFSDDTSGSEENYDGGLLFSWAMHQITSHLKTLKIMLPKITEGGSLSNILDQCMYCAMGLGGVGLDFRGLLPPLFEEAVLNLFSKNMSTAVENFQLVLDSHRWVPLPSVGFPSSGINEDSKDDVTPPSYLMEHPPLAVFINGVSSALNELRPCAPLSLKNVVAHELIKGLQAVSDSLLRYNTTRMLRLSESNLFLSLCRAFVEVVFPHCATCFGRCYPGGATIVMDAKSAYEGLGRILAASSSQEPSNKSPKVISTDTKDASENGVASQPEEKQAENPNAKEEDNSPIPLQTPEITPES

SEQ ID NO: 495 - protein, 872 aa, Arabidopsis thaliana
MKSTFLLLLLLLSLNLLFVFVSCASSIEFVYPNFTASNLRFVDSSKGAFLLSRNSIFKAGLFSPGGDDSSTGFYFSVVHVDSGSTIWSSNRDSPVSSSGTMNLTPQGISVIEDGKSQIPVWSTPVLASPVKSLRLTDAGNLLLLDHLNVSLWESFDFPTDSIVLGQRLKLGMFLSGSVSRSDFSTGDYKFLVGESDGLMQWRGQNYWKLRMHIRANVDSNFPVEYLTVTTSGLALMARNGTVVVVRVALPPSSDFRVAKMDSSGKFIVSRFSGKNLVTEFSGPMDSCQIPFVCGKLGLCNLDNASENQSCSCPDEMRMDAGKGVCVPVSQSLSLPVSCEARNISYLELGLGVSYFSTHFTDPVEHGLPLLACHDICSKNCSCLGVFYENTSRSCYLVKDSFGSLSLVKNSPENHDLIGYVKLSIRKTNAQPPGNNNRGGSSFPVIALVLLPCSGFFLLIALGLLWWRRCAVMRYSSIREKQVTRPGSFESGDLGSFHIPGLPQKFEFEELEQATENFKMQIGSGGFGSVYKGTLPDETLIAVKKITNHGLHGRQEFCTEIAIIGNIRHTNLVKLRGFCARGRQLLLVYEYMNHGSLEKTLFSGNGPVLEWQERFDIALGTARGLAYLHSGCDQKIIHCDVKPENILLHDHFQPKISDFGLSKLLNQEESSLFTTMRGTRGYLAPEWITNAAISEKADVYSYGMVLLELVSGRKNCSFRSRSNSVTEDNNQNHSSTTTTSTGLVYFPLYALDMHEQGRYMELADPRLEGRVTSQEAEKLVRIALCCVHEEPALRPTMAAVVGMFEGSIPLGNPRMESLNFLRFYGLRFAESSMVEGQNGESETMVFHRRESSNSGGSRQSASYIASQEVSGPR

SEQ ID NO: 496 - protein, 200 aa, Arabidopsis thaliana
MTDQGLEGSNPVDLSKHPSGIVPTLQNIVSTVNLDCKLDLKAIALQARNAEYNPKRFAAVIMRIREPKTTALIFASGKMVCTGAKSEDFSKMAARKYARIVQKLGFPAKFKDFKIQNIVGSCDVKFPIRLEGLAYSHAAFSSYEPELFPGLIYRMKVPKIVLLIFVSGKIVITGAKMRDETYKAFENIYPVLSEFRKIQQ

SEQ ID NO: 497 - protein, 261 aa, Arabidopsis thaliana
MWNLASKSIREGFISKGEEAATKPRRATLDRSGDGRKTTKEEKLECPICWESFNVVENVPYVLWCGHTICKYCLLGLQRAIVIKSSALPFQLPFFVACPWCNILSLRLVCNGTIRFPSKNFYLLWMVESMNGSRSEAPSDNKRVASGQRDLRNRCDGVSNTALGDEGLLDNRSWWNGVTRGFFRTGRLHDSVRKSMALVAHLLAKFPLVVIFLLMALYAIPVSAAVLGVYFFVTFALAVPSFLVLYFAFPSLNWLIREIAT

SEQ ID NO: 498 - protein, 371 aa, Glycine max
MATPVEPPNGIRTEGKHYYSMWQTLFEFDSKYVPIKPIGRGAYGIVCSSVNRETNEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGSPFSRLYPNAHPLAIDLLAKMLVFDPTKRISVTEALQHPYMAPLYDPNCDPPAVIPIDLDIDEDLGEEMIREMMWKEMLHYHPESAMENAGLC

SEQ ID NO: 499 - protein, 405 aa, Arabidopsis thaliana
  unsure (1)..(405): unsure at all Xaa locations
MAFHNNHFNHFTDQQQHQPPPPPQQQQQQHFQESAPPNWLLRSDNNFLNLHTAASAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRXMQVKTAEETVEIKLACRDPKAL

SEQ ID NO: 500 - protein, 490 aa, Arabidopsis thaliana
MAETTSWIPVWFPLMVLGCFGLNWLVRKVNVWLYESSLGENRHYLPPGDLGWPFIGNMLSFLRAFKTSDPDSFTRTLIKRYGPKGIYKAHMFGNPSIIVTTSDTCRRVLTDDDAFKPGWPTSTMELIGRKSFVGISFEEHKRLRRLTAAPVNGHEALSTYIPYIEENVITVLDKWTKMGEFEFLTHLRKLTFRIIMYIFLSSESENVMDALEREYTALNYGVRAMAVNIPGFAYHRALKARKTLVAAFQSIVTERRNQRKQNILSNKKDMLDNLLNVKDEDGKTLDDEEIIDVLLMYLNAGHESSGHTIMWATVFLQEHPEVLQRAKAEQEMILKSRPEGQKGLSLKETRKMEFLSQVVDETLRVITFSLTAFREAKTDVEMNGYLIPKGWKVLTWFRDVHIDPEVFPDPRKFDPARWDNGFVPKAGAFLPFGAGSHLCPGNDLAKLEISIFLHHFLLKYQVKRSNPECPVMYLPHTRPTDNCLARISYQ

SEQ ID NO: 501 - protein, 208 aa, Arabidopsis thaliana
MEKIVRSSSLILLVGLLLFMNFHGFVRIAEATKRRIEISDDLDDVEDNEEDESWKEWGKKATTPEFDPPPDFTNMGFDQIQEEMAKRTFGTVVGFVKLRLGVPRTKDVVIDIAMKWTKVLRTGGIGVRFMAVDRSTVMFNMQNGKLVTELREFVLSQEEAYEVKIGKQEFRRPGDPPFEDVFDKFQAEQRKDHEDGDGNKNDLTKDEL

SEQ ID NO: 502 - protein, 611 aa, Arabidopsis thaliana
MAKLLETFPCVPSTERGRGILISGDSKSDTILYCNGRSVFIRSLRQLQDVQVYGEHGYAVTVARYSPNGEWIASADVSGTVRVWGTHNGFVLKNEFRVLAGRVDDLQWSFDGLRIVASGDGKGKSLVRSFAWDSGNTMGDFDGHSRRVLSCAFKPTRPFRIATCGEDFLVNFYDGPPFKFHSSHREHSNFVNCIRYSPDGTKFITVSSDKKGMIYDGKTGDKVGELASEDGHKGSIYAVSWSPDSKRVLTVSADKSAKVWEVAEDGTIGSVIKTLSFMESGGAEDMLVGCLWQNDHLITVSLGGTMSLFSADDMDKPPLLLSGHIKNVTSLAVLGENQKTILSCSYDGLIVKWLKGVGYSCKLQMKDTKIKRLAATESSIFISGYDNMVWRIPLTDNGYGAAEHVDIGHQPLDISIAVDSPEATALVSFDSGVVLLNGLNILSKIDLGFAVAASVISPDGKEAIVGGQDGKLHIYSVSGDNNLKEEAVLEKHRGALTVIRYSPDLTMFASGDANREAVVWDRETKQVKLNNMLFHTARINSLAWSPNNKMVATGSIDTCVIVYEVDKPASSRITARNAHLGGVNAVAFIDDCTVASSGEDASVRLWHIEPQ

SEQ ID NO: 503 - protein, 764 aa, Arabidopsis thaliana
MASHNENDDIPMLPISDPSSRTRARAFTSRSRSVSLSNPTSSIEGFDTSTVVLGYTGPLRTQRRPPLVQMSGPLTSTRKHEPLFLPHPSSDSVGVSSQPERYPSFAALEHKNSSEDEFVLKHANLLRSGQLGMCNDPYCTTCPSYYNRKAAQIPTSRVSALFDSTFHNALYDDAKGWARRFASSVNRYLPGIMNPHAKEVQTWTKFFALSCLLAIFIDPLFFFLIKVQEQNKCIMIDWPMTKAFVAVRSVTDVIFTMNILLQFRLAYVARESTVVGAGQLVSHPKKIALHYLKGKFFLDLFIVMPLPQILILWIIPAHLGASGANYAKNLLRAAVLFQYIPKLYRLLPFLAGQTPTGFIFESAWANFVINLLTFMLAGHVVGSCWYLFGLQRVNQCLRNACGNFGRECQDLIDCGNGNSSVLVRATWKDNASANACFQEDGFPYGIYLKAVNLTNHSNLFTRYSYSLFWGFQQISTLAGNQVPSYFLGEVFFTMGIIGLGLLLFALLIGNMQNFLQALGKRNLEMTLRRRDVEQWMSHRRLPDGIRRRVREAERFNWAATRGVNEELLFENMPDDLQRDIRRHLFKFLKKVRIFSLMDEPILDAIRERLKQRTYIGSSTVLHRGGLVEKMVFIVRGEMESIGEDGSVLPLYEGDVCGEELLTWCLERSSVNPDGTRIRMPSKGLLSSRNVRCVTNVEAFSLSVADLEDVTSLFSRFLRSHRVQGAIRYDSPYWRLRAARQIQVAWRYRRRRLHRLCTPQSSYSL

SEQ ID NO: 504 - protein, 356 aa, Arabidopsis thaliana
MAPSSSPLRTTSETDEKYANVKWEELGFALTPIDYMYVAKCRQGESFTQGKIVPYGDISISPCSPILNYGQGLFEGLKAYRTEDDRIRIFRPDQNALRMQTGAERLCMTPPTLEQFVEAVKQTVLANKKWVPPPGKGTLYIRPLLLGSGATLGVAPAPEYTFLIYASPVGDYHKVSSGLNLKVDHKYHRAHSGGTGGVKSCTNYSPVVKSLLEAKSAGFSDVLFLDAATGRNIEELTACNIFIVKGNIVSTPPTSGTILPGVTRKSISELAHDIGYQVEERDVSVDELLEAEEVFCTGTAVVVKAVETVTFHDKKVKYRTGEAALSTKLHSMLTNIQMGVVEDKKGWMVDIDPCQG

SEQ ID NO: 505 - protein, 92 aa, Arabidopsis thaliana
MAFLRSFFATKHIIRRSFTTESLSTPKGFFAVYVGENLKKKRYLVPVCYLNKPSFQALLRKAEEEFGFNHPTGGLSLPCDEAFFFTVTSQIR

SEQ ID NO: 506 - protein, 779 aa, Arabidopsis thaliana
MDDRHEGDHHDIEVEGGALHGFERKISGILDDGSVGFRQPLLARNRKNTTSQIAIVGANTCPIESLDYEIFENDFFKQDWRSRKKIEILQYTFLKWALAFLIGLATGLVGFLNNLGVENIAGFKLLLIGNLMLKEKYFQAFFAFAGCNLILATAAASLCAFIAPAAAGSGIPEVKAYLNGIDAYSILAPSTLFVKIFGSIFGVAAGFVVGKEGPMVHTGACIANLLGQGGSKKYRLTWKWLRFFKNDRDRRDLITCGAAAGVAAAFRAPVGGVLFALEEAASWWRNALLWRTFFTTAVVAVVLRSLIEFCRSGRCGLFGKGGLIMFDVNSGPVLYSTPDLLAIVFLGVIGGVLGSLYNYLVDKVLRTYSIINEKGPRFKIMLVMAVSILSSCCAFGLPWLSQCTPCPIGIEEGKCPSVGRSSIYKSFQCPPNHYNDLSSLLLNTNDDAIRNLFTSRSENEFHISTLAIFFVAVYCLGIITYGIAIPSGLFIPVILAGASYGRLVGRLLGPVSQLDVGLFSLLGAASFLGGTMRMTVSLCVILLELTNNLLMLPLVMLVLLISKTVADCFNRGVYDQIVTMKGLPYMEDHAEPYMRNLVAKDVVSGALISFSRVEKVGVIWQALKMTRHNGFPVIDEPPFTEASELCGIALRSHLLVLLQGKKFSKQRTTFGSQILRSCKARDFGKAGLGKGLKIEDLDLSEEEMEMYVDLHPITNTSPYTVLETLSLAKAAILFRQLGLRHLCVVPKTPGRPPIVGILTRHDFMPEHVLGLYPHIDPLK

SEQ ID NO: 507 - protein, 303 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMSADPNRIVRLLPLGAGSLGGLLLLINRLSTPMLNPSQARSDVVGVILAGMLVCVWLIWQRIQPKSPEAVVLEGKEGFDLLDSLPQEIKTELAWASHLLLTNTVTQTMVVYYDRQVLLRRGILSEQKEVKPGPIVERVMQTQKPVYLVNLPLYPGRVEFDYLPANTQGLICQPLDDRGVLILGANIPRSYTKQDENWVTGIADKIAHSLSMPINA

SEQ ID NO: 508 - protein, 432 aa, Saccharomyces cerevisiae
MYKLDNNDIDDETNNSVSLTSLLEFLDPIASKVVSKYYHGSHLSKAEQKLRNFEGFRRRKPHHEHDSHHPHHLNRSRSFLQLEDFKVRALQRIRNLDKPLDSIFFKNSSRLEKAFYPFTLFNIFFIGFLMGRFPEWFHVYYTILFFVLMPIRFYTYYKTKNHYFLADFCYFVNMLCLLFIWIFPYSYSLFQSCFAFTFGTLCFAVITWRNSLVIHSIDKTTSCFIHIIPPCVMYVIYHGLPLEYKIERFPGAIIQSELDIKKNILWTSLYYLVWQSLYHYFITLKKSSKIKSGERMTSFEYLTTHQFKNFWAVKLRSPWPMIIYTLSQYFYQLFTMLLCGIWIRYKLAAALFLTIVFLWASHNGATYYIDHYGKNFEKEVDRLRLEVENLQQKLQPDSDAVISDASVNDKDYLNVNRDEDFDDSSSVSSKSD

SEQ ID NO: 509 - protein, 447 aa, Escherichia coli K12
MASSMLSSATMVASPAQATMVAPFNGLKSSAAFPATRKANNDITSITSNGGRVNCMQVWPPIGKKKFETLSYLPDLTDSGGRVNCMQAMAKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKANEAYLQGQLGNPKGEDQPNKKYYDPRVWLRAGQTSMIARLEKAFQELNAIDVL

SEQ ID NO: 510 - protein, 602 aa, Saccharomyces cerevisiae
MSNTSSYEKNNPDNLKHNGITIDSEFLTQEPITIPSNGSAVSIDETGSGSKWQDFKDSFKRVKPIEVDPNLSEAEKVAIITAQTPLKHHLKNRHLQMIAIGGAIGTGLLVGSGTALRTGGPASLLIGWGSTGTMIYAMVMALGELAVIFPISGGFTTYATRFIDESFGYANNFNYMLQWLVVLPLEIVSASITVNFWGTDPKYRDGFVALFWLAIVIINMFGVKGYGEAEFVFSFIKVITVVGFIILGIILNCGGGPTGGYIGGKYWHDPGAFAGDTPGAKFKGVCSVFVTAAFSFAGSELVGLAASESVEPRKSVPKAAKQVFWRITLFYILSLLMIGLLVPYNDKSLIGASSVDAAASPFVIAIKTHGIKGLPSVVNVVILIAVLSVGNSAIYACSRTMVALAEQRFLPEIFSYVDRKGRPLVGIAVTSAFGLIAFVAASKKEGEVFNWLLALSGLSSLFTWGGICICHIRFRKALAAQGRGLDELSFKSPTGVWGSYWGLFMVIIMFIAQFYVAVFPVGDSPSAEGFFEAYLSFPLVMVMYIGHKIYKRNWKLFIPAEKMDIDTGRREVDLDLLKQEIAEEKAIMATKPRWYRIWNFWC

SEQ ID NO: 511 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNFAYVTDGAATVEGIRKAELFVLSSLGYNISLPNPLNFIRRISKADNYCIETRNMAKFIMEYSICCNKFVHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 512 - protein, 424 aa, Glycine max
MGNSEDEKSVKTGSPSSSPATTDQTNQPNIHVYPDWAAMQYYGPRVNIPPYFNSAVASGHAPHPYMWGPPQPMMPPYGPPYAAFYSHGGVYTHPAVAIGPHLHGQGVSSSPAVGTHSSIESPTKLSGNTDQGLMKKSKGFDGLAMSIGNCNAESAEHGAENRQSQSVDTEGYSDGSDGNTAGANQTKRKRCREGTLTTDGEGKTELQNGPASKETSSSKKIVSATPASVAGTLVGPVVSSVMATTLELRNPSTVDSKANSTSAPQPCAIVPNETCLQNERELKRERRKQSNRESARRSRLRKQAETEELARKVDMLTAENVSLKSEIIQLTEGSEQMRMENSALREKLRNTQLGQREEIILSSIESKRAAPVSTENLLSRVNNSSSNDRTTENENDFCENKPNSGAKLHQLLDTNPRADAVAAG

SEQ ID NO: 513 - protein, 316 aa, Glycine max
MESEREIMMIPCFDFGKALEEGSEEWKEMSKKVREACESHGCFLLVCDEMIPKGVREEFFSNMEALFDLPEERKMKHISPKPYSSYSGKSPVIPLSETFGIDDVPLSASAEAFTNLMWPQGNPPFCETLKIMSSKMLKLSSLILKMIVEDYGIQQHYISDVEKMKSSSNSRLIKYKIPENNNDSNTGLVSHTDKNALTIICQNEVQGLQVLSKTDNWIELEIPQNGFVVIVGDILKAWSNGRLHAATHRVMMSGDKERYSFGLFTMPKEEMDIEVPIELVDEKIHPLRYHSFKYGEYISYFVSNLKENALEVFAGL

SEQ ID NO: 514 - protein, 287 aa, Glycine max
MSRASSAADSAASGEIILFGVRVVVDSMRKSVSMSNLSQYEHPQDGSNNKDALAAGYASADDAAPQNSGRLRERERKRGVPWTEEEHKLFLVGLQKVGKGDWRGISKNYVKTRTPTQVASHAQKYFLRRSNLNRRRRRSSLFDITTDTVSAIPMEGEQVQNQDTLSHSQQQSPLFPAETSKINGFPMMPVYQFGFGSSGVISVQGGNGNPMEELTLGQGNVEKHNVPNKVSTVSDIITPSSSSSAVDPPTLSLGLSFSSDQRQTSSRHSALHAIQCFSNGESIISVA

SEQ ID NO: 515 - protein, 277 aa, Arabidopsis thaliana
MYRERGMVGSKSEVVDRKRINEIHDNRPSHSMSQPVNGKGKVTSTSVLMGKQQLHDKESSRSGSISKTNISDAVDISDTDSEESEVSGSDGEDTSWISWFCNLRGNEFFCEVDDDYIQDDFNLCGLSHQVPYYDYALDLILDVESSHEEQNELIESAAEMLYGMIHARFILTSKGLASMLDKYKNYDFGRCPRVYCCGQPCLPVGQSDIPRASTVKIYCPKCEDVYYPRSKYQGNIDGAYFGTTFPHLFLMTYGHLKPQKASQSYTQRVFGFKLHKP

SEQ ID NO: 516 - protein, 577 aa, Arabidopsis thaliana
MRLLTLLLICTFFFFFSFAYSAESDNETDSVVTREINGTVVESNATSAKPREDSFADMIDRALEKEFPDNDQNEVPDPGSFNNSVADQQAVLETVARVKPKKNETKTKEEKSFFNLDNENGVEDTPRLIDRKDNVFIMSNPKSKYPVLQLDLRLISDLVVVIVSATCGGIAFACAGQPVITGYLLAGSIIGPGGLSFVSEMVQVETVAQFGVIFLLFALGLEFSAAKLRVVRAVAIPGGLLQIFLFMCLSGITASLCGGKLTEGIFVGAFLSMSSTAVVLKFLMERNSISALHGQITVGTLILQDCAVGLLFALLPVLGGTSGVLQGVLSMAKSLAILIAFLGALFVLSRTWVPWFLKLMTSLSSQTNELYQLAAVAFCLLVAWCSDKLGLSLELGSFAAGVMISTTDLAQHTLEQVEPIRNFFAALFLASIGMLIHMHFLWNHVDILLAAVLLVIVIKTVVVAIVVKVFGYNNKTAVLVGMSLAQIGEFAFVLLSRASNLHLIESKLYLLLLGTTALSLVTTPLLFKLIPAVVHLGVLLRWFSPDSSTEIGFKGELYHSESAKRISLMIQGSLHDS

SEQ ID NO: 517 - protein, 342 aa, Arabidopsis thaliana
MSLGALMEEKRRATTSSSSSQVHMSNDIDWQMLDKSRFFFLGAALFSGVSTALYPIVVLKTRQQVSPTRVSCANISLAIARLEGLKGFYKGFGTSLLGTIPARALYMTALEITKSSVGQATVRLGLSDTTSLAVANGAAGLTSAVAAQTVWTPIDIVSQGLMVQGDVSLSKHLPGVMNSCRYRNGFDAFRKILYTDGPRGFYRGFGISILTYAPSNAVWWASYSLAQKSIWSRYKHSYNHKEDAGGSVVVQALSAATASGCSALVTMPVDTIKTRLQVLDAEENGRRRAMTVMQSVKSLMKEGGVGACYRGLGPRWVSMSMSATTMITTYEFLKRLATKKQK

SEQ ID NO: 518 - protein, 287 aa, Glycine max
MYLFLNPPVTLFSYFYLCCFHRIASYVGELSTKKMGRGRVQLKRIENKTSQQVTFFKRRSGLLKKASEISVLCDAQVALIIFSTKGKLFEYSSERSMEDLLERYERCSHTALAGANNVESPGFWSFEHIKLTAKVEVLERNIMNFFGNDLDPLSLKELHSLEQQIETSLKRIRTRKNQVMNQSVSDLHKKARTLQVQNRWLGKMKEKAKTVTEGPHNGPETLGFDSSTLNLSSPQLPPPPSPQRLVPSLTLSETMQGGTPVEETGEAQTVPSGNSLIPPWMLRCMSD

SEQ ID NO: 519 - protein, 499 aa, Saccharomyces cerevisiae
MSYNFTGTPTGEGTGGNSLTTDLNTQFDLANMGWIGVASAGVWIMVPGIGLLYSGLSRKKHALSLLWASMMASAVCIFQWFFWGYSLAFSHNTRGNGFIGTLEFFGFRNVLGAPSSVSSLPDILFAVYQGMFAAVTGALMLGGACERARLFPMMVFLFLWMTIVYCPIACWVWNAEGWLVKLGSLDYAGGLCVHLTSGHGGLVYALILGKRNDPVTRKGMPKYKPHSVTSVVLGTVFLWFGWMFFNGGSAGNATIRAWYSIMSTNLAAACGGLTWMVIDYFRCGRKWTTVGLCSGIIAGLVGITPAAGFVPIWSAVVIGVVTGAGCNLAVDLKSLLRIDDGLDCYSIHGVGGCIGSVLTGIFAADYVNATAGSYISPIDGGWINHHYKQVGYQLAGICAALAWTVTVTSILLLTMNAIPFLKLRLSADEEELGTDAAQIGEFTYEESTAYIPEPIRSKTSAQMPPPHENIDDKIVGNTDAEKNSTPSDASSTKNTDHIV

SEQ ID NO: 520 - protein, 683 aa, Arabidopsis thaliana
MPSRLSPPDIPPLQPTPTVSDGHHRFQTLPLIIAGSLTLTGVLLILVTLLIYRRLYRNRTAPSDLISNSKSPQHYQCRRFSYSQLRRATNSFSESTHLGHGGFGSVYKADFPSGGDSLAVKVMDTSAGSLQGEREFHNELSLSSHLIGSPHVVSLLGFSSDRRGRKLILVYELMANRSLQDALLDRKCVELMDWNKRFEIATDIAKGIEFLHHCCDPIIIHGDIKPSNILLDSDFKAKIGDFGLARVKSEDFDTRILIEEEDKSKDVVEDNGSILEETESVITVFEEGNNVVNLSPETCGISVLTETVASPGEKSGLSPENCAVSILTVEVGAASPAMASIPSPETCAISVLTDTGLSPESSKLKVGSKRDWWWKQDNNGGSRGGIESGSVKDYVMEWIGSEIKKERPSNNKEWINNGDGSSSVSKKKKKEKKRKPREWWKEEFCEELTRKKRKKKKKKKRGLSSISSIDSWFHRDDGASSVHDHNLNPTKRKKRNSIDWWVDGLSGELKSVMGKKNSQDSGLWCDVNVQKSGGVSSTPSMRGTVCYIAPECGGGGVLSEKCDVYSFGVLLLVLVSGRRPLQVTASPMSEFERANLISWAKQLACNGKLLELVDKSIHSLEKEQAVLCITIALLCLQRSPVKRPTMKEIVEMLSGVSEPPHLPFEFSPSPPMGFPFKSRKKAR

SEQ ID NO: 521 - protein, 292 aa, Bacillus subtilis subsp. subtilis str. 168
MKKVRKAIIPAAGLGTRFLPATKAMPKEMLPIVDKPTIQYIIEEAVEAGIEDIIIVTGKSKRAIEDHFDYSPELERNLEEKGKTELLEKVKKASNLADIHYIRQKEPKGLGHAVWCARNFIGDEPFAVLLGDDIVQAETPGLRQLMDEYEKTLSSIIGVQQVPEEETHRYGIIDPLTSEGRRYQVKNFVEKPPKGTAPSNLAILGRYVFTPEIFMYLEEQQVGAGGEIQLTDAIQKLNEIQRVFAYDFEGKRYDVGEKLGFITTTLEFAMQDKELRDQLVPFMEGLLNKEEI

SEQ ID NO: 522 - protein, 888 aa, Arabidopsis thaliana
MPLKEDDCCLFAEEYDGPPLSYNIPCAVPINVEKIPVAAVVSPVCISDNMSFPVIQPILSVESKKFLIDSVSPTSVIANCGSNQLELVSDSITVSPTSVIEHTEEEEEEEGGDGEDCELSSSGELLLRSCSVKESLDLNESSSNPLVPDWESNESVLSMDYPSSRVTGDCVSETNGDGKKQPVVTFLGIASDDGFEEEESCSNLRRVRVVPVKKQPQTKGKKGSCYRCFKGSRFTEKEVCLVCDAKYCNSCVLRAMGSMPEGRKCVTCIGFPIDESKRGSLGKCSRMLKRLLNDLEVKQIMKTERFCEANQLPAEYVYVNGQPLYPEELVTLQTCSNPPKKLKPGDYWYDKVSGLWGKEGEKPYQIISPHLNVGGPISPEASNGNTQVFINGREITKVELRMLQLAGVQCAGNPHFWVNEDGSYQEEGQKNTKGYIWGKAGTKLLCAVLSLPVPSKSTANASGEQLYSANSRSILDHLEHRTLQKILLVGNSGSGTSTIFKQAKILYKDVPFLEDERENIKVIIQTNVYGYLGMLLEGRERFEEEALALRNTKQCVLENIPADEGDAKSNDKTVTMYSIGPRLKAFSDWLLKTMAAGNLGVIFPAASREYAPLVEELWRDAAIQATYKRRSELGLLPSVASYFLERAIDVLTPDYEPSDLDILYAEGVTSSSGLACLDFSFPQTASEENLDPSDHHDSLLRYQLIRVPSRGLGENCKWIDMFEDVGMVVFVVSMSDYDQVSEDGTNKMLLTKKLFESIITHPIFENMDFLLILNKYDLLEEKVERVPLARCEWFQDFNPVVSRHRGSNNGNPTLGQLAFHFMAVKFKRFYSSLTGKKLFVSSSKSLDPNSVDSSLKLAMEILKWSEERTNICMSEYSMYSTEPSSFSN

SEQ ID NO: 523 - protein, 574 aa, Saccharomyces cerevisiae [sequence omitted]

SEQ ID NO: 524 - protein, 170 aa, Bacillus subtilis subsp. subtilis str. 168
MDLKQYVTIVPDYPKEGVQFKDITTLMDKGDVYRYATDQIVEYAKEKQIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELSYLDGRNKLEDYDILTLMKY

SEQ ID NO: 525 - protein, 768 aa, Arabidopsis thaliana
MILHKMAFLAVILFFLISSSSVCVHSRETFACDTKDAATATLRFCQLSVPIPERVRDLIGRLTLAEKVSLLGNTAAAIPRLGIKGYEWWSEALHGVSNVGPGTKFGGVYPAATSFPQVITTVASFNASLWESIGRVVSNEARAMYNGGVGGLTYWSPNVNILRDPRWGRGQETPGEDPVVAGKYAASYVRGLQGNDRSRLKVAACCKHFTAYDLDNWNGVDRFHFNAKVSKQDIEDTFDVPFRMCVKEGNVASIMCSYNQVNGVPTCADPNLLKKTIRNQWGLNGYIVSDCDSVGVLYDTQHYTGTPEEAAADSIKAGLDLDCGPFLGAHTIDAVKKNLLRESDVDNALINTLTVQMRLGMFDGDIAAQPYGHLGPAHVCTPVHKGLALEAAQQGIVLLKNHGSSLPLSSQRHRTVAVIGPNSDATVTMIGNYAGVACGYTSPVQGITGYARTIHQKGCVDVHCMDDRLFDAAVEAARGADATVLVMGLDQSIEAEFKDRNSLLLPGKQQELVSRVAKAAKGPVILVLMSGGPIDISFAEKDRKIPAIVWAGYPGQEGGTAIADILFGSANPGGKLPMTWYPQDYLTNLPMTEMSMRPVHSKRIPGRTYRFYDGPVVYPFGHGLSYTRFTHNIADAPKVIPIAVRGRNGTVSGKSIRVTHARCDRLSLGVHVEVTNVGSRDGTHTMLVFSAPPGGEWAPKKQLVAFERVHVAVGEKKRVQVNIHVCKYLSVVDRAGNRRIPIGDHGIHIGDESHTVSLQASTLGVIKS

SEQ ID NO: 526 - protein, 494 aa, Agrobacterium tumefaciens str. C58
MASSMLSSATMVASPAQATMVAPFNGLKSSAAFPATRKANNDITSITSNGGRVNCMQVWPPIGKKKFETLSYLPDLTDSGGRVNCMQAMEEFHKVRRLPQYVFEQVNRLKASARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLKRFLSSADETMHNVVSLNAHR

SEQ ID NO: 527 - protein, 417 aa, Arabidopsis thaliana
MGVINVQGSPSFSIHSSESNLRKSRALKKPFCSIRNRVYCAQSSSAAVDESKNITMGDSFIRPHLRQLAAYQPILPFEVLSAQLGRKPEDIVKLDANENPYGPPPEVFEALGNMKFPYVYPDPQSRRLRDALAQDSGLESEYILVGCGADELIDLIMRCVLDPGEKIIDCPPTFSMYVFDAAVNGAGVIKVPRNPDFSLNVDRIAEVVELEKPKCIFLTSPNNPDGSIISEDDLLKILEMPILVVLDEAYIEFSGVESRMKWVKKYENLIVLRTFSKRAGLAGLRVGYGAFPLSIIEYLWRAKQPYNVSVAGEVAALAALSNGKYLEDVRDALVRERERLFGLLKEVPFLNPYPSYSNFILCEVTSGMDAKKLKEDLAKMGVMVRHYNSQELKGYVRVSAGKPEHTDVLMECLKQFY

SEQ ID NO: 528 - protein, 460 aa, Arabidopsis thaliana
LNSFLKARKKKDFVFKMPMFQPSKNGGFDGHILDLHSAVKDGVLGGGDGKFLVVVTDEKKKLDLKEMISELELPEIPSVFICPISLEPMQDPVTLCTGQTYERSNILKWFNIGHCTCPTTMQELWDDLVTPNKTLHQLIYTWFSQKYVLMKKRSEDVQGRAIEILGTLRKAKGKAKVHALSELKQVVMAHAIAKKTVVDEGGVFVISSLLSPFTSHAVGSEAIAILVNLELDSDSKAGLMQPARVSLMVDMLNDGSIETKINCARLIGRLVEEKGFRAELVSSHSLLVGLMRLVKDRRRRNGVSPALTLLKSVSVHKQVRNLLVRIGAVPQLVDVLPCLDVECLESALFVLDSLCLESEGRIALKDSVNTIPHTVRLLMKVSEKCTNYAISILWSVCKLASEECSSLAVEVGLAAKLLLVIQSGCDPALKQRSAELLKLCSLHYSDSMFISKCKLTRTIQ

SEQ ID NO: 529 - protein, 129 aa, Arabidopsis thaliana
MAISKALIASLLISLLVLQLVQADVVRLFHHKLIILNIILMFSKTYFSHVTTIFLQENSQKKNGYAKKIDCGSACVARCRLSRRPRLCHRACGTCCYRCNCVPPGTYGNYDKCQCYASLTTHGGRRKCP

SEQ ID NO: 530 - protein, 365 aa, Arabidopsis thaliana
MGSVEAGEKKALGWAARDPSGVLSPYSYTLRSTGADDVYIKVICCGICHTDIHQIKNDLGMSNYPMVPGHEVVGEVLEVGSDVSKFTVGDVVGVGVVVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAIEHLGADDYVVSSDPAEMQRLADSLDYIIDTVPVFHPLDPYLACLKLDGKLILMGVINTPLQFVTPLVILGRKVISGSFIGSIKETEEVLAFCKEKGLTSTIETVKIDELNIAFERLRKNDVRYRFVVDVAGSNLVEEAATTTN

SEQ ID NO: 531 - protein, 421 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMELLKREGLSLTEEKALWMYQKMLEIRGFEDKVHELFAQGVLPGFVHLYAGEEAVAVGVCAHLHDGDSITSTHRGHGHCIAKGCDLDGMMAEIFGKATGLCKGKGGSMHIADLDKGMLGANGIVGGGFTLACGSALTAKYKQTKNVSVCFFGDGANNQGTFHEGLNLAAVWNLPVVFVAENNGYGEATPFEYASACDSIADRAAAYNMPGVTVDGKDILAVYQAAEEAIERARNGGGPSLIECMTYRNYGHFEGDAQTYKTKDERVEHLEEKDAIQGFKNYLLKETDANKLSDIEQRVSESIEKAVSFSEDSPYPKDSELLTDVYVSYEKGGM

SEQ ID NO: 532 - protein, 299 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMGKRPIIIGVAGGTGSGKTTVAKEIFYQFNEKSIVLIEQDAYYKDQSQLSLEERLQTNYDHPLAFDNDLLIEHLHSLLNGQAIEKPVYDYKLHTRSNEVILVEPKDVIILEGILLLEDERLRELMDIKLFVDTDADIRIIRRMVRDIRERGRTLESVIEQYTKVVRPMHMQFIEPTKRYADVIIPEGGQNRVAIDLMVTKIRAIIEEKAVL

SEQ ID NO: 533 - protein, 215 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMVALIDTVKSIDNQLSRRHIDLDPAGYWLVMVEREAGVLKVEHYSNDINDQGLAVDPETGEVIACQGGRKRLPSLTLTGRTAKELCVKIFEELESCPVTMLNHAAYLGRELMRAELALTGGGEYIQD

SEQ ID NO: 534 - protein, 305 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMVKVAPSILSADFAALGNEIKDVEKGGADCIHIDVMDGHFVPNITIGPLIVEAVRPVTDLPLDVHLMIEEPDRYIPAFAKAGADILSVHAEACPHLHRTIQLIKEQGVKAGVVLNPHTPVQVIEHVFDDLDLVLLMTVNPGFGGQKFIHSVLPKIKEVKRMADEKGKKDLLIEVDGGVNKETAPLVIEAGANLLVAGSAVYGQSDRKKAISEIRGSK

SEQ ID NO: 535 - protein, 300 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMASYSSATARAEMSELRRLKSLLPPELQSWVMVEGSTEVNPPLIRSEELGRDEIEIQVDLAKWENLAIDQRNLLFWHEVARIQSDTIPREGWEMAALAIGLGGAVGELWVQDGLLLLLALGLCGISGYRLWQKNNGEKRIKEAIEADEKAITLATRFGYTLPNAYKSLGSAFKTLIEQTPNRRQRKQYETRLQALRQSAAKMKAKTQKAKAL

SEQ ID NO: 536 - protein, 514 aa, Escherichia coli K12
MKIRSQVGMVLNLDKCIGCHTCSVTCKNVWTGREGMEYAWFNNVETKPGIGYPKNWEDQEEWQGGWVRDVNGKIRPRLGNKMGVITKIFANPVVPQIDDYYEPFTFDYEHLHSAPEGKHIPTARPRSLIDGKRMDKVIWGPNWEELLGGEFEKRARDRNFEAMQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEREVDLYERQCEVFLDPHDPSVIEEALKQGIPQNVIDAAQRSPVYKMAMDWKLALPLHPEYRTLPMVWYVPPLSPIQSYADAGGLPKSEGVLPAIESLRIPVQYLANMLSAGDTGPVLRALKRMMAMRHYMRSQTVEGVTDTRAIDEVGLSVAQVEEMYRYLAIANYEDRFVIPTSHREMAGDAFAERNGCGFTFGDGCHGSDSKFNLFNSSRIDAINITEVRDKAEGE

SEQ ID NO: 537 - protein, 490 aa, Xenorhabdus nematophilus
MTNHLDAVLHDSLLLRQQGYIDGKWLDADNKATFAVTNPATGDIIANVSDMGAAETHRAIKAAEKALPAWRDLTAKKRSQILRQWFNLVIDNQKTLAELLSIEQGKSHAEAMGEIAYGASFIEWFAEEGKRIYGETIPSPMPGCRTSTIKQPIGVVAAITPWNFPNAMITRKVSPALAAGCTVVLKPAAETPLSALALVVLAEQAGVPAGVFNIVTGMDAKAIGEALTSSPIVRKLSFTGSTRVGKLLMAQSADTVKKLSLELGGNAPFIVFDDADLDAAVKGAMAAKFRNSGQTCVCANRILVQENIYEAFAERLAQAARELHVGPASDSSSQQGPLINQAAIDKVQAHVSDAVSRGARLLTGGKSHKLGGLFFEPTVLADIDETMQVAHEETFGPLAALFKFRDEEEAIRIANSTEYGLAAYFYSRDIGRIYRVAEALESGMVGINEGLISNEAVPFGGIKQSGLGREGSRYGIEDYLEVKYLCFGGL

SEQ ID NO: 538 - protein, 574 aa, Bacillus subtilis subsp. subtilis str. 168
MAHKTAGQAMTELLEQWGVDHVYGIPGDSINEFIEELRHERNQLKFIQTRHEEVAALAAAAEAKLTGKIGVCLSIAGPGAVHLLNGLYDAKADGAPVLAIAGQVSSGEVGRDYFQEIKLEQMFEDVAVFNREVHSAESLPDLLNQAIRTAYSKKGVAVLSVSDDLFAEKIKREPVYTSPVYIEGNLEPKKEQLVTCAQYINNAKKPIILAGQGMKKAKRELLEFADKAAAPIVVTLPAKGVVPDKHPHFLGNLGQIGTKPAYEAMEECDLLIMLGTSFPYRDYLPDDTPAIQLDSDPAKIGKRYPVTAGLVCDSALGLRELTEYIERKEDRRFLNACTEHMQHWWNEIEKDETEATTPLKPQQVVARLQEAAADDAVLSVDVGTVTVWMARHFKMNANQDFIVSSWLATMGCGLPGAIAASLSEPERQAIAVCGDGGFSMVMQDLPTAVKYKLPITVVILNNENLGMIEYEQQVKGNIDYVTKLQNVDYAAFAESCGAKGIKVTKAEELAPAFHEALHSDQPVVVDVMIGNEPPLPGKITYGQAKGFSKYMLKNFFENQKFEMPSLKKSLKRLF

SEQ ID NO: 539 - protein, 360 aa, Pseudomonas putida KT2440
MSKQILILPGDGIGPEIMAEAVKVLELANDKFQLGFSLAHDVIGGAAIDKHGVPLADETLERARKADAVLLGAVGGPKWDKIERDIRPERGLLKIRSQLGLFANLRPAILYPQLADASSLKPEIVSGLDILIVRELTGGIYFGAPRGQRELEGGERQAYDTLPYSESEVRRIARVGFDMARVRGKKLCSVDKANVLASSQLWREVVEDVAKDYPDVELSHMYVDNAAMQLVRAPKQFDVMVTDNMFGDILSDEASMLTGSIGMLPSASLDADNKGMYEPCHGSAPDIAGLGIANPLATILSVSMMLRYSFNQSAAAEAIEKAVSLVLDQGLRTGDIFSEGCRKVGTQEMGDAVVAALRNL

SEQ ID NO: 540 - protein, 287 aa, ASPERGILLUS NIDULANS FGSC A4
MASPSQAAPSTQPLTPPAEPSSTNNATTTNTTAAPSQQPTQPTSAPTTTPAPASQPAQIPSTSLKDSGKSRRPRDVRLIHMLLAAQGVTAYQERVPLQLLDFAYRYTSGVLQDAVHLTTEGYAGTGADTTTSSGNKGPPEVNSVTLPALRLSIASRLHYQFQTGLPKEFLMDVAAERNRVALPGATRGFDAGAGKPAASNSVLMAGMRLPPERFCLTGTGWKMSDEWESEGEEDIAAPEEKNDVMAGAEREEGEGEGDEDEDGKMEDIFGEDAVMGDDDGDKDMTDV

SEQ ID NO: 541 - protein, 553 aa, Glycine max
  unsure (1)..(553): unsure at all Xaa locations
KTRLRTQRVCEFLFLLFQRPNPLISTYTFIIIPTTVQKQLHWPFVLVSISKSTTTPSLLFSIIIISTPFTLSHSSLESSTAMATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTXTKDGWYPPGHGDVFPSLLNSGKLDALLSQGKEYVVCCQFRXLGMHIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKISIVANPGVKLEVPDGAVISDKEINGPEDLL

SEQ ID NO: 542 - protein, 380 aa, Eremothecium gossypii
MDINHITNPTVTKQVYKGHGAPGAEEVVEITYPATEVVGHGSFGVVFTTVIEQTGEKVAIKKVLQDRRFKNRELEIMKLLQHPNVVDLRYHFYESEPQTNEVYLNLILEYMPQSLYQRLRHFVTGRLLMPRDEIKVYMFQLFKSLNYLHRVARVCHRDIKPQNLLVDAGTLQLKLCDFGSAKQLRPTEPNVSYICSRYYRAPELIFGATNYTTQIDIWSTGCVMAELLLGQPMFPGEFVIVQLAEIIKILGTPTRQEICAMNENYSDHKFPQIKPIPLSKVFKREDAHTVQLLSDVLQYDPTRRFNALMAMCSSYFDEITGHNTEPETVAPGASISELWQGVVHSLQLLHFKPEEFNDLNDLERSLIQNKLIAKQPPNVP

SEQ ID NO: 543 - protein, 76 aa, Zea mays
  unsure (1)..(76): unsure at all Xaa locations
RPRVRFPSLNNSGNTXTMTSMXQAYFWEGNLHKMGAIDYITILNHRINNQNEVCMEDTPKMLDDVNGGSLIFYKGI

SEQ ID NO: 544 - protein, 185 aa, Triticum aestivum
  unsure (1)..(185): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGYYDGRYWXTMWKLPMFGXAPDATQVINEVEESKKEYXDAYVRIIGFDNMRXVQCVSXIASKQRGCKIRKAKQSSRQAY

SEQ ID NO: 545 - protein, 427 aa, Halobacterium sp. NRC-1
MTADPGDRVRVTHGDASHEGVLVPSPSDDHLVVKLDSGYNVGVDTADADIDVLDADAVTVDGDTGEDAAGSTVEFDDDLPTIALISTGGTIASTVDYRTGAVTAQFDAEDVLRAVPDLAGRANYRGRVVANILSENMEPSIWQDLAAAVREEIEAGADGVVVMHGTDTMQFSASALSFMLETPVPVVFTGSQRSADRPSSDNVMNAVCAVEAAKSDVAEVMVCMHATESDDRCALHRGTRVRKTHTSRRDAFETVGATPLGYVDYDAASEAATADARGVTVEGAHAARGDATLDVASALEPAVELVKFTPGMNESLLAACEGSAGVVIEGTGLGHVHSDLTDTIGSLVDDGTTVVMTSQCLEGRVCDRVYDTGRDLLAAGVVEAGDTLPGTAKVKLMWALANADDPEAAMQESVAGALTTQSRPWTA

SEQ ID NO: 546 - protein, 369 aa, Persea americana
MAPTIVPFLPTTTEEKTLRQNFVRDEDERPKVAYNQFSNDIPIISLAGIDSEDGRAEVCKKIVEACEDWGVFQVVDHGVEAGLISEMTRLAREFFTLPAEEKLRYDMSGGKKGGFVVSSHLKGEAVQDWREIVTFFSYPIRSRDYSRWPDKPEGWKEVAQVYSDKLMGLACKLLEVFSEAMGLEKEALTKACVDMDQKMVVNFYPKCPQPDLTLGLKRHTDPGTITLLLQDQVGGLQATKDGRQTWITVQPVEGAFVVNLGDHGHFLSNGRFKNADHQAVVNSNFSRMSIATFQNPAPEAIVYPLAIREGEKPILDEPMTFAEMYRKKMSRDLELANLKKQAKEQQHQQEAEKASLVTIQAKALDDILA

SEQ ID NO: 547 - protein, 332 aa, Anabaena variabilis
MTKNLLEQLREMTVVVADTGDIQAIEKFTPRDATTNPSLITAAAKMPEYQEIVDQTLLQAKKDAGAGASKGQIVSLAFDRLAVSFGLKILQIIPGRVSTEVDARLSYDTEATITKARELIAQYKAAGIGPERVLIKIASTWEGIKAAEILEKEGIHCNLTLLFGLHQAIACAEAGITLISPFVGRILDWYKKETGRDSYPSAEYPGVISVTTIYNYYKKFGYTTEVMGASFRNIGEITELAGSDLLTISPGLLGELQATIGELPRKLDPAKAATLDIEKISIDKATFDKMHAADRMAYDKLDEGIKGFSKALEELETLLAERLARLEVVASH

SEQ ID NO: 548 - protein, 484 aa, Actinobacillus actinomycetemcomitans
MSAKCPFDHNSATLTTAAGAPVVDNDNTMSAGPRGPLLLQDVWYQEKLAHFARERIPERVVHAKGSAAFGTFTVTHDITQYTKAALFSEVGKQTEVLLRFSTVAGERGAADAERDVRGFSLKFYTEQGNWDLVGNNTPVFFIRDPLKFPDFIHTQKRNPQTNLRDATAAWDFWSRHPESMHQIMILFSDRGIPASLRNMNGYGSHTYSFINADNERFWVKFHFKTQQGHKFLTNAEAAKVVGEDRESSQRDLYDAIANGNFPRWNVRIQIMPEADAEKHNYSFDLTKVWPHKDYPLIDVGVLELNRNPQNYFAEVEQAAFAPNNNVPGIGFSPDRMLQGRLFSYQDAQRYRLGVNHHQIPVNAPKCPYHTTHRDGAMRVDHNGGTHPNYAPNRFDTYVPTHDQGPSLQLEREGAHFNFRDYDEDYYSQPAALYAIMDAAQRDRLAGNFAASLAEVTDDAIVEHQLVHFERVNTELANAIRTKLA

SEQ ID NO: 549 - protein, 352 aa, Medicago sativa
MASSINGRKPSEIFKAQALLYKHIYAFIDSMSLKWAVEMNIPNIIQNHGKPISLSNLVSILQVPSSKIGNVRRLMRYLAHNGFFEIITKEEESYALTVASELLVRGSDLCLAPMVECVLDPTLSGSYHELKKWIYEEDLTLFGVTLGSGFWDFLDKNPEYNTSFNDAMASDSKLINLALRDCDFVFDGLESIVDVGGGTGTTAKIICETFPKLKCIVFDRPQVVENLSGSNNLTYVGGDMFTSIPNADAVLLKYILHNWTDKDCLRILKKCKEAVTNDGKRGKVTIIDMVIDEKKDENQVTQIKLLMDVNMACLNGKERNEEEWKKLFIEAGFQHYKISPLTGFLSLIEIYP

SEQ ID NO: 550 - protein, 362 aa, Eremothecium gossypii
MFRNTLSHITKRGYAAGREQLLPKKYGGRYTVTLIPGDGIGKEVTDSVVQIFEAENVPVDWESVELSALEENHEGVQKAVESLKRNKVGLKGIWHTPADQTGHGSLNVAFRKQLDIFANVALFKSFPGVKTKLQDVDLVIIRENTEGEYSGLEHESVPGVVESLKIMTKAKSERIARFAFDFALKNNRKAVCAVHKANIMKLGDGLFRNTVSEIGAKEYPEVNVSSIIVDNASMQAVAKPHQFDVLVTPNLYGSILGNIGAALIGGPGLVPGANFGREYAVFEPGCRHVGLDIKGQDVANPTAMILSSTLMLRHLGLNEYADRISRATYETIAEGKRTTKDIGGTATTTEFTNAVIDKLATL

SEQ ID NO: 551 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 552 - protein, 477 aa, Hebeloma cylindrosporum
MVNVTYDDSGSLVAYTPDGTPIVYNLGDMAWIAASMALVWIMIPGVGLFYSGLLRRKNALSMIWTSLASIAVVSFQWFFWGYSLAFSETGNAFIGDLKYFGLKGVLDQPSIGSSRIPAILFCIYQLMFAAITAALAVGAIAERGRLGPLLVFIFVWSTIVYDPIANWTWNTNGWSFILGGLDFAGGTPVHISSGTAALAISIFLGKRRGYGTERLAYKPHNTTYVILGTVFLWFGWFGFNGGSALSANLRAIQACIVTNLAASVGGLTWMLWDYRIERKWSAVGFCSGAVSGLVAITPASGFVGAPAAVAFGVLGGTACNFATQLKFVLGYDDALDIFATHAIGGIVGNLLTGLFAQASVAGFDGITEIPGGWLDRHYIQLAHQLADSVAGFAYSFVMTTIILWVMHIIPGLTLRTTEEAEILGVDDAEMGEFAYDYVGIDQEIGHTLDTGLTATGGGREPDHAKAVSTSSVEEKSA

SEQ ID NO: 553 - protein, 441 aa, Ahnfeltiopsis gigartinoides
  unsure (1)..(441): unsure at all Xaa locations
PQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSIAASGEVKGHYLNVTAATMEDMNERAEFAKQLGSIXXMIDLVIGYTAIQSMAIWARKNDMILHLHRAGNSTYSRQKSHGMNFRVICKWMRMAGVDHIHAGTVVGKLEGDPLMIKGFYNTLLLPYLEVNLPQGIFFEQDWASLRKVTPVASGGIHCGQMHQLLDYLGIDVILQFGGGTIGHPDGIQAGAIANRVALETXXLARNEGRDYVTEGPQILQDAAKTCGPLQTALDLWKDITFNYTSTDTADFVETPTANV

SEQ ID NO: 554 - protein, 602 aa, Pseudomonas aeruginosa UCBPP-PA14
MVFLIAAVFMVPLAKRLQLGAVLGYLLAGVLIGPSVLGLVDNPESVAQISEMGVVLLLFIIGLELSPRRLWVMRKSVFGVGLLQVLLTGVVIGTVALVGFDQPVNSAVVLGLGLALSSTAFGLQILAERKELTQPHGRLAFAILLFQDIAAIPLIAMIPLLSGAHSDAGGSELTQTLKVVGSIAAVVVGGRYLLRPVFRIVAQTKLQDMSTATALLVVMGTALLMELAGVSMALGAFLAGLLLADSEYRHELEAQIEPFKGLLLGLFFISVGMSADISLLLKSPWMVLGLTVLLIALKAPVLYFVGRISGGLDKASALRLGVVLAAGGEFAFVVFKMARDQGLFQNDLHNLLVLSITLSMALTPLLVLGLARLLAKEPEATKPPPEMERIDNDDTPRVVIAGVGRMGQIVARVLRAQRVPFIALDTSVETIELTRTLGAIPIFYGDPMRPEILRAAQVEKAEFFVIATDDPETNIETAKRVRKLYPHLKIIARARNRQHVHLLLDAGVEPVRETFFSSLEMSRMVLCGLGLSEEQADARIRRFRRHDEEVLASQHLFYNDRDALIKSAREARVELETLFQTDQLEDRGAVAAETPEKPSRAS

SEQ ID NO: 555 - protein, 728 aa, Aspergillus fumigatus
MRLTFIPSLIGVANAVCPYMTGELNRRDEISDGDAAAATEEFLSQYYFNDNDAFMTSDVGGPIEDQNSFSAGERGPTLLEDFIFRQKIQRFDHERVPERAVHARGAGAHGVFTSYGDFSNITAASFLAKEGKQTPVFVRFSTVAGSRGSSDLARDVHGFATRFYTDEGNFDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPEWELGVQIMDEEDQLRFGFDLLDPTKIVPEEFVPITKLGKMQLNRNPRNYFAETEQVMFQPGHIVRGVDFTEDPLLQGRLFSYLDTQLNRHGGPNFEQLPINQPRVPVHNNNRDGAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEGASTLRDRLKDDGVDVVLVAERLADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 556 - protein, 304 aa, Synechococcus sp. PCC 7942
MNDFLPYAFFRGQLVPFPEAQLSIATHALHYGTGAFGGLRGIPDPENPDRVLLFRLDRHCQRLSQSAKFLHFELSAEEIFKAIEAFVQKNQPSQSFYIRPFVYTSDLGIAPRLHNIEKDFFIYGLQLGDYLSPEGVSCRISSWYRQEDRSLPLRGKISGAYIASSLAKTEAVASGFDEAILMNSQGKVCEATGMNLFMVRNGRLITPGYDQDILEGITRDSVIRVAQDLGIPVDQRPIDKSELFIADEVFLSGTAAKVTPVKQVENYLTPCDRPITDQIRQQLTLITEGRLAAYQDWVFPIALR

SEQ ID NO: 557 - protein, 371 aa, Magnetospirillum magnetotacticum
  unsure (1)..(371): unsure at all Xaa locations
MKALLPVAEALDRILAAIPGPVEAEDIPIAQAAGRTLAADLAASRTQPPFPASAMDGYAVRAADLATSPARLRLIGTSAAGHGFSGMLGPGETVRIFTGAPVPAGADAILIQENAEADGETVTALEPVAPGRFLRRAGLDFREGETLLQAGDTLDARRLALAASAGHATLPVRRKPRIAVLATGDELVRPGEPAAWDQIVASNGLALSALSLEAGAEPIDLGIVPDDLDSLRGAIGRARSAGADLLVTLGGASVGDHDLVQAALGAEGLELGFWRVALRPGKPLMHGRASDPXERVILALACAIPVSSIVCGLLFVVPAIRALLGDPRAARIARAASWPRMPENDGRQDYLRYPPSTRRPNFCRWPIRRRA

SEQ ID NO: 558 - protein, 552 aa, Emericella nidulans
MRVLPATLLVGAATAATPAQQVLGGLQDFGNAVQDAMHENLPKINKPLEAFQEQLKSLYEAREFWEEVANAFPQNLDHNPVFSLPKKHTRRPDSHWDHIVRGADVQSVWVTGENGEKEREIEGKLEAYDLRIKKTDPSSLGIDPDVKQYTGYLDDNENDKHLFYWFFESRNDPKNDPVVLWLNGGPGCSSLTGLFMELGPSSIDENIKPVYNPYAWNSNASVIFLDQPVNVGYSYSGSTVSDTVAAGKDVYALLTLFFKQFPEYAEQDFHIAGESYAGHYIPVFTSEILSHQKRNINLKSVLIGNGLTDGLTQYEYYRPMACGEGGYPAVLDESSCRSMDNALGRCQSMIESCYNSESAWVCVPASIYCNNALLAPYQRTGQNVYDVRGKCEDESNLCYKGMGYVSEYLNKPEVRAAVGAEVDGYDSCNFDINRNFLFHGDWMKPYHRLVPGILEQIPVLIYAGDADFICNWLGNKAWTEALEWPGHKEFAAAPMEDLKIVDNEHTGKKIGQIKTHGNFTFMRLYGGGHMVPMDQPEASLEFFNRWLGGEWF

SEQ ID NO: 559 - protein, 371 aa, Oryza sativa
MASEVEDDAAAVLTNGGAGAAEVRRRRDQAKEILSKQAVKIATKAEEHERFIFKVTHLLGVLGFGTFCYLLGARPQDVPYVYCLFYVIFVPLRWIYYRYKKWHYYLLDFCYYANTFLLVMILFYPKDEKLFMVCFSFAEGPLAWALIVWRCSLVFSSFDKLVSVLIHLLPGIVIFTIRWWNPQTFAAMHPEGRAARVTWPYVEDKSYLWTWLFAVPLAAYTLWQLMYFLIVNVLRRQRLLKDPEVMTSYRELSKKAQKANNIWWRLSGLLGDRNRPLMYILLQALFTVATMALTVPIFLSFQMHVVFQILKVCASTWNGGSFILEVMPRQVVQKEKKKLEMKPMEEANSSQNAEESQGDLSANGQHSSEHS

SEQ ID NO: 560 - protein, 507 aa, Oryza sativa
MGKAAAVGTAVVVAAAVGVAVVLARRRRRRDLELVEGAAAERKRKVAAVIEDVEHALSTPTALLRGISDAMVTEMERGLRGDSHAMVKMLITYVDNLPTGNEQGLFYALDLGGTNFRVLRVQLGGKEKRVVQQQYEEVSIPPHLMVGTSMELFDFIASALSKFVDTEGDDFHLPEGRQRELGFTFSFPVSQTSISSGTLIKWTKGFSINDAVGEDVVSELGKAMERQGLDMKIAALVNDTVGTLAGGRYADNSVVAAIILGTGTNAAYVENANAIPKWTGLLPRSGNMVINTEWGSFKSDKLPLSEFDKAMDFESLNPGEQIYEKLISGMYLGEIVRRILLKLAHDAALFGDVVPSKLEQPFVLRTPDMSAMHHDSSHDLKTVGAKLKDIVGVPDTSLEVRYITSHICDIVAERAARLAAAGIYGVLKKLGRDKMPKDGSKMPRTVIALDGGLYEHYKKFSSCLESTLTDLLGDDVSSSVVTKLANDGSGIGAALLAASHSQYAEID

SEQ ID NO: 561 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGRPWHVFENPKTGQKITIKDVIADAFLQQILLRPAECSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 562 - protein, 68 aa, Glycine max
  unsure (1)..(68): unsure at all Xaa locations
REGSYKWDDNPQTGNYEYKTTTLVLXVRVMLGAWGANTGSIFTGGAIGYRKGFTWAAPDRIQQGIGFG

SEQ ID NO: 563 - protein, 388 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRGNSEDIYAGIEWKADSADAKKVIKFLREEMGVKKIRFPEHCGIGIKPCSEEGTKRLVRAAIEYAIANDRDSVTLVHKGNIMKFTEGAFKDWGYQLAREEFGGELIDGGRWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 564 - protein, 257 aa, Glycine max
  unsure (1)..(257): unsure at all Xaa locations
MEDIGPNSCTRPVTEKKARPQEQLNCPRCSSTNTKFCYYNNYSLTQPRYFCKTCRRYWTEGGSLRNVPVGGGSRKNKRVTSSKVPDLNPPISLSSVSAISSQNPKMQGVHDLNLAFPAAMDKYHHGTSPYVEMPKLEIGGDHSTSHHSHHHSHSPSSAVELLRSGMDSRGLNPYAPNSLMSGSDHSLYTPGYPMXEIKPNLSFSVDDGFGNRSYGVQENGGGRLLFPFGDIKHLSAGLEVEHNKEQGNNSTGYWTGW

SEQ ID NO: 565 - protein, 517 aa, ASPERGILLUS NIDULANS FGSC A4
MLFLSVLLAFAAYLLIYQYAMTNWNHARRARLWGCSPLPRYPTDILGLATLRESLKADKEKKIPLLLQNRLKRMSAREKRPVTTFVIRQMGLDNIFTCDHGNVQAILATKFKNFELGVGRRHTLYPMFGVGIFTSDGETWSRSRALLRPQFTRDQISDLDLEESHVQQAMRAMNVDPATGWTSSIDIQAIMFRLTIDSATEFLFGESAGSQAEALRNGGTLPLNHFSGDFDLGQWYVAQRSRFEKFYWLVDNRESRAVVKRVHEYVDRFVHAVLTTAEDRIEKSQSSSYVFLEALAASTKDPIELRSQLLNILLAGRDTTASLLSWSILMLARYPEVFTKLRSVILADFGSYTSSRDKITFASLKSCRYLQYFLNEVLRLYPAVPINRRVATTATTLPKGGGPAGDKPIYLRAGQVVTYSPFVTHRRTDLWGEDAEVFNPERWVNKKVGWEYLPFNGGPRVCIGQQFALTEAGYVIVRLLQRFDAIMDCFPEREIRYGLTLTLAPADGVFVRLHAAE

SEQ ID NO: 566 - protein, 462 aa, Streptomyces coelicolor A3(2)
MKAHDGMYIDGAWRPADGRDTIDVVNPVDEQVIGKVPAGSALDVDTAVRAARAALSGWAATPPAERAARLAALRDVLVARKDEIAETVTAELGSPLKFSQAVHAGAPIAVAGSYAELAATHAFEEKVGNSVVHHEPVGVVGAITPWNYPLHQIVAKAAPALAAGCTMVLKPAEDAPLVAQLFAEAVHEAGIPAGVFNLVTGLGPVAGQALVEHPGVDLVSFTGSTAVGRRIGATAGAAVKRVALELGGKSANVILPSADLAKAVNVGVANVMSNSGQTCSAWTRMLVHRDQYDEAVSLAAEAAAKYGDRIGPVVNAEQRERVRGYIGKGVAEGARLVAGGPEAPREQGYFVSPTVFADVTEEMTIAQEEIFGPVLSILRYEDEDDALRIANGTVYGLAGAVWAGDEADAVAFARRMDTGQVDINGGRFNPLAPFGGYKQSGVGRELGAHGLTEYLQTKSLQF

SEQ ID NO: 567 - protein, 332 aa, Zea mays
MAGIRWPPEDPEIFPSRMVSGGAWVPVAPPGEMASDDDRSVAADSWSIKSDYGSTLDDDQRYSDTAEVLLASSSASSVAAPSTTVAVHPSSDFSFDKDVHDSSYVEPPLLGLQNFQDGAYAEDLANFHERSHADDWFGTDIMDIRVGWTKNLCSSRDLPSCSVLDIGTGSGRLLQQLAKQGFSDLTGIDYSESAIELARSLAIGDGFEHINFLVDDVLESKLERRFELVMDEGTLDAIGLHPDGPVKRMMYWQSVDSLVSRGGILVITSCSRTKDELVQEVENFNQRKLGAVGSGSEGLPASEAAVFSYLDHVQSYPSVDSSCITTVALLHK

SEQ ID NO: 568 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 569 - protein, 449 aa, Pterocladia lucida
VLALFRVSPQPGVDPVEASAAVAGESSTATWTVVWTDLLTACDLYRAKAYKVDPVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIASTGEIKGHYMNVTAATMENMYERAEFAKQIGTVIIMIDLVVGYTAIQTMAIWARRNDMILHLHRAGNSTYSRQKIHGMNFRVICKWMRMAGVDHIHAGTVVGKLEGDPLMIKGFYNTLLLTHLEVNLPQGIFFEQDWASLRKVTPVASGGIHCGQMHQLLDYLGDDVVLQFGGGTIGHPDGIQAGATANRVALEAMVIARNEGYDFVAEGPQILRDAAKTCGPLQTALDLWKDISFNYTSTDTADFVETPTANV

SEQ ID NO: 570 - protein, 348 aa, Rosa hybrid cultivar
NQKWSNGEHSNELLHAQAHIWNHIFSFINSMSLKSAIQLGIPDIINKYGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIIDDCKGVFEGLESLVDVGGGTGTMAKAIADAFPHIECTVLDLPHVVADLQGSKNLKYTGGDMFEAVPPADTVLLKWILHDWNDQECIKILKRSRVAITSKDKKGKVIIIDMMMENQKGDEESIETQLFFDMLMMALVGGKERNEKEWAKLFTDAGFSDYKITPILG

SEQ ID NO: 571 - protein, 201 aa, Ralstonia metallidurans
MRDRPRRSAALLNEDCRSMTMHRIAPSILSADFACLGDEVRGVIAAGADWIHFDVMDNHYVPNLTIGPAVAKALKPHTRRADGSSAPLDVHLMVHPVDTLAAEFAQAGAGLISFHPDASVHVDRTLQLIRGAGCKAGLAFNPAAPLDVLDWTLDKIDLVLIMSVNPGFGGQSFIDSALRKIESARRLIDQSGRDIRLQVDG

SEQ ID NO: 572 - protein, 389 aa, Synechococcus sp. PCC 7942
MKAMILAAGKGTRVRPITYTIPKPMIPILQKPVMEFLLELLKEHGFKEVMVNVSHLAQEIESYFRDGQRFGVEVAYSFEGRIEDGQLIGEALGSAGGMKRIQDFSPFFDDTFVVLCGDALIDLDLTEAVRWHKEKGALATIVMKTVPREEVSSYGVVVTDSDGRIQAFQEKPSVEEALSTTINTGIYIFEPEILNYIPSGQEYDIGGDLFPKLVETGAPFYGISMDFQWIDIGKVPDYWQAIRSVLNGEVRNVAIPGKQVRPGVYTGLNVAIDWDSVAIEGPVYIGGMTRIDEGVRIVGPAMIGPNCHICKGATIENSVIFEYSRLGSGVRLVDKLVFGRYCVDRNGNAIDVQAAALDWLITDARRAEPVQPSAEHQAIADLLGSNVLP

SEQ ID NO: 573 - protein, 494 aa, Glycine max
  unsure (1)..(494): unsure at all Xaa locations
YHHRPVLALRGDPPHGQDKFVQVEGGFACARDLVQHIRAKYGDYFGITVAGYPEAHPDVIESDGLATPEGYRNDLAYLKSKVDAGADLIVTQLFYDTDIFLKFVNDCRQIGITCPIVPGIMPINNYKGFIRMTGFCKTNIPADIMAVLEPIKDNEEAAKAYGIHLGTEMCKKILAHGIKTLHLYTLNMEKSALAILMNLGLIEESKVSRSLPWRRPANVFRVKEDVGPIFWANRPKSYISRTIGLDQYPHGGWGDSCNPSYGALSDYQFMRPRARDKKLVEEWAVPLKSVEDIYERFRLYCLGKLRSNPWSELDGLQPETKIINEQLEKINTKGFLTINSQPAVNGEKSDSPYCXGWGGPGGYVYQKAYVEFFCSKEKLDALVDKCKDRTSLTYMAVNKDGSWKSNVGQTDXNAVTWGVFPAKEIIQPTIVDPVSFNVWKDEAFEIWSRGWASLYPEDEASRKLVEEVGGSHFLVSLVDNDYINGDLFAVFADF

SEQ ID NO: 574 - protein, 412 aa, Archaeoglobus fulgidus DSM 4304
MQYEKVKPPENGEKIRYENGKLIVPDNPIIPYFEGDGIGKDVVPAAIRVLDAAADKIGKEVVWFQVYAGEDAYKLYGNYLPDDTLNAIKEFRVALKGPLTTPVGGGYRSLNVTIRQVLDLYANVRPVYYLKGVPSPIKHPEKVNFVIFRENTEDVYAGIEWPRGSEEALKLIRFLKNEFGVTIREDSGIGIKPISEFATKRLVRMAIRYAIENNRKSVTLVHKGNIMKYTEGAFRDWGYEVAKQEFGEYCITEDELWDKYGGKQPEGKIVVKDRIADNMFQQILTRTDEYDVIALPNLNGDYLSDAAAALIGGLGIAPGSNIGDGIGVFEPVHGSAPKYAGQNKVNPTAEILTGALMFEYIGWKDASEMIKKAVEMTISSGIVTYDIHRHMGGTKVGTREFAEAVVENLQSL

SEQ ID NO: 575 - protein, 218 aa, Ipomoea batatas
MGRGKVEIRRIEKSTNRRVTFWKRRNGLLKKAMEMGILCDAEVGLMIFSSTGKLHEFATTSIRSVIERYNKTQGDSLQSPLDPTLELKFWQIEVAILRQQLHNMQEDHRKVMGEVYGLSVKDLQNLENQLEMSLSGIRMKKEQILIEQIQELTHKQGSFVHQENFELFNKFQAYGTSDPNAVNGDTISPYDFTISEESQGHIHFQLPQNFSDLARALY

SEQ ID NO: 576 - protein, 483 aa, Tuber borchii
MNDPDHLNYVPLVPFNGTKPFGGDSLTQDLNIWYESGNVAWVMTSTALVLLMIPGVGFFYSGLARRKSALSLIWLSMMATAVVSFQWFLWGYSLAFSHTGGRFIGNLDNFGFKGLLGYPSIGSEKIPDLLFALYQGMFSAITVALAIGAAAERGRMLPCVVFMFVWATLIYDPIACWTWNSSGWSFRMGGLDFAGGTPVHISSGSAALAYSLMLGKRRGHGTHELNYRPHNVTHIVLGTVFLWVGWFGFNGGSALSGNMRAVMACVVTNLAASVGGITWCLLDYRLEQKWSTVGFCSGVIAGLVAITPGSGYVPSWAAVIYGVVGGAACNYATKLKFVIGVDDALDIFAEHGVGGIVGNILTAFFAADYIAHLDGSTEINGGWLNGHYKQLGYQVADSVAGFAYSFGGTCIILFIMNLIPGLSLRATEEAEILGIDDAELGEFAYDYVELTREVISDDDTVPKMSSENNASVELPAERAEKSA

SEQ ID NO: 577 - protein, 585 aa, Zea mays
  unsure (1)..(585): unsure at all Xaa locations
IRLELKDVEKSFTGVTESLSSLRSKFESLPSGVLIIGSHTQMDSRKEKAHPGGFLFTKFASSSQTLFDLFPDSFGSRWLHERSKESPKAMKHLNKLFPNKILIQLPQDEALLTDWKQQLDRDVETLKAKSNIGSIRTFLSRNGIECNDIEELFIKDQSLSNENVDKIVGYAVSYHLKHNKIETSNSKDNKLVLTSESLKHGLNMLQSMQSDNKSSKKSLKDVVTENEFEKRLLVDVIPPNDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVIFIDEVDSMLGRRENPGEHEAMRKMKNEFMVNWDGLRTKDKERVLVLGATNRPFDLDEAVIRRFPRRLMVNLPDASNREKILKVILAKEELGSDVDLDSLANMTDGYSGSDLKNLCVTAAHYPIREILEKEKKVHNVVSAFDYPSQQGAVICFSVKXCLHWVAEFHCVQEKSLAKTEGRPEPALYGSEHIRPLSIDDFKSAHEQVCASVSSDSANMNELLQWNDLYGEGGSRKRKALSYFM

SEQ ID NO: 578 - protein, 195 aa, Daucus carota
SKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYDQIKAAIKEESEGKLKGILGYTEDDVVSTDFVGDSRSSIFDAKAGIALNDNFVKLVSWYDNEWG

SEQ ID NO: 579 - protein, 284 aa, Oryza sativa
  unsure (1)..(284): unsure at all Xaa locations
LTPKTKKKTSSGYTSDRLRDLQAFDDTKAGVKRLVDAGVTTVPDFFHHQPDPLTTTKHQICLPIAAPSAAAIPLIDLAKADVDRGRVVAEVRVATETVGFFQVVNHDVAKELTDAMLAAVRYFHEEPLEAKAPYYTRDVGSKVRFSSNYDLFRPPAANWRDTLFMEMAPEGPSPEEIPPPCRGVAEEYXRRLGEWLFELLSEALGLPAGYLGLDAGCKDGLGGAANYYRPCPELEATMGTTRQSDPSFLTVLLQDTSGGGFCFFRRLLGGGGHIPPGKKNPGFL

SEQ ID NO: 580 - protein, 219 aa, Brassica napus
MSSDEEGGEEYLFKIVIIGDSAVGKSNLLSRYARNEFNAHSKATIGVEFQTQSMEIEGKDVKAQIWDTAGQERFRAVTSAYYRGAVGALVVYDISRRSTFESVARWLDELKTHSDTTVARMLVGNKCDLDNMRAVSVEEGKALAETQGLFFMETSALNSTNVKTAFEMVIRDIYANFSRKQLNSDMHKTELKWNSRVSLVKDDNKGSKQGSGFSCCSSS

SEQ ID NO: 581 - protein, 447 aa, Calliblepharis fimbriata
ALFRVTPQPGVDPVEASAAVAGESSTATWTVVWTDLLTACDLYRAKAYKVDAVPNTSDQYFAFIAYDIDLFEEGSIANLTASIIGNVFGFKALRALRLEDMRIPVAYLKTFQGPATGVISERERMDKFGRPFLGATVKPKLGLSGKNYGRVVYEGLRGGLDFLKDDENINSQPFMRWKERYLYSMEGVNRSVAATGEVKGHYLNVTAATMEDMYERAEFAQQLGSIIIMIDLVIGYTAIQTMGIWARKNDMILHLHRAGNSTYSRQKIHGMNFRVICKWMRMAGVDHIHAGTVVGKLEGDPLMIRGFYNTLLLPYLKVNLPQGIFFEQDWASLRKVTPVASGGIHCGQMHQLLDYLGIDVVLQFGGGTIGHPDGIQAGATANRVALESMVLARNEGRDYVAEGPQILEDAAKTCGPLQTASDLWKDITFNYTSTDTADFVETPTANV

SEQ ID NO: 582 - protein, 572 aa, Oryza sativa
MSQSSPFFSVARAHAGAGGRAAAAALLLRHPVAQLPPRIHGLRYYPSAIVSPAKTLNSHLSLPHATISSFANADNGSSGQADATESEEEQNGESELSEMAKAFHISPRMAMSISVVIAFAALTVPLAMQSVVFHGTNKMKALAYLTLLSGFYMAWNIGANDVANAMGTSVGSGALTLRQAVLTAAVLEFSGAFLMGTHVTSTMQKGILVASVFQGKDSLLFAGLLSSLAAAGTWLQVASSYGWPVSTTHCIVGAMVGFGIVFGGVNAVFWSSLARVSSSWVISPLMGAAVSFIVYKGIRRFVYSAPNPGQAAAAAAPIAVFTGVTAISFAAFPLSKTFSIAILQALACGAIGAVIVNRVIQKQLGDLLSSEAEKIASADKANAQQVGFLSDIAGPTGAQLQIVYGVFGYMQVLSACFMSFAHGGNDVSNAIGPLAAALSILQGVASSAEIVIPTEVLAWGGFGIVAGLTMWGYRVIATIGKKITELTPTRGFAAEFAAASVVLFASKLGLPISATHTLVGAVMGVGFARGLNRVRAETVREIVASWLVTIPVGAVLSIFYTLLFTKILAYFM

SEQ ID NO: 583 - protein, 505 aa, Cicer arietinum
DKVPHSSSSSKVANKAIQQSNLSFSSSHLSGDKIVTLSGAGRGRCTRKHVIVTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEFLILAGDHLYRMDYEKFIQAHRETDADITVAALPMDEKRATAFGLMKIDEEGRIIEFAEKPKGDQLNAMKVDTTILGLDDERAKEMPFIASMGIYVISKNVMLDLLSDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIFHSVIGLRSCISEGAIIEDTLLMGADYYETDADKRFLAAKGSVPIGIGRNSHIKRAIVDKNARIGENVKIINSDNVQEAARETDGYFIKSGIVTVIKDALIPSGTVI

SEQ ID NO: 584 - protein, 659 aa, Schizosaccharomyces pombe
MEYYTSKEVAEWLKSIGLEKYIEQFSQNNIEGRHLNHLTLPLLKDLGIENTAKGKQFLKQRDYLREFPRPCILRFIACNGQTRAVQSRGDYQKTLAIALKKFSLEDASKFIVCVSQSSRIKLITEEEFKQICFNSSSPERDRLIIVPKEKPCPSFEDLRRSWEIELAQPAALSSQSSLSPKLSSVLPTSTQKRSVRSNNAKPFESYQRPPSELINSRISDFFPDHQPKLLEKTISNSLRRNLSIRTSQGHNLGNFGQEILPRSSRRARPSELVCPLSSLRISVAEDVNRLPRIDRGFDPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 585 - protein, 488 aa, Glycine max
TRPGFPIDEAKRGSLGKFSRMLKRLLNDLEVRQIMKAERFCEANQLPPEYVCGCGQPPAGEELVTLQNCPNPPKKLKPGTYWYDKVSGLWGKEGQKPSQIISPHLNVGGPIQQDASNGNTQVFINGREITKVELRMLQLAGVQCAGNPHFWVNEDGSYQEEGQKNTRGYIWGKAGTKLVCAFLSLPVPSKSSNSLGEQPSSLASRTMPDYLEHGIVQKLLLVGCSGARASTIFKQAKILYKSVPFSEDERENIKLTIQTNVYAYLGILLEGRERFEEESFGNLKKSQSSVLDTTGTSPKLDEKTVYSIGPRLKAFSDWLLKTMVSGKLDAIFPAATREYAPLIEELWNDAAIKATYERRSELEMLPSVASYFLERAVKILRTDYELSDLDILYAEGVTSSNGVACVEFSFPQSVSEETVDTTDRYDSLVRYQLIRVHARGLGENCKWLEMFEDVEMVIFCVSLTDYDQFFCLLMATVVSLTRCSKQKV

SEQ ID NO: 586 - protein, 496 aa, Glycine max
MGKVAVGTAVVCAAAACVAAALVVRHRTRSSGKWGRATAIAKELEEQCWTFFSKLRQVADALDVEMHAGLASEGGCKLKMLITYVDNLPSGDEKGLFYALDLGGTNFRTLRVHLGGKEKGVVKIESEEVSIPPHLMTGSSQELFDFIASKLAKFVSSEPEELHPPPGRQRELGFTFSFPVKQTSIASGTLIKWTKGFNIEDAVGEDVVGELTKSMEKIGLDMRVAALVNDTIGTLARGRFYNQDVIAGVILGTGTNAAYVECAHAIPKWHGLLPKSGEMVINMEWGNFRSSHLPLTEYDQALDAESLNPGEQIFEKIISGMYLGEIVRRVLLKLAEEVDFFGDTVPPKLRIPFVLRTPDMSAIHQDTSSDLKVVGNKLKDILEINNTSLKMRKIVVELCDIVANRGARLSAAGIFGILKKIGRDTVKDGKKSVVALDGGLFEHYTKFRSSLESTLKELLGDEAAETIGIEQSNDGSGIGAALLAASHSQYLEVQES

SEQ ID NO: 587 - protein, 315 aa, Glycine max
MMGRVMEKPSQDLLQQQQQALKCPRCESSNTKFCYYNNYSLSQPRHFCKACKRYWTRGGTLRNVPVGGGCRKNKRVKRPTNHGDSSSSAANSPSSSNSNPPSQPHLDNIIASSSTTNHINNISPFFYGGDVMSSVPFPRFNLHSQLNALGLGFSTGVSENGFSTSNNNSFFSAYNSMFGSSSSSTCAPSTPVMASLLSSTLLQQNLMGGGGGGVKGRDHDQGDNTFHGLAPLQGLRVEGDSNNNIGSKEVKGEGQNRFEWSNNNNNNNNNGGGGQNQMEHVGLSDPNSLYWNTATGLGAWSDQPNNIGPSVTSLI

SEQ ID NO: 588 - protein, 120 aa, Triticum aestivum
  unsure (1)..(120): unsure at all Xaa locations
WTNVVVAYEPVWAIGTGKVASPAQAQEVHANLRDWLKTNVSPEVAESTRIIYGGSVTGRKLQGVGAQPDVDXFLLGGXSFEPDSTDIINAATVNLPKQSTGPFRRGSKTTKMKNPFFPCL

SEQ ID NO: 589 - protein, 119 aa, Beta vulgaris
LVPGDSAGTVTAYYLSSLGSTHDEIDFEFLGNASGQPYTLHTNVFAQGKGNREQQFHLWFDPTKDFHTYSILWNPQRIVFSVDGIPIREFNNMESQGVSFPKNQPMKIYSSLWNADDWA

SEQ ID NO: 590 - protein, 780 aa, Botryotinia fuckeliana
MSLTLLTRASTSFQNWTHAHHLALTFVNQLNITEKSNIVTGTYHTSTLDGKPMNCIGNIGPIPRLNFTGICLNDGPALLLVRDLISVFPSGVTLAATWDRELVYQSYKALGEEFRGKGTHVALGPVAGPLGRHPLGGRNWEGFSPDPYLTGHLMTASITGMQSVGVQTSSKHFIGNEQETQRSNSPLPDGTNIDAISSNIDDRTLHELYLWPFADAVRAGTTSILCSYNRINETYACENPHLLNNILKGELGFQGYVVSDWFATHSGYPAANAGLDMDMPGYISQSAINTGETYFGPHLISAIQAGNMTEDRLDDMVTRIMTSYFLLNQSSNYPTPDPSQTYVMANMYGYDYGAQIPARDVRANHSSLIRQIGSAGTVLLKNTNNILPLSKPLNIGVFGNSAPDPTDGLTWPQSDLQTGFDIGTLDIGGGSGSARHTTLISPLTALRTRAATYARVQYLTNNALLSSSSSSSFAGIYPIPEICLVFLKTFSSEGVDRTSYPLDWNSTLVVNNVASFCQGNTIVITHSSGINTLPFAQNPNVSAILLAHYPGQESGNSIVDVLFGVVNPSGKLPYTIPVHESDMHIPVVNLSTSEVLAHHQSQNAWQSNFTEKLAIDYRGFEMKNVTPLYEFGHGLSYTTFNLTTPTPSIKHVTTQPITARPNPLSPILPGGNADLYTPLFTLTTRVKNTGTRTGATILQLYISLPETSTPEGTPKKVLRGFEKVEMRGGEERDVEFVLQRRDVSYWDTVLGDWVVPEGDIGVMVGFSVQDLRARVGVVVR

SEQ ID NO: 591 - protein, 550 aa, Leptosphaeria maculans
MASTMKGEGHVAERVESASAHYVTDDTNTAIDNERNMTVRQSLRFWWKAIVFSFVISLCVVMEGYDTSLMNKFFAFTPFKNRFGDQVDADGIPLVSSRWQTIILNGTQVGCILGLIINGYITEWIGYKKTMIGSMVFMTGAILIPFFSTSLEMFLVGGIIQGLPWGVFQTLAISYAADLCPIHLRGYMTSWINMCWVIGGLLSTGILTGLMKNNSQWGYRIPFALQWVWPIPIILATLLAPESPWWLVRQGRNGRSQSRDPQNHHAYSGVQFDVDSHVEMMVVTNQYEKEVGAGTNYWHLFRGSDLHRTEVSAMAFVTQALVGTTFMGFGVQFFLGVGLKQEDSFYLTVGQDCLGLIGCFIAWWIMTRFGRRPIYLTGLCAIFLILLIVGFLGLAPPTNESAGLAGGIFIVLMIFCFQLSLGPICYSLAAEIPSSRLRVKTVALSRASYNSIVFVTNTIMPKMVGRNDWNWGAKGGFFWAGIAALFIVWGYFRLPEPKGFTYSELDLLFEHRVSARKFTRERVEVLRPALGGGVGKLDEKESIERVGDGA

SEQ ID NO: 592 - protein, 215 aa, Glycine max
MARLKVLSALDTARTQYYHFKAIIIAGMGLFTDAYDLFSITLIIKIIGRVYYGHREGENRYETPPEVVSALVAVALLGTAVGQLVFGRLGDLKGRRRVYGFALLLMVFSSLASGFSICIRKTCVLLTLGFFRFFLGLGIGGDYPLSSTIMSEFANKKTRGSFIAAVFSMQGFGILASSTVTMAVCSIFGAASKNSEADVAWRLILMLGSVPAAMT

SEQ ID NO: 593 - protein, 151 aa, Zea mays
ADAHRTDLMTITRFVLNEQSKYPESRGDFTILLSHIVLGCKFVCSAVNKAGLAKLIGLAGETNIQGEEQKKLDVLSNDVFVNALVSSGRTSVLVSEEDEEATFVEPSKRGKYCVVFDPLDGSSNIDCGVSIGTIFGIYTLDHTDEPTTADV

SEQ ID NO: 594 - protein, 570 aa, Leptospira interrogans serovar lai str. 56601
MLVTGTSGPQETLSYKLHSSSWRFWNANSFVWKKIWSIFWFFKLGKIFFPSYRDTDAHEKFFRTLGEDCRNFFLSMGGVYIKLGQYLGNLSHIFPDSFTESLQDLQDRVPPHPFSEIEERFRSEFGKEIIKVFPDISNVPEASASTAQVHVASIGGQKVAVKVLYPGIETLIANDLKNIRSFLKRINRYLFRFEYKKIHDEITRLVTRETDLKLEADSYDRMRQFFVEEPDYIFPKVIRQFSGKSVLVTEFIEGVKITRATPVLKGQAKSRPVELLVRAYVLMIFQYRFYHADPHPGNLIYTPEEKLCFLDFGAVGEINSGGAYALKKIFLCAIAKDYFGVVDGLEEMGALSASADRDKLEEVVRYSLEKLGRFVADTDYFRNLSLGQIHTREDQLFLKEINSSLKEIFRMIQIPENFIFLERVLGLLVGITSILDPYRTVLDYGEKPFRTVASGKEGGLEFLLLNEDKNLLGNTLSIPGEFYKVLQNINRGKQGIQLREVERHTRKMYILGHQILYSGFLIAGIHFGNDYLEKGMEIQSWGFFTSSVIFGFILIYSFWKNKLKKKGTSL

SEQ ID NO: 595 - protein, 454 aa, Pseudomonas fluorescens
MTSWEREVSRGAGNRQLPVVKGWPLLGSALALIRNPLGFLQTTRSTYGDVYRVKAAHMNFVVLAGMEANRFVADKGKDCFVSSGFWEATLQEMQCPHSFIGVDGDAHRFQRNLMKPLFSKSAFNERIPMLAQIFTDTLQARYGVDQKVSALFRHVLSQQIGGSLQGYQPTPDEVEALMRYQNTAMNVCALKKWPRLALRLPGYRAAKKQVQALADRIIESERTQEQTQGYFQTLKEKGQMVQPQWFTPGDMRNHAIISYLAGIDTVGATLSFMLLELFKQPHLHQALRDEVDACFSQGLPDADGLENMETLKNFIREVMRLYPTAYAVRRTRRKDFEFQGYSIDKGQDIILFTTANHTDPAWFKNPQVFDITRYEEPRLEHRASGAWAPFGRGPHTCIGAGLANILLSLNLALFLYHTDLRPACKLSDIKMDFSNPAAGLSERFAISFTPRNRP

SEQ ID NO: 596 - protein, 240 aa, Pseudolarix amabilis
YTYTLGNKGPEDVIVRVIYCGICHSDLVQMRNEMGMSHYPMVPGHEVVGIVTELGSEVKKFKVGEHVGVGCIVGSCRKCGNCNESMEQYCSKRIWTYNDVNHDGTPTQGGFASTMVVDQMFVVRIPANIPLEQAAPLLCAGVTVYGPLKHFGMTESGKRCGILGLGGVGHMGVKIAKAFGLHVTVISSSDKKKEEALEVLRADAYLVSKDAEKMQEAAESLDFIMDTIPVAHPLEPYLAL

SEQ ID NO: 597 - protein, 357 aa, Pinus taeda
MGSLESEKTVTGYAARDSSGHLSPYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFAMTEPGKKCGILGLGGVGHLGVKIAKAFGLHVTVISSSDKKKEEAMEVLGADAYLVSKDTEKMMEAAESLDYIMDTIPVAHPLEPYLALLKTNGKLVMLGVVPEPLHFVTPPLILGRRSIAGSFIGGMEETQETLDFCAEKKVSSMIEVVGLDYINTAMERLEKNDVRYRFVVDVAGSELDN

SEQ ID NO: 598 - protein, 187 aa, Oryza sativa
MAVSEEKKEMQDPRTQAIASTIRVVPNFPKPGIMFQDITTLLLNPPVFKDTIDLFVERYTGKGISVVAGVEARGFIFGPPIALAIGAKFIPLRKPNKLPGEVMSKEYELEYGADCLEMHVGAVQPGERALVVDDLVATGGTLCAAIVLLERAGAEVVECACVIELPELKGRERLNGKPLYVLVESHS

SEQ ID NO: 599 - protein, 189 aa, Mitthyridium sp. Streimann 64399
GGAKKVVISAPSKDAPMFVMGVNEEKYTNEDIVSNASCTTNCLAPLAKVINDKFGILEGLMTTVHATTATQKTVDGPSNKDWRGGRSAGSNIIPSATGAAKAVGKVLPELNGKLTGMAFRVPTTDVSVVDLTVRLEKPASYDAIKAAVKEASQGKMKGILGYTEDDVVSSDFITDSQSSIFDAKAGIAL

SEQ ID NO: 600 - protein, 325 aa, Zea mays
  unsure (1)..(325): unsure at all Xaa locations
MAAAAFDAYTDKNAIFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLNKEVAKSAITDNALPSSPVTVSEASKPSDDFPEFKLSDAPAPPAENLNGKHEPKSPKSAPRSPKAATHPTFATSVKKPIGAKKVGGKTGGLGVRKLTTKPNESLYEQKPEEPKPAIPALTAPTAKGGPSLHSRFEYVDNEQSSDSRTGGSGSRVTGHVAPPKSSDFFQEYGMGNGFQKKSSNASKAQIEETDEARKKFXNAKAIS

SEQ ID NO: 601 - protein, 323 aa, Yarrowia lipolytica
GLARKTTRTISCCSEIPSDLSMPQTLTRESMQPSRTQSSSQVERGSSLRKSTASIPATLETLSQQEEAASAAASATASLVDPPHSATPSEDDMSDEQIIAMQSEAPKNWIKGTLIGQGSFGCVHLGMNSLTGELMAVKQVSLGDFSKTSHKQAMVDALQREMNLLRDFQHDNIVQYLGSSSDEEYLNIFLEYVPGGSVSSMLTKYGQFEEPLVKHFVRQILKGLDYLHSRNIIHRDIKGANVLVDNKGNVKISDFGISKKIEASSSNRQSLQGSVYWMAPEVVKQTSYTLKADIWSLGCLIVEMLTGSHPFPQFSQMQAIFKI

SEQ ID NO: 602 - protein, 126 aa, Bacillus licheniformis
CIGCHTCSVTCKNTWTNRSGAEYMYFNNVETKPGIGYPKQWENQDKYKGGWELKKGKLQLKSGAKATRLMNLFYNPYQPTIDDYYEPWNYDYETLTNSPEKKHQPVARPKSSITGDFMNLEWGPNW

SEQ ID NO: 603 - protein, 320 aa, Streptomyces avermitilis MA-4680
MSPRQITVLGECVADAFTEPANASNELALRVLPGGGPANTAVALARLGTPARFLARLSGDVFGRLFRAHLEESGVDLSYAVAAAEPSTLAVAELDATGQAAFSFHAQNTADWQWTPGELAGVDLSETACVHTGSLALVREPGGAAVEEFLAAAAPRATISIDPNVRPLLVRPEVYRARLAHWCALADILRLSEDDLELLLPGTPPEQACDIWHAAGVRLVVITLGAGGALASLDGERLRVPAVATRVVDTVGAGDSFTAGLLHHLGARGLLGGRLTDLGLDEVAEACRFGARVAALTCSVAGPNPPWRDQLAQLTTAGGA

SEQ ID NO: 604 - protein, 177 aa, Triticum aestivum
MDGGKDKGAGGYSGYPGGYPAPAGYPGYPVPVSSYPPAPGYAAPPGQYAPPPGAYPQPGGYQPPNVAYPPNGYPATAGYPQYPTAHPPAGYPAQGPPMQVPPYGHAPMYGGGGHGVAGGMVAGGAVAAGAVYGAHKVSHGGAHGMYGHGHHQGKFKHGKFKHGKFGKHKKMYGRKWK

SEQ ID NO: 605 - protein, 330 aa, Oryza sativa (japonica cultivar-group)
MSDSCKMPLPLFHRNISLLPLAANFSVIKSGVQPRCTHCSSAHPHSPRPHCLTAAAAATMPLLSSWLFHKLRRRRSAARGEPDVVEAASKKQQPPMAAAAAAAPCSPSPNRASYYFASRERCLPPARAATDNHKLRDTRFPRSPQPNDDIVFDVVAVSASPARGQFDGMKAMPELKLRPILTKRATAKNDGDEGDALDSGTSAAASPTSRVRRFVHHAKPSSGRRKGRVAALPADATSRRRRRRRRCRWLYESLVVVKESADPEEDFLESMAEMIAANDVRSPRDLEELLACYLALNAAEHHRAIVGAFRRAWLHAAAATAAPPSPSPIK

SEQ ID NO: 606 - protein, 389 aa, Escherichia coli
TLQNGKLNVPENPIIPYIEGDGIGVDVTPAMLKVVDAAVEKAYKGERKISWMEIYTGEKSTQVYGQDVWFPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 607 - protein, 321 aa, Arabidopsis thaliana
MDSDFVPPSVSFQLPVIDFSDQNLKPGSSKWDEVKADVLKALEDYGCFEAFFDKLSVELNRSVFEAMEDLFELPIPTKQRNVSSKPFHGYLCHNLYESLGIDDANVLEKVNDFTQQLWPDHGNKSISETIHLFSEQLVELDLMVRRMIMESFGIENYIDEHLNSTYYLTRLMKYTSPPDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGRIAQSALHAFAAF

SEQ ID NO: 608 - protein, 391 aa, Archaeoglobus fulgidus DSM 4304
MSDGNVAWILASTALVMLMVPGVGFFYAGMVRRKNAVNMIALSFISLIITVLLWIFYGYSVSFGNDISGIIGGLNYALLSGVKGEDLLFMMYQMMFAAVTIAILTSAIAERAKVSSFILLSALWLTFVYAPFAHWLWGGGWLAKLGALDFAGGMVVHISSGFAALAVAMTIGKRAGFEEYSIEPHSIPLTLIGAALLWFGWFGFNGGSALAANDVAINAVVVTNTSAAVAGFVWMVIGWIKGKPGSLGIVSGAIAGLAAITPAAGFVDVKGAIVIGLVAGIVCYLAMDFRIKKKIDESLDAWAIHGIGGLWGSVAVGILANPEVNGYAGLLFGNPQLLVSQLIAVASTTAYAFLVTLILAKAVDAAVGLRVSSQEEYVGLDLSQHEEVAYT

SEQ ID NO: 609 - protein, 718 aa, Bacillus licheniformis
MFQMAKRVLLSTTLTFSLLAGSALPFLPASAIYADADTAVTNKQNFSTDVIYQVFTDRFLDGNPSNNPTGAAFDGTCSNLKLYCGGDWQGLVNKINDNYFSDLGVTALWISQPVENIFATINYSGVTNTAYHGYWARDFKKTNPYFGTMTDFQNLVTTAHAKGIKIIIDFAPNHTSPAMETDTSFAENGKLYDNGNLVGGYTNDTNGYFHHNGGSDFSTLENGIYKNLYDLADLNHNNSTIDTYFKDAIKLWLDMGVDGIRVDAVKHMPQGWQKNWMSSIYAHKPVFTFGEWFLGSAAPDADNTDFANESGMSLLDFRFNSAVRNVFRDNTSNMYALDSMLTATAADYNQVNDQVTFIDNHDMDRFKTSAVNNRRLEQALAFTLTSRGVPAIYYGTEQYLTGNGDPDNRGKMPSFSKSTTAFNVISKLAPLRKSNPAIAYGSTQQRWINNDVYIYERKFGKSVAVVAVNRNLTTPTSITNLNTSLPSGTYTDVLGGVLNGNNITSSGGNISSFTLAAGATAVWQYTASETTPTIGHVGPVMGKPGNVVTIDGRGFGSAKGTVYFGTTAVTGSAITSWEDTQIKVTIPPVAGGDYAVKVAANGVNSNAYNDFTILSGDQVSVRFVINNATTALGENIYLTGNVSELGNWTTGAASIGPAFNQVIHAYPTWYYDVSVPAGKQLEFKFFKKNGATITWEGGSNHTFTTPTSGTATVTINWQ

SEQ ID NO: 610 - protein, 137 aa, Pectobacterium carotovorum subsp. carotovorum
KPGMDRSDLFNVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVKPKQ

SEQ ID NO: 611 - protein, 372 aa, Hemerocallis hybrid cultivar
STEIFSPVRIRSLAAVRQEEVKLMITGILASTSTDNSVKVNMKVVFSELMFNVIMKIIAGKRYFGVNTDSEVEEGQKFRVVFDEMFSTLEVASPQDFLPFLKWFGFKRMENRLTKLAKELDQLFQKLIEERRSERGKVQSTVIDVLLSLQETDREQYSDKLIKGMILSLIAAGTHTTAGTMEWAMSLLLNHPEALLKVRDEIDKKVGQDRLIDHSDLQNLSYLNNAIKESLRLFPTAPLLLAHESSAECTVGGFTIPSNTILFANAYALHRDPKVWTDPVSFKPERFENNGQQGSRIYVPFGLGRRSCPGEGLATQVVGLALGTLIQCFEWDRNGEEKVDMTDGSGLAMHMEKPLEAMCKPRQSIVDVINRL

SEQ ID NO: 612 - protein, 319 aa, Zea mays
  unsure (1)..(319): unsure at all Xaa locations
MRLRGLLRLVLALLLAATAIVPVLLLSENGGGGVAPAPPFNSSRVKAVSWHPRIFVYKGFLSDAECDHLVTLAKKKIQRSMVADNESGKSVKSEVRTSSGMFRSVGRXQDPVVSRIEERIAAWTFLPQENAENMQVLRYEPGQKYEPHFDYFHDRVNQARGGHRYATVLMYLSTVREGGETVFPNAKGWESQPKDATFSECAHKGLAVKPVKGDAVLFFSLHADGTPDPLSLHGSCPVIRGEKWSAPKWIHVRSYEDXNPRQYSCSPRKPTARGCADRSERCAKWAAAGECAWNPAYMLGAGDEGAPGQCRRSCGVCDS

SEQ ID NO: 613 - protein, 124 aa, Salmonella enterica
SGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 614 - protein, 339 aa, Corynebacterium glutamicum ATCC 13032
MTCDREGRHIPSKMSEGLHRHMTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 615 - protein, 203 aa, Oryza sativa
MAAEAAAALEGSEPVDLAKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQ

SEQ ID NO: 616 - protein, 116 aa, Schizosaccharomyces pombe
MSADGLDYTNLLPIANVARIMKSALPENAKISKEAKDCVQDCVSEFISFVTGEASEQCTQEKRKTITGEDVLLALNTLGFENYAEVLKISLTKYREQQARSASMKETKQSRSEEPQ

SEQ ID NO: 617 - protein, 411 aa, Chlamydomonas reinhardtii
MQIGFVSAESGQGRAKNVRNILLKNSVNIMLCAICWWAVGYAFAYGNSGGGFIGTSRFFSDGESFGSKPWFFTWTFCLSCVTIASGCLAERTHLFVYPVYTAVVSIAVHPVIAHWVWAPDSWLNSMTGSPCRFLDFAGGAVVHTVGGLTGLIGAMLCGPRLGRFEDGVGKDIPGHDVSSVSLGSLMLWFGWYGFNCGSTYIYMAQGGSEASAAVSRVALNMTLCASVAGMTSLVVSSIQTGTFDLAVCCNGLMAGLSASTSNVGFLTPWAACITGALAGLLYVGISRLLVRMGVDDPLDSSAIHCGSGILGVLVSGFLARPSYVMQMVGCNCGGVVYATNGGMQLGMQLLGLSCSMVWTAMWALLTFGILKKLQLLRVDQQTELAGIDNMEHGGPAYPEFLQRVQSTRPGY

SEQ ID NO: 618 - protein, 533 aa, Medicago truncatula
MSGELGVLNALDVAKTQLYHFTTIVIAGMGFFTDAYDLFCISLVTKLLGRIYYTEPNPTRPGTLPPSAQSAVTGVALVGTLAGQLFFGWLGDKLGRKKVYGLTLILMVVCSVASGLSFGSSPKSVMATLCFFRFWLGFGIGGDYPLSATIMSEYANKKTRGAFIAAVFAMQGFGILGGGIVALTVASIFDHKYKVPTFEENPAASLLVPQFDYVWRLILMFGALPAALTYYWRMKMPETARYTALVAKNAKQAAADMSKVLQVELEVEEEKVEKMTSDKRNSYGLFSKQFAARHGLALFGTCSTWFLLDIAFYSQNLFQKDIFSAIGWIPPAKEMNAIHEVYKIARAQTLIALCSTVPGYWFTVAFIDHMGRFAIQMMGFFFMTVFMFALAIPYDHWSKEENRIGFVVIYSLTFFFANFGPNATTFVVPAEIFPARLRSTCHGISAAAGKAGAIVGAFGFLYAAQSKDPTKTDKGYPTGIGIKNSLIMLGVINFVGMLCTLLVPESKGKSLEELSGENEGEGAEATEQEGSRV

SEQ ID NO: 619 - protein, 354 aa, Lentinula edodes
MGCAQSSGIDDEAKARNDEIENQLRRDRMMAKNEIKMLLLGAGESGKSTVLKQMKLIHHGGYNDSERDSYKEIIFSNTIQSMRAILDAMPSLDLFLNPSNDARRATILSLPVQLEVDVMPRDVGDSIRGLWSDPAVKEAVKRSREFQLNGSAVYYFNSIDRMSGPGYMPSDQDILRSRVKTTGITETTFQVGELTYKLFDVGGQRSERKKWIHCFENVTALVFLVSLSEYDQMLYEDESVNRMQEALTLFDSICNSRWFVKTSIILFLNKIDLFAEKLPRSPLGDYFPDYTGGNNYDAACEYLLRRFVSLNQSAATKQVYAHYTCATDTQQIKFVLSAIQDILLQLHLREAGLL

SEQ ID NO: 620 - protein, 149 aa, Glycine max
MISANRLIEMARKWQKMAVGNRKRISYPPRNHNNIVHMHYSSTANKGHFVVYSVDHKRFEVPLKYLSTNVFRELLDWSEEEFGLPSNGPITLPCDSVFLDYVISLIRERVPEEVEKALITSMVACHHEASSSSSRGLRQSNEPMIIYGF

SEQ ID NO: 621 - protein, 362 aa, Bacteroides thetaiotaomicron VPI-5482
MAKKIAEQLIDTLVESGVERIYAVTGDSLNEVNEAVRKNNKIQWIHVRHEETGAYAAAAEAQLTGRIGCCAGSSGPGHVHLINGLYDAQRSGAPVIAIASTIPSGEFGTEYFQETNTIKLFNDCSYYNEVATTPGQFPRMLQSAIQTAITRKGVAVVGLPGDLAKASSVSVDSSVKNYPAPPEVCPAEEDLIQLAELLNNHKRITLFCGIGCRGAHEEVIALSEKLNAPVVYTFKGKMEVQYENPYEVGMTGLLGMPSGYYSMHEAEVLLMLGTDFPYSAFLPDDIKIAQIDIKPERLGRRAKVDIGLCGDVRMTIQALLRMLDPKTDDTFLLKQLKRYEGVKKDLAAYTENKGDHCCPIKI

SEQ ID NO: 622 - protein, 486 aa, Oryza sativa
MRIVVPLQGVVQGRGGLVLGSLIPCALFYFFQLYIKRNRASPPPPPGSPTAASAAAVSPIHRSLSRGLLAPRAALPAISARGASVRDDDSLYYAGLRRCAADPYHPVTNPSGIIQLGLAENYLSLDLVGRWMEEHAAEAASMAGGEDEDERELSIRGLAAYQPYDGILALKMALAGFMRQIMQGSVSFEPSQVVITSGATPAMEILSFCLADPGNAFLVPSPYYPGWDRDIKWRTGIELIPVPCRSTDNFNISITALEIAYNQAKKRGIKVRGVLISNPNNPTGSFVPKQTLHDLLEFAAEKNIHLISDEVFAGSTYGSGKFVSVAEVVDDLEDFDKGRVHIIYGLSKDLSLAGFRVGVIYSYNESIVTAAAKIARFSSVSTPTQRLLVAMLSDQKFISDYLKVNRERLRKMYHLFVDALDQVGIECYKSSGGFYCWADMSKFIRSYSEKGERKLWDRLLEEAKDYPLELVMEWNNCFARSQLLPL

SEQ ID NO: 623 - protein, 553 aa, Saccharomyces cerevisiae
MTEDNIAPITSVKRLVTDKCTYKDNELLTKYSYENAVVTKTASGRFDVTPTVQDYVFKLDFEKKPEKTRNYAHWVRWLQQWLTLWPRYWRISTMWSFQTKAKGVKQPNYFGSMTQCSTLKLGIDAEGNDVYAPFNSLLPMVSPKHFVVSGWDINNADLYEAMQRSQVLEYDLQQRLKAKMSLVKPLPSIYYPDFIAANQDERANQCINLDEKGNVTTRGKWTHLQRIRRDIQNFKEENALDKVIVLWTANTERYVEVSPGVNDTMENLLQSIKNDHEEIAPSTIFAAASILEGVPYINGSPQNTFVPGLVQLAEHEGTFIAGDDLKSGQTKLKSVLAQFLVDAGIKPVSIASYNHLGNNDGYNLSAPKQFRSKEISKSSVIDDIIASNDILYNDKLGKKVDHCIVIKYMKPVGDSKVAMDEYYSELMLGGHNRISIHNVCEDSLLATALIIDLLVMTEFCTRVSYKKVDPVKEDAGKFEELLSSFNLLELLVKSSINKNQDLHPVNGLNKQRTALENFLRLLIGLPSQKRTKIRREIVVISFQRLSFSFSAYL

SEQ ID NO: 624 - protein, 334 aa, Agrobacterium tumefaciens str. C58
MQIGMVGLGRMGANMVRRLLKQGHDCVVFDVNPDNVAPLVKEGATGATSPDDLVAKLSPPRAVWLMLPAAITPKIARDFAARLQAGDAIIDGGNSNYRDAIDLAAEFAPRGIDFIDTGTSGGIWGLERGYSLMIGGPVAAVQRLDPIFASLAPGAGLGIAADPVTGTAPMGYLHCGPSGAGHFVKMVHNGIEYGVMAAYAEGLNILKAANAGTQHREADAETAPLAHPQYYQFDIDLPAVTEVWRHGSVIGSWLLDLTAQALKQDPNLDQYGGRVSDSGEGRWTLQAAVETGVPAPVLASALFERFSSRGEAEFAGKVLSAMRNAFGGHLEKAK

SEQ ID NO: 625 - protein, 427 aa, Photobacterium profundum
MSVYDTICIIAAVAVFISLFNHRVGKFQTTIAITGWSVIISLALLFLSNMNYIPLNKEHELINIIQNIQFDDFLLKGVLGFLLFGGALNIKLPHLKDQKFEITILALASTLFSTFFIGTVLWLLFSLVGINMAFIHCCLFGALISPTDPIAVLAIVKKMNAPQRVSTQIEGESLFNDGIGLVIFVTLFEVAFGETAPTVSSTIALFTHEALGGIAFGLVLGLVFHYLIKHSHDSMMRLILTMLIPTSGYVLGQHLGVSAPLAMVVSGIMIGNWTRNSIAEDESNQLNHLWELADEILNAILFLLIGLIMLTFSFHYIDIVAVAIAIPLVLCSRYLSVKIAYLGFNRYRTYNPESIKILTWGGLRGGLALAMAMAIPSGIATGFSPEIDVKEIIVLMTYAVVVFSIIIQGSTITPMIHKAKELEKTGY

SEQ ID NO: 626 - protein, 249 aa, Zea mays
MFGYQKGLDVEAGTSGAAATGGARQLYPGMQESPELRWALIRKIYVILSLQLLLTAVVAAVVVKVRAIPHFFTTTSAGLGLYIFLIILPFIVLCPLYFYHEKHPVNLILLGLFTVAISFAVGMTCAFTSGKVILESAILTTVVVLSLTAYTFWAVNRGKDFSFLGPFLFAALIVLLVFALIQILFPLGKLSQMIYGGLASLIFSGYIVYDTNNIIRRYTYDQYVWAAVSLYLDVINLFLSLMTLFRAAD

SEQ ID NO: 627 - protein, 90 aa, Oryza sativa
ILAGDHLYRMDYEKFIQAHRETDSDITVAALPMDEKRATAFGLMKIDEEGRIVEFAEKPKGEQLKAMMVDTTILGLDDVRAKEMPYIASM

SEQ ID NO: 628 - protein, 694 aa, Nitrosomonas europaea ATCC 19718
MKNPLEGSVIRRVMVGTDRSETADQTVQWAAGLADRYDAELFIVQVIVPKYPSATEFGESEQTSAVAANNDLAHFARQIAGERGHALVVINADPALAIVHAAEQEAIDVLVVGNLGMAGRKEFLLGNIPNRISHNAHCTVIIVNAAHSADERAPHSVRASLSNDEIPSFKPRLVARATHIAAVMAKHGLTELFSQSDPDISIRRQQARRLRGALEELGPIFSKLGQVLSTRPDLLPIEYIEELVLLQSRVPPMTESEVVRVSEQELGVPWEDVFKSFDPNPLAAGTIAQVHRATLETGDRVVVKVQRPTARADIEQDLALFEMFAEKVGKRPALNQVINMEDVFKHLSTSLHRELDFRQEANNIERMRTVLADYDRLAVPSIHWDLSTSRLLVMEEIQGIPIKQAPAGPERIQAARQLLESYYKQIIVDGFFHADPHPGNLMWWKDCIYFLDFGMVGAVGADLREHLLLMLMALWQEDAGFLTDVTLMMTNAVNSNDFDVAQFQSEIGEVMAKYRAASLAEMQIGPLLQEMSTVSLRHGVPLPASLTLATKALAQVQLATAELDPTLDPYDVAGKYLMRLMVKRIGAALNPKTFVYQSQKLKVRTLRVIEALENLVGVRPGGPKLVVNFKANSLENIVRHTGRRLALGLTAAASILTSGLTTMSTAVAEWVPVTFGAVAGLLTLGLVIDLLRGR

SEQ ID NO: 629 - protein, 244 aa, Crocus sativus
MGRGRVELKRIENTINRQVTFSKRRGGLLKKANEISVLCDADVAIIIFSTKGKLSEYSTDARMESILERYDRYSCAERDIVAPDPDSQESWRDEYGRLKAKLEALQTSQRHLMGAQLDMLSAKELQQLEQQLENALKNIRSRKNQLLFDSISELLKKEKTLTTQNKDMEMKLIEKKKVKSMARQGQQYTESSSPPSLLIQDPFPSLTIGINPASGSSEEDNEARLLPPVNRNRLPPWMVRSANE

SEQ ID NO: 630 - protein, 491 aa, Candida glabrata
MKPELKNPDLIKGLGYINGEWVKDSNEFFEVDDPSTGEIIAKLPEHDIAVVDRAVDAAYDAFQKYKNTLPRQRATWLRNLFNLMTENAEDLAKIITWENGKSLPDSRAEIKYAASYYEWYAEEAPRIYGATIQPSIPNNRVITKRQPVGVCGIICPWNFPSAMITRKVGAALAAGCTVVVKPDSHTPLSALAMTVLVEKAGFPKGVFNVVLSQHNTPKLGKRLCEHPKVKKVTFTGSTRIGKTLMEQASSTLKKCSFELGGNAPFIVFDDADLDLAVDQAIASKFRGMGQTCVCTNRFYVQDTIADEFAEKLVTKVKQFKIGDGMKEGVTHGCLTNAKQADKVDEHKKDAIEKGAKVLLEGGRMPDLGKNFYAPVVLKNVPQSAMVAKEETFGPLCPIFTFKTVEEVLGYANDTELGLASYVFTKNVNTLFTVSEALEAGMVSCNTGLFSDSSVPFGGVKESGFGREGSLYGIDDYTTVKSIIIGNLPDSL

SEQ ID NO: 631 - protein, 585 aa, Oryza sativa
WRATAGGGGSPKEAAVVVPSSGDATLGGHLARRLVQVGVSDVFAVPGDFNLTLLDYLIAEPGLSVVGCCNELNAGYAADGYARARGVGACAVTFTVGGLSVLNAIGGAYSENLPLICIVGGPNSNDYGTNRILHHTIGLPDFSQELRCFQPITCYQAVVNNLDDAHDQIDTAISTAIRESKPVYISVSCNLAAVPHPTFSRDPVPYFLSPRLSNQASLHAALDATLDFLDKAVKPVLVAGPKLAVAKAGEGFVDLADASRYGFAVMPSAKGLVPETLPAFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPDRQLRSARPGEPLRVNVLFKHIQGMIGGDEAVVAETGDSWFNCQKLRLPEGCGYEFQMQYGSIGWSVGALLGYAQAVQKRVVACIGDGSFQVTAQDVSTMLRCGQKSIIFLINNGGYTIEVEIHDGPYNVIKNWDYVGLVNAIHNGEGRCWATRVRCEEELEAAIATATGDKADSLCFIEVVAHKDDTSKELLDWGSRVSAANSRPPNPQ

SEQ ID NO: 632 - protein, 469 aa, Pseudomonas syringae pv. tomato str. DC3000
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPHIPSWVSAAVFFVLINAINLTNVKVFGETEFWFAIIKVVAIIGMIALGSYMLVSGSGGPQASVSNLWEHGGFFPNGVSGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPKLLAQVDKRGVPVKAIFASAAVTLVAVLLNYFVPQQALELLMSLVVATLVINWAMISYSHLKFRQHMNRTGQVPLFKALWYPYGNYVCLAFVVFILGIMLMIPGIQISVYAIPVWLAVMWVCYRAKNRRSVVVNAETGK

SEQ ID NO: 633 - protein, 787 aa, Oryza sativa
  unsure (1)..(787): unsure at all Xaa locations
LPDSRLKWRKWKRNPTASPSPSNRSSAAAAAADHSDDSDSAAVNEDDDSAVPEDADDETLAGAEDPVLDLREAEVLPSAEPVSAFPVATRRVVNRPHPSVLAVIAAERSACAGEGSAAVAAAPVLENISYGQQQVLSGVLPDHASLATDTDKPSTYVCTPPNLMEGHGVTKQFQGRLHVVPKHSDWFSPGIVHRLERQVVPQFFSGKSPGNTPEKYMLLRNKVIAKYLENPSKRLAFAECQGLVANTAELYDLSRIVRFLDTWGIINYLASGSVHRGLRMATSLLREEPTGELQLLTAPLKSIDGLILFDRPKCNLQAEDISSLASNSEVVDFDAGLAELDGKIRERLSESSCSYCLQPLTSLHYQSLKEADIALCSDCFHDARYITGHSSLDFQRIDGDNDRSENDGDSWTDQETLLLLEGIEKYNDNWNNIAEHVGTKSKAQCIYHFIRLPVEDGLLENIEVPDASVPFRAETNGYPHLDCNGSTSGNLPQKIPPDNQLPFINSSNPVMSLVGFLASAMGPRVAASCASAALSVLTVDDDSRLAIFPEMFYFSSMIKSFNTSXQDFRKRLHKLNTRSYLVQLPPEKVKHAAMCGLSAAATKAKLFADQEEREIQRLTATVINHQLKRLELKLKQFAEVETLLLKECEQVERIRQRIASDRVRIVSTRLASPGNSLPGGSTSTMSSNPMSMSPRPMGVPGSMPQSSMPAPFANNMQGHGHPQMAFLQQQQRQQMLSFGPRLPLSAIQTQPSPQTSNIMFNPGMPNSVTPNHHQLLRSSSGNNSSVG

SEQ ID NO: 634 - protein, 425 aa, Corynebacterium glutamicum ATCC 13032
MTELIILLIVIVTALAFDFTNGFHDTGNAMATSIATGALKPKVAVALSASLNLVGAFLSVEVATTVAKGVVDLDQFDLSNAWDSHQLLLVVFAGLIGAIVWNLLTWLLGIPSSSSHALFGGLIGAAIASLGFGGVVWEGVLSKMIIPALAAPVVAGLVAAIGTFAVYSITKAVGDNEKNRYFRWGQIGSASLVSLAHGTNDAQKTMGVIFLSLVATGHLGTDADIPFWVKATCALAIAIGTYLGGWRVIRTLGKGLVEIDSPQGMAAETSSAAIILTSSHFGMALSTTHVATGSIMGTGIGRKGAKVRWSVAGRMAMAWVITLPASAIVGVFCWWVAHGIGLISSDLLGVLVAFAILVILSGYIYARSRRVPVDPSNVNADWNEESNSVEPATPSAPAASEITEAPAAPAAQAVQDLNNENEVTK

SEQ ID NO: 635 - protein, 170 aa, Helicobacter pylori
GSGMHTHVSVWKNNENLFSGETYKGLSEFALHFLGGVLCHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 636 - protein, 121 aa, Triticum aestivum
  unsure (1)..(121): unsure at all Xaa locations
MAVTITWVKARQIFDSRGNPTVEVDVGLSDGSYARGAVPSGASTGXYMRLGSLRDGGSDYXGKGVLKGCQAMLNTIIGPSIGWERPTEQFELTLQWPTLDGTSNGXGWCKQNLGANASLRS

SEQ ID NO: 637 - protein, 319 aa, Actinidia chinensis
MEAFPVIDMEKLNGEERAPTMEKIKDACENWGFFELVNHGISHELMDTVERLTKEHYNKCMEQRFKEMVATKGLEAVQSEINDLDWESTFFLRHLPVSNISEIPDLEQDHRKAMKEFAEKLEKLAEQLLDLLCENVGLEKGYLKKAFYGSKGPTFGTKVSNYPPCPRPELIKGLRAHTDAGGIILLFQDNKVSGLQLLKDGEWIDVPPMKHSIVINIGDQLEVITNGKYKSVMHRVIAQPDGNRMSIASFYNPGSDAVMYPAPALVDKEEDQQKQVYPKFVFEDYMKLYAGLKFQAKEPRFEAMKAMENAVNLGPIATI

SEQ ID NO: 638 - protein, 452 aa, Medicago sativa subsp. falcata
MKEVAPGTQDQKQPLRANSKRALSDVTYLPHKKRAILQDVTNNCGENTKRSCLNPTEIQAKKRKVAKPAQPNVSNEVPSAAELPPFIADSKPVSSMEMRLRSSEDFRCLDDLEDNAPFRMSSNQCGTNNNLLQSQTSRISARPSSSQKKASQIVAAKKANISELLDVSKHPDVADIDADFEDPQLCSHYAADIYDHLRVAELSRRPYPNFMETVQQDITPSMRAILVDWLVEVSEGYKLQANTLYLAVYLIDWFLSKNCIEKERLQLLGITCMLIASKYEEINAPRIEDFCFITDNTYTKEEVVKLESLVLKSSSYQLFAPTTKTFLRRFLRAAQASYKRPSIELEYLTNYLAELTLLNYGFLNFLPSMIAASAVFLARWTLDQSSHPWNPTLEHYASYKASDLKATVLALQDLQLNSNDDCPLTAIRKKYTQDKLNCVAALSSPKLLETLF

SEQ ID NO: 639 - protein, 344 aa, Oryza sativa (japonica cultivar-group)
MEIRRSLRPLDLAKQRGRSSGNGTAAGSAVDGASPAGSDSEEHVLPGGVGTFSIRHASGTPSREEAGSHGGVRRSAFAFAPALHGARMENAHETGGRSGSRAHRAPSTMWQDSAIDQRSIGQTPYEATRAEGRSSASSADQGPSTPRSKHSATEQRRRTKINDRLEILRELLPHTDQKRDKASFLSEVIEYIRFLQEKVQKYEEADPERNHEDSKSMPWAKVYYRSCWRNTKNTSQVQGEDLSPSTQDMNNEQYGPKHISAAQPALFNTQSVTSTTTSSSHMATGTPQNLEKNSTPSNQPPWLSMSTMRQESEPGNKMPNKHEKQTLHDENHSISSAYSQGSVP

SEQ ID NO: 640 - protein, 393 aa, Prochlorococcus marinus subsp. pastoris str. CCMP1378
MSEVNLSKRALSIEPSLTLQISAKANQLAKEGKDICNLSAGEPDFDAPNEILKATSEAIFDGYTKYGPASGDLELRKAIAEKLQTQNNLNVEYENVMVTNGAKQSIYNLFQVLLNDGDEVIIPAPYWLSYPQMVRLAGGKPVFLNSSAEDGFKINIQDLKSKISPKTKFIIINSPNNPTGRVMPKEELLQIAELVRENKNINILSDEIYELILKKEFKHLSLASLATDLKERIFIINGFAKGWAMTGWRVGYLVGQKDVIKASSALQSQSTSNVCSFVQRGALEALKINREFFLEINSHYDLRREVLYKGLKNIEGLFISPPNGAFYAFPRLPNNSMTSVEFCKRILNDYGLVVVPGKPFGDDQCIRISCASSKEKILDGLTRLEKGILNYYF

SEQ ID NO: 641 - protein, 530 aa, Aspergillus niger
MLFRSLLSTAVLAVSLCTDNASAAKHGRFGQKARDAMNIANGSANAVKHSLKIPVEDYQFLNNKTKRYRVESLPDVHFDLGEMYSGLVPIEKGNVSRSLFFVFQPTIGEPVDETTIWLNGGPGCSSLEALSPGECRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAAPASTLTALIKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 642 - protein, 1119 aa, ASPERGILLUS NIDULANS FGSC A4
MYKTGNHSSDPARKNHRSAPPIPERLNTGNSRLMRQTRTAAKDSSFVLISRSGHFLANQCLASSCCSSVNLLEPDAAGSEDYMAGSHRSPVLKDQWRGSSGEVGDQRGREKHSRPRGSHRDRGRERFRDQDRHHHHPPNDDRLHRSSRSPPPRSFPGPDNKPQHRDFSTNIASTRASPAPSRSEIRPSQNINRPDSPERIGYRVTNSHMRSAERNHRREDSPSAPPFKRQRTHSPPPDGFQGRPPTHSRGAPPRHGRDFDREPSHSKGRGGRPPGRGRPSRRPSPRRERERRKHDSGLRDPSRNRQPWSHDWEDKPPIHPSRRYRSPPLDGIERDSYLRSPSRVSAGTLDSRTSALSRRGSKGDIAMHPPPSPSRLSLDRVPDTGYGAGLPERSRASRSPVNSYHESTRPSSPYSTARSGRSGQHSSHPSQHSFRASNFSEHDSPSRLSHGQPTSSHHVAPSHSYRDGQQRYQETHQDRRISGIVPTAPLSHARNRFSSPQRDASASRSRAGPPSPPQGPAADDPPPPPPPPTEPRSHREGYQNLTNHRPASRETRAPDEGSGHDSGSGFRAGQTGQPDTRPPEPPSGPSKGGKISFAFKAKTGPPSAPKPVPDLAQRMLAREPPQRVAEPPRSKMSSGPPPRFKPEPRFDRRDRDRDRHRDRDRNRGRNDRRDYREPRGSREARDYRDSRRDDRRVDPRDKRRNDKASGVRPERRHDPSPEPVKRSKIMLRLKPRPTISEEFANSDSVYFRKPGNESVIGAGTYGKVFKAIHVYTQRKVALKKIRMEGEKDGFPVTAVREIKLLQHLRNHNVVSLLEVMVEKNECFMVFEYLSHDLTGLINHPTFTLTAAHKKDLAKQMFEGLSYLHHRGVLHRDIKAANILISNQGRLKYADFGLARFFSKSRQLDYTNRVITIWYRPPELLLGETQYGPAVDVWSAACVYVEMFTKKAVFPGEGGEISQLDKLYNTLGTPTRAEWPNIVEMPWFELMRPTERRKRIFEDIYRDILSPAALDMVSQVFRYDPAKRPSAEDVLAHPYFHSEEPSPQQPIELENIQGDWHEFESKALRKERDREARRAEYQRDKEKRKILAAQDERETKRIKPDTSDGLTSSVPQPGQQ

SEQ ID NO: 643 - protein, 166 aa, Zea mays
  unsure (1)..(166): unsure at all Xaa locations
GRVGGRVGGRVGGIRILDEAHQCIVELQSPDYYPEIVKEAVNLALDKGTNFVDPLVRLLEHLYTKKIFKTQDLESGCLLYXGALLDDIGIDLPKAPAQFGEIIARLTLLGALRFEVMEEILKKMEDTMYRKAVFDAVKKTLEANPSGQTILGSHAAVIDACNSLLE

SEQ ID NO: 644 - protein, 183 aa, Triticum aestivum
  unsure (1)..(183): unsure at all Xaa locations
VMMMTTILVTIIMLLIWQVNIIVVLCFLTLFLGLELFFFSSVLGSVADGSWVLLVFAAVLYLVMYIWNYGTKLKYETEVKQKLSMDLMMDLGCNLGTVRAPGIGLLYNELVXGVPAXFGHFLTTMPAIHSMIIFXVCIKWVPVPCRXPKNEKVLFRXVCPKNYKCSLQCYGDKYQENPNIEQS

SEQ ID NO: 645 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTMVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 646 - protein, 418 aa, Burkholderia fungorum
MSTPTPRAPMLATAEALATLLSAASPIAGTESIPTLDALNRVLAANVTSPLDVPPMNTSSMDGYAIRTADLTVRDYSRLPVSQRIPAGHAPEPLKPGTAARIFTGATVPPGADAIVMQEQTEAADADVVILHSPEPGEWITAQGADIRSGSVILPAGTRLTPQALGLAASVGCAELVVRRRVKVAVFFTGDELTMPGEPLKPGAIYNSNRFTLRGLLEKLGCEVTDYGIVADRLDATRATLREAAGAHDLILTCGGVSVGEEDHVKPAVEAEGRLAMWQIAMKPGKPLAFGAVRRAARHGETSSAETFFIGLPGNPVSSFATFLLFVRPFILSLAGVQAVAPRALSLRADFTQSKADRRNEFLRARINPAGGLDLFPNQSSAVLTSTVWGDGLIDNPPNHAISAGETVRFIPFSELLN

SEQ ID NO: 647 - protein, 337 aa, Triticum aestivum
MAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 648 - protein, 296 aa, Zea mays
MGNASGRDEDAAAVDGDGADVEDGGGDSSERDFPSYGSGGANHVRRACSVGVVGGGAAAGSPPGSPGHSLSPRMFVPQTPVPPLQRAADVTPVFNQILMDEQEEYDGPPQKEIPALIVWTLGGKNVYVEGSWDNWKSRKAMQKSGKDHSLLLVLPAGVYRYRFVVDGERRCLPDLPCEIDAMGNAVNLLDVNDYVPESVESVAEFEPPPSPDSSYSFQAPEDKDFAKEPPVLPSQLHLGVLNSQNSEESCARPQHIVLNHLFIEKGWGAHPLVSLGLTHRFESKYVTVVLYKPIER

SEQ ID NO: 649 - protein, 439 aa, Rhodotorula mucilaginosa
MAISKIHSRYVYDSRGNPTVEVELTTEKGTFRSIVPSGASTGVHEALELRDGDKSKWLGKGVLKAVANVNDTIAPALIEANIDVADQAKIDEFLLKLDGTPNKAKLGANAILGVSLAAAKAGAAQKDVPLYKHIADISKAKEGKFVLPVPFQNVLNGGSHAGGDLAFQEFMIVPSGAPSFSEGLRIGSEVYHHLKSLTKKKYGQSAGNVGDEGGVAPDIKTAKEALDLIVSAIEAAGYTGQVDIAMDVASSEFYKDGLYDLDFKNPNSDKSKWITGPQLAELYEQLLNEYPIVSIEDPFAEDDWEAWSHFFSKVEGKTQIVGDDLTVTNPIRIKKAIETKAADALLLKVNQIGTLTESIQAANDSYAAGWGVMVSHRSGETEDTFIADLSVGIRSGQTKTGAPARSERLAKLNQILRIEEELGDKAIYAGKDFHKAHSL

SEQ ID NO: 650 - protein, 337 aa, Glycine max
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEKEYNSDIDIVSNASCTTNCLAPLAKVINDRFGIVEGLMTTVHAMTATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 651 - protein, 498 aa, Oryza sativa
MSGDAFNMSVAYQPSGMAVPEWLNKGDNAWQMISATLVGMQSVPGLVILYGSIVKKKWAVNSAFMALYAFAAVWLCWVTWGYNMSFGHKLLPFWGKARPALGQSFLLAQAVLPQTTQFYKGGGGADAVVETPWVNPLYPMATMVYFQCVFAAITLILLAGSLLGRMNIKAWMLFVPLWLTFSYTVGAFSLWGGGFLFHWGVMDYSGGYVIHLSSGVAGFTAAYWVGPRSTKDRERFPPNNVLLMLTGAGILWMGWAGFNGGDPYSANIDSSLAVLNTNICAATSLLVWTCLDVIFFKKPSVIGAVQGMITGLVCITPGAGLVQGWAAIVMGILSGSIPWFTMMVVHKRSRLLQQVDDTLGVFHTHAVAGFLGGATTGLFAEPVLCSLFLPVTNSRGAFYPGRGGGLQFVRQVAGALFIICWNVVVTSLVCLAVRAVVPLRMPEEELAIGDDAVHGEEAYALWGDGEKYDSTKHGWYSDNNDTHHNNNKAAPSGVTQNV

SEQ ID NO: 652 - protein, 191 aa, ASPERGILLUS NIDULANS FGSC A4
MLSQKVAQQSLRRLAVQQPYAMRWSLMNAASPAAVAMGRNVQKIQTRFAATSTTTSDPNKILVEQRLRRPVSPHLTIYRPQITWYMSALHRVTGIILSGPLYIFATAYLAAPLFGWHLESASLAASFATLPLAAKFSLKTLAALPFTYHSFNGLRHLMWDTGRGITNKQVIQTGWTVVGLSIASALYLAYV

SEQ ID NO: 653 - protein, 433 aa, Glycine max
MKISDENSSKPINPTSFQGGIECVGNRKMGQNRRALSVINQDLVAEGRPYPCVVNKRALAEKHNVCEKKQADPGHRPITRRFAAQIASTQKNRAEGTKKSNLGNSNSNGFGEHIFVDEEHKSTTDDQPVPMSLEKTEPMHSESDQMEEVEMEDIIEEETVLDIDTCDANNPLAVVDYIEDLYAHYRKLEGTSCVSSDYMAQQSDINERMRAILIDWLIEVHDKFDLLHETLFLTVNLIDRFLAKQTVARKKLQLVGLVAMLLACKYEEVSVPVVGDLILISDKAYTRKEVLEMEKLMVNTLQFNMSVPTAYVFMKRFLKAAQADRKLELLAFFLVELSLVEYEMLKFPPSLLAAAAVYTAQCTIYGFKQWSKTCEWHSNYSEDQLLECSTLMAAFHQKAGNGKLTGVHRKYCSSKFSYTAKCEPARFLLENPL

SEQ ID NO: 654 - protein, 355 aa, Arabidopsis lyrata subsp. petraea
ISYLTYDRADMAFAHYGPFWRQMRKVCVMKVFSRKRAESWASVRDEVDKMVRSVSCNIGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 655 - protein, 629 aa, GIBBERELLA ZEAE PH-1
MLRTSLQSVRAFGGRPVVAAAARQWPIAATRTASLAGQRFYAVDKKPELDPLKQPVLPTSQTITSERIHETTIDDVGETKAIIGEVPRTPPPPPPAPKKKGFFRRLKNFVFTLLVLGVVGFAGGVWYSRVSDNFHDFFTEYVPFAEQAVLYLEEMDYKKRFPNVTGRSKTQATEDAVRVPAQSGASWRVAEAERHSSAGPVASAAKKVKETVKPKPKPKAPAVEAKAVAKEEPAPAPKSNTDFKAPEVNEPSKMPPLKPIDLLSLEHAREPVVQDLVHMVNDLILVINADGAHGKYGTSVDKAKSEIAKVGEKLKGMKGEFERKAALQVREKIEEFDKAATDLIDRVENTMINQENQWRQDFEDEMKKVRENYEGRVSVLLEREKKVNEEKLQNQLAQQALALKKEFTKDIEKQVEQERESRLGKLNALSSAVGELEKLTTGWNEVLDTNLKTQQLHVAVEAVRASLEDDQHPRPFIRELVALREIASDDPVVNAAIASVNPAAYQRGISTSSQLIDRFRRVANEVRKASLLPDEAGVASHASSWVLSHVMFKKQGLADGNDVESILTRTQTYLEEGDLDSAAREINGLDGWAKTLSKDWLGEVRKVLEVQQALDVIATEARLQSLRVD

SEQ ID NO: 656 - protein, 439 aa, Corynebacterium efficiens YS-314
MDPSDLAWILAAFALVSLMFPGLALLYGGMLGGHQVLNTLMMVMGALAVTCLVYVTYGHGLVMGNSIGGLGIIGNPLDHLGFHDIMADDGAGGLMWAGFYVLFAAISLALVASGAAGRMKFGAWMVFGAIWLTLVYAPLAHWVFGGGWMITALGFHDFAGGTAIHMNAGASGLALALVLGRRHSMAVRPHSLPMTLLGAGMIMVGWFGFNGGTAGGANFLASYVVVTTLLATGGGMLGFILIERIREGRSTLLGLATGIIAGLVAITPAADAVSPVGALITGFLGSAVAAWVISWKRTHRIDDTLDVFAVHGMAGVAGALFVMLLGSPDAPAGLAGVLRGGELSLLWREPLAIIITLGYAFGMTWLIATVMNRITPIRIASEDEYTGIDTAIHAESAYSLTPVGMASRTNPETRIPEETAPADRAGVAKRNTDQKEDAR

SEQ ID NO: 657 - protein, 395 aa, Oryza sativa
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 658 - protein, 222 aa, Panicum miliaceum
IENKISRQGTFAKRRNGLLKKAYELSLLCDAEVALIIFSGRGRLFEFSSSSCMYKTLERYRSSNYSSQEVKTPLDGEINYQDYLKLKTRVEFLQTTQRNILGEDLGPLSMKELEQLENQVEISLKHIRTRKNQMLLDHLFDLKSKEQELQDLNKDLRKKLQETNAENVLHVSWEEGGHSGASGNAIEPYQGFLQHPENDPSLQIGYHQQAYMDQLNNEDMAD

SEQ ID NO: 659 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 660 - protein, 170 aa, Vibrio parahaemolyticus RIMD 2210633
MGHAESKFQPANIAVLTVSDTRTEENDTSGRYLVEHAQEAGHNVVDKQIVIDDMYKIRAIVSQWIADENIQAIMITGGTGFTSRDSTPEALKPLFDKEVEGFGELFRMVSYEEIGTSTIQSRAIAGFANHTVIFAMPGSTGACRTGWTKIIKQQLDASHRPCNFMPHLSV

SEQ ID NO: 661 - protein, 404 aa, Glycine max
  unsure (1)..(404): unsure at all Xaa locations
MASDGFTDKNTVFRKLKAKSENKMCFDCNAKNPTWASVTYGIFLCIDCSAVHRSLGVHISFVRSTNLDSWSPEQLKTMSFGGNNRAQVFFKQHGWNDGGKIEAKYTSRAADLYRQILSKEVAKSMAEDGGLPSSPVASQSSQGVNGLPEVKTNEVPKENILEKPEKPESTSSPRASHTVISSTVKKPIGAKKAVKSGGLGARKLTKKPSESLYEQKPEEPPAPVSSSTNNMPAGPSPTSRFEYVENVQSSELNTGGSHLLSHVSPPKSSSFFADFGMDSGFPKKSGPSSSKVQIQETDEARKXKFSNAKSISSSQFFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 662 - protein, 178 aa, Novosphingobium aromaticivorans
MTTDDLKRLVRTVPDFPSPGILFRDITTLIAHGEGLSACIDHLAHKARAAGAQAVAGMEARGFIFGAAVAARMGLGFIPVRKPGKLPVKTIGIDYALEYGRDRLEIDPTAIREGQRVVIVDDLIATGGTALAAAELLRMAGAHVTHALFVIDLPELHGAERLRGAGLTVEALMDFPGH

SEQ ID NO: 663 - protein, 200 aa, Zea mays
MAEPGLEDSQPVDLSKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLAEFRKVQQ

SEQ ID NO: 664 - protein, 523 aa, Aspergillus fumigatus
MIEKILSKRGYNWFISLVAAACMVLYGYDASVYNSVQGSKNWVKFFNDPDENMIGAVNTAYTVGAIFGGFFLGGPIADYLGRKIGMGVGCVLVIASTFMQTWSPRGNIGCFLAGRLIIGIGQGIALSEYPLPMESAGPIYIGELAPPEIRGKIMTFWQMFYSVGSFICFWVNYGCTQHKENLGEWDWKMVVIFQLLVPSLILALLPTIPGSPRWFLQRGDNVEKARAALRRVRETEEEVEEEILRIREALEYEKEAISSNYSALWKDKSLRKRMALALVINAGQQVTGQGSLNSYSTKIYQKVFPSAGTIALINALNATFGIIFTLNAVWIIDRFGRKFLLIVGGIGMGLCMIIAAAVETETPSPNGVKTEPVGISIVFLLFLFIFFSNILISDKPSWGATVWIWTSEVFSMNVRAQAVGMASQTQNVANAIVQQFFPIFLKNCGFYAFYMFAGVNFLLALFVWFFIPETKQVPLEEIDALFGGANHVTHGERMMIGEKEKHFEDQANEKGDAVTIENLEARR

SEQ ID NO: 665 - protein, 106 aa, Zea mays
  unsure (1)..(106): unsure at all Xaa locations
KAPGFPFGMAQKSLKISPIAMVFRAPAGIKGSTLIXINKPGNPQXVAESLEALLPAVKPALKQIKGGQRGKDPCPPPQSATGPVGQWERSFKTASFGNGGGGSCDP

SEQ ID NO: 666 - protein, 354 aa, Podospora anserina
MGSCMSTSGEESEQRKRSNKIDRDLEEDSKRLRRECKILLLGSGESGKSTIVKQMKIIHLKGYSHEELKNYRPTVFKNLLECAKSVASAMRQFDIEPVLDENKRHLDFLIDYSLDTNPQTIDAKVSVAIQSLWNDPAKEQLMERQTEFYLMDSAEYFFDEAARIAHKEYIPNEMDVLRARTKTTGIYETRFKMGQLSIHMFDVGGQRSERKKWIHCFENVTSIIFCVALSEYDQVLLEESSQNRMMESLLLFDSVVNSRWFMRTSIILFLNKVDIFKQKLGRSPLSNYFPDYSGGNDVNKAAKYLLWRFNQVNRAHLNLYPHLTQATDTSNIRLVFAAVKETILNNALKDSGIL

SEQ ID NO: 667 - protein, 474 aa, Nostoc sp. PCC 7120
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 668 - protein, 732 aa, Zea mays
MDLASFITSVLTSFLIFVALVLLFTWLSRRPGNAPVYYPNLLLRGLDPWAGRGRGTRSPVGWLRDAISASEPDVVAAGGVDAAVYLVFLSSVLSILVYSGIVLLPVLLPVAATGGALSTIPIPTNKSAQSAQNFSSIERLGMGNVAEKSMRLWAFLLSVYWVSFVTYFVLWKSYKHVSNLRATARSAPDVKPEEFAVLVRDIPRPSPDETIKDSVDSYFRALHPNTFYRSMVVTDHTKADKIYQEIEGHKQKIARAEVVYANSKTESNTEGTRPTHRTGFLGLIGTKVDTIEYCSEQIKELLPKLEAEQKTTLHEKQQRAAIVVFNSRSAAAFASQTLHAQVYDKWTVMEAPEPRQIIWSNLPRKLYDRQIRQCVVYCIVFLIVVFYIVPLTAIAAVTTLENLEAKLPFLKPVVEQPAIKTVLEAYLPQIALIVFLALLPTLLMFLSKQEGIPSQGHAVRAASGKYFYFIVFNVFLCYTLGSTLFKSLTTIINHPAEIVNMLAKSLPGSATFFLTFVALKFLVGYGLELSRLVPLIIFHLKRKYLCKTEEEVRAAWAPVDLGYNTRVPNDMLIATVVLCYSVIAPLIIPFGVAYFALGWLIARNQILRVYVPSYESYGRMWPHMHTRIIAALMVYQTTMIGFISLKKFAYASVLVPLLPASIIFAYVCHMRFYPAFAKTPLEVVVRHDLKETPNMEAIYTAYIPPCLKPDKLEDLDAFEDAQSRATSRVPSI

SEQ ID NO: 669 - protein, 252 aa, Methanothermobacter thermautotrophicus str. Delta H
MVPYLDGEDVAGVQSRVRMYNADENLLTKMQDIEFALFGNLIMRSRMKMGVPAFLGGNGQLVKRRAVEEIGGWDGYAVTEDLNLSVKLMLRGYDVKFSSEAEVFQEAVGDWPAFFRQRTRWLIGNLETLFVYLAPLIDAPITLHRKLDSLFYLFSMLFIGFVMLGYVVFILNLAGFTLRMNAPFIIGIISTIAFFPLVITGIRRDGYSLPRTLILSIEYWAYCLYLLPLFIVAAVHMIRRRERRWAKTFHTG

SEQ ID NO: 670 - protein, 159 aa, Streptococcus thermophilus
MASKRLRHVLKVFSSVGLLSYREKHLPQDQQTTPVKLRQAFEQLGPSFVKIGQILSTRSDLLSEAYIRELSKLQSSVPPLNKEEVMTAIRQELPTDLSEVFVDFSKEPLASGSVAQTHRARLLSGQEVIIKIQRPGIDDIVNEDIQLLIKLARHIPKYF

SEQ ID NO: 671 - protein, 130 aa, Chloroflexus aurantiacus
MACSRVGLSEQLWKIKQPYNVSVAAQAAAVASLAVADELRARVQAIVAERERLFQHLNTFPFLTPFPSVANFILCRVEGRDARELKLALERRGVLVRHYQTPLLNGYIRISVGTPAQTDALIAMLAEVTR

SEQ ID NO: 672 - protein, 90 aa, Schizosaccharomyces pombe
  unsure (1)..(90): unsure at all Xaa locations
MXKPSTEHINLKVVGQDNNEVFFKIKKTTEFSKLMKIYCARQGKSMNSLRFLVDGERIRPDQTPAELDMEDGDQIEAVLEQLGGCTHLCL

SEQ ID NO: 673 - protein, 336 aa, Staphylococcus aureus subsp. aureus Mu50
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMEKGTITGRMVIKF

SEQ ID NO: 674 - protein, 259 aa, Glycine max
  unsure (1)..(259): unsure at all Xaa locations
FTFTTRIFTFDATVVLFSLNYCKSRKGGLXAWEPXGTQEWLEILNPTEFLGNIVVEHDYAECTGSAIQALVLFKKLYPRHREKEIKNSIANAVQFLEDTQTANGSWYGSWGVCYIYGTWFALRGLAAAGKTYTNCAAIRKGVKFLLSTQKEDGGWGESYLSCPKQIYPLEGSRSTVVHTAWALLGLILAGQAERDTTSLHRAAKLLINSQLKEGDWPQQELTGVFNRTCMLHYPMYRNIYPMWALAEYRRLVPLPSXEV

SEQ ID NO: 675 - protein, 361 aa, SYNECHOCOCCUS SP. WH 8102
MGQDLAVDTAPIGSAAAGPHAERLSNLVTAKRATVDRETGLELFRDMTLGRRFEDKCAEMYYRGKMFGFVHLYNGQEAVSTGVIGAMKRQHDWFCSTYRDHVHALSAGVPAREVMSELFGKETGCSKGRGGSMHLFSKEHHLLGGFAFIAEGIPVALGSAFTSRYKRDALGDASSNAVTAAFFGDGTCNNGQFFECMNMAQLWKLPILFVVENNKWAIGMAHDRATSDPEIWRKAASFGMAGEEVDGMDVLAVRAAAQRAVERARAGEGPTLLECLTYRFRGHSLADPDELRAEQEKQFWAQRDPLKALERDLCEANLVSSDELRSIEKEIDAIVQDCVEFALSAPEPDPTELTRYIWAED

SEQ ID NO: 676 - protein, 83 aa, Zea mays
MLPCTRSLPIGRVFWHPADDTTPSRKLSILYKLFPISFVMNQAGGQSFTGKQRPLDVVPAKIDDRSPIFLGSYNDVEEIIALY

SEQ ID NO: 677 - protein, 175 aa, Zea mays
MQNQIMCHACRTLLLYPRGASSVCCAVCQAITTVPPPGLEMAQLICGGCRTLLMYTRSADTVRCSCCNTVNLVRPVNNIAHVNCGQCRTTLMYPYGAPSVKCAVCNYVTATGVNTVAPTPSARPTSDGSSYSGSSTSAPKSQSQNVTVVVENPMTVDDKGKLVSSVVVGVTAGKE

SEQ ID NO: 678 - protein, 287 aa, Glycine max
LCTESRGGVGSKSEVTSVDRKRINDVLDKQLERSSPSTSRAAGAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 679 - protein, 459 aa, Helicosphaera carteri
DPEYTIKETDLLALFRCTPQPGVDPVEAAAALAGESSTATWTVVWTDLLTACDLYRAKAYRVDPVPSAADTYFCYIAYDLDLFEEGSLANLTASIIGNIFGFKAVKALRLEDMRMPVALLKTYQGPATGLVVERERLDKFGRPLLGATVKPKLGLSGKNYGRVVFEGLKGGLDFLKDDENINSQPFMRYRERFLYSMEGVNHAAAMTGEVKGHYLNTTAATMEDMYERADFAKELGSVIVMIDLVIGYTAIQSMGKWSRKYDVLLHLHRAGNSTYSRQKSHGMNFRVICKWMRMAGCDHIHAGTVVGKLEGDPLMIKGFYNTLLDFKTDVNLPQGLFFAQDWASLRKCVPVASGGIHCGQMHQLIDYLGDDVVLQFGGGTIGHPDGIQAGATANRVALECMVLARNEGRDYVAEGPQILRDAAKTCGPLQTALDLWKDITFNYASTDTADFVETPTANV

SEQ ID NO: 680 - protein, 320 aa, Pseudomonas sp. Ki-723
CIGCHTCSITCKNVWTSREGMEYAWFNNVESKPGIGYPKEWENQDKWKGGWIRNANGTINPRIGGKFRVLANIFANPDLPSLDDYYGPFDFDYQHLHNAPLGEHQPTARNRSLINGNRMEKIEWGPNWEEILGTEFAKRRKDKNFDKIQADIYGEYENTFMMYLPRLCEHCLNPTCAAACPSGAIYKREEDGIVLIDQEKCRGWRMCISGCPYKKIYFNWKSGKSEKCIFCYPRIEAGMPTVCAETCVGRIRYLGVLLYDADRISEVASTANEQDLYEKQLEIFLDPNDPAVIRQALAECVPQSVIDSAQRSPVYKMAVD

SEQ ID NO: 681 - protein, 179 aa, Streptomyces avermitilis MA-4680
MTRPAEPSIGGALTASYSALVVTASNRAAAGVYEDKGGPLIAEGLATFGFAVDGPWVVPDGDPVEETLRSGVAAGYDVIVTTGGTGISPTDRTPEATRAVLDHEVPGIPEAIRAFGREKVPTAALSRGLAGVAGGTLIVNLPGSTGGVKDGLAVLEPLLVHAVDQIRGGDHPRPSGGAS

SEQ ID NO: 682 - protein, 138 aa, Zea mays
CDAIQFQCDRGRAGEGLPPGFRFHPTDEELITYYLTRKVSDFTFSTRAIADVDLNKCEPWDLPGKASMGEKEWYFFSMRDRKYPTGIRTNRATDSGYWKTTGKDKEIFHGGALVGMKKTLVFYRGRAPKGQKTSWVMH

SEQ ID NO: 683 - protein, 434 aa, Vibrio vulnificus CMCP6
MKFPGQRKSKHYFPVHARDPLVSQAQESKKMTRTHIIGIDQTLVDIEARVTSEMIEKYGLSKGHSLVIDDVTAEALYQQLKQENLITNEYAGGTIGNTLHNYSVLADDRSTLLGVMSQDIKIGSYGYRYLCNTSSRMDLNYLQGVDGAIGRCFALITEDGERTFAISEGQMNQLHPDNIPEKIFKKASALVLTAYLIRCKEGDPMPDATMKAIEYAKKYDVPVVLTLGTKFVIQDDPTFWQEFIRDNVTVVAMNEDEAEALTGESDPLAASDKTLDWADMVLCTAGPLGLFMAGYTEDSAKRETSLPLLPGCIAEFNRYEFSRPTKKASCENPIKVYSHISPYMGGPEKIKNTNGAGDAALSAVLHDMAANKYHKENVPNSSKHVYEFLTYSSFSQVCKYANRASYEVLVQHSPRLSRGLPEREDSLEEAYWER

SEQ ID NO: 684 - protein, 395 aa, Glycine max
  unsure (1)..(395): unsure at all Xaa locations
MFRRSILQISSRPTLKRNPRRFVYQQIPLHLSSQKNFSTVSKPGGASASGSPGKPPESNGTLSKFFIGSVALGAAFLAAYQTHYLDQYLKKEHYSVLQEPHVNATIEDLKSVQHSTDHHFPEGKEEKYEKKLKDAAARELMLAEEAAMLDRELKRERAKASLAINSLQEKMEEKLKTELEQKEIEAEIEVETSSGISKXRSDGIIGIQSTETVNARMEEGYHHASTSTQTSPDENGMKNIQPEQLEIQEMGRRESALGKDIEQQPTLLEEYHLRNKSERSPATYISSHDFTENSHFPEGKEALNGAMEELKDGYISENGKLVLDFLQAIHAAEKRQADLDAHAFNEEKKVLKEKYEKKLKDAAARELMLAEEAAMLDRELKRERAKASLAIKSLQ

SEQ ID NO: 685 - protein, 492 aa, Zea mays
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYSLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAISVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLPSRLNLKPSM

SEQ ID NO: 686 - protein, 387 aa, Medicago sativa
MEGGGAPPADTVMSDAAPAPPQMGIENIPAVLSHGGRFIQYNIFGNIFEVTAKYKPPIMPIGKGAYGIVCSAHNSETNEHVAVKKIANAFDNKIDAKRTLREIKLLRHMDHENVVAIRDIVPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEDDLGFLNENAKRYIRQLPPYRRQSFQEKFPHVHPEAIDLVEKMLTFDPRKRITVEDALAHPYLTSLHDISDEPVCMTPFSFDFEQHALTEEQMKELIYREALAFNPEYQQ

SEQ ID NO: 687 - protein, 480 aa, Opephyllum martensii
  unsure (1)..(480): unsure at all Xaa locations
QAIKNERYESGVIPYAKMGYWDPNYVTKETDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMXXXXXXXXXXXXXXXXXXXXXXVIIMIDLVIGYTAIQTMAIWARKNDMILHLHRAGNSTYSRQKVHGMNFRVICKWMRMAGVDHIHAGTVVGKLEGDPLMIKGFYDTLLEPYLDINLPQGIFFQQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 688 - protein, 200 aa, Cichorium intybus x Cichorium endivia
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 689 - protein, 482 aa, Pseudomonas syringae pv. tomato str. DC3000
MLEVPLLIGGQSCPARDGRTFERCNPVTGEVVSRVAAATLEDADAAVAAAQAAFPGWAALAPGERRARLLKAAEQLQARSGEFIAAAGETGAMANWYGFNVQLAANMLREAASMTTQITGDVIPSNVPGSFAMALRQPCGVVLGIAPWNAPVILATRAIAMPLACGNTVVLKASELSPAVHRLIGQVLQDAGLGDGVVNVISNAPADAAAIVERLIANPAVRRVNFTGSTHVGRIVGELSARHLKPALLELGGKAPFLVLDDADLDAAVEAAAFGAYFNQGQICMSTERLIVDQKVADVFVAKLTAKIETLRAGHPDDSQSVLGSLVDVSAGSRIKALIDDAVNLGATLVIGGQLQGSILQPALLDGVTDRMRLYREESFGPVAVVIRGEGDEALLALANDSELGLSAAIFSRDTGRALALAQRVESGICHINGPTVHDEAQMPFGGVKSSGYGSFGGKASIEHFTQLRWVTLQNGPRHYPI

SEQ ID NO: 690 - protein, 488 aa, Bacillus cereus ATCC 14579
MNPNNRLTTNQGAPVGDNQNSRTAGRRGPVLLEDYHLVEKLAHFDRERIPERVVHARGAGAHGVFVTKNSMKQYTKAAFLQNEGTETPVFVRFSTVIHGQGSPETARDPRGFAVKFYTEEGNYDIVGNHLPVFFIRDAIKFPDMVHSLKPAPDTNIQTPDRYWDFMTLSPESTHMMTWVFSDYGTPASYREMEGFGVHSFKWINEEGKIVYIKYHWKPQQGVRNLNAKEVQEVQGKDFNHATRDLFDAIEKGNHPKWDLHVQVMQLDEMDSLDFDPLDPTKVWPEDRFPLIEVGTMTLNRNPKNFFAEVEQVAFSPSATVNGIEPSEDKLLQGRLFSYPDTQRYRLGANYLQIPVNCPYAAVHNQQRDGAMQVNQNPSTINYEPSRHAENPVEDPAYRDSTMKVEGYVSREKIEKPNDFKQAGERYRSFSKEEQDNLIANLTNDLKDVNERTKLLAVCNFFRADQEYGMRLAQALNVDITQYVGNAPK

SEQ ID NO: 691 - protein, 454 aa, Hypnea japonica
GYWDPDYVVKETDVLALFRVTPQPGVDPVEASAAVAGESSTATWTVVWTDLLTACDLYRAKAYKVNAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLRGGLDFLKDDENINSQPFMRWKERFLYAMEGVNRSVAATGEVKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADF

SEQ ID NO: 692 - protein, 327 aa, Bacteroides thetaiotaomicron VPI-5482
MIENTATGALENFNFEQLQRHIPELQKFNFPIDTYQFDPPMDSSDMEPDMWRKLVHIIHENYDLYHGFVILHGTDTMAYTASALSFMLEGLDKPVILTGSQLPIGVLRTDGKENLMTSIEIAAAQDKDGKALVPEVCIFFENHLMRGNRTTKMNAENFNAFRSFNYPVLAEAGIHIKYNQAQIHVNKSKQELVPHYLLDTNIVVLKLFPGIQENVIATMLGTKGLKAVVLETYGSGNAPRKEWFIRRLCQASAQGIVIVNVTQCNAGMVEMERYETGYQLLQAGVVSGYDSTTESAVTKLMFLLGHGYTPDEVRDCMNRSIAGEITL

SEQ ID NO: 693 - protein, 174 aa, Glycine max
MSMSMSMSTLPSSTFANSNLSLSTSLSSQKLPLFHTLQAKSLPLPFPHLRIQTPPPYLPPPLCKSPEGAEAEAAPPEEDEWLQKLPEKSKPLYSHSLPCIEAWLRNLGFCQNNEDRALWVVHKPDWHAELFLDLTDLYIRYLKSGPGNLEKNMERRFSYALSREDIENAVLGGP

SEQ ID NO: 694 - protein, 243 aa, Triticum aestivum
  unsure (1)..(243): unsure at all Xaa locations
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIPDPRGFAVKFYTREGNWXTWSGNNFPLFLIXNGIKFPHPIPPFNPKPPSPCARSTWPPLPTFLFPTPPKPSPNPFFLPLLTHLPPPPPPPPPYHPPFPTNPPPSLPPPPPTPPSPHHPPPPPPQPFP

SEQ ID NO: 695 - protein, 648 aa, Emericella nidulans
MRWIPSPGGSMLVSRGLLHKIRPSPSAQLPLSVFPSSSFVFGSRCHSGAAVTQKSRMARFPSQQSRPVHATPHVNHNGPIEQNYDTANPAYIRKYLRTYGLTPPRPESYETQKTRCLAQLALKQTPIDKFLYLSTLRKNNVHLFYRLVTDHLRELTPLIYTPVVGEACQRWSEIYQQPEGMYLSWEDRGNLASVIANWPQPNVEITCITDGSRILGLGDLGINGMGIPIGKLALYTTCAGIRPEATLPLTLDLGTSNKALREDPLYLGSRRDKITPDEEREFLDELMAALTERWPGIVIQFEDFKNPFPALERYQDVYTCFNDDIQGTGAVILGGVINAVKRSGVPCKDQRAVFFGAGSAGVGVAKQIVAFFMREGMTEDEARSCFWLVDTKGLVTADRGDKLAEHKVYFARTDNAGQQFKTLEEVVDHVKPSILMGLSTQGGVFTPEILRKMAEWNTNPMIFPLSNPSSKSECDFETAVTNTDGRVLFASGSPFPTMSFTNSAGETKMYYPGQGNNMYVFPGIGLGTILSKAVKVTDSMIYASGEALSKALTAEEIERGLLYPDLTRIRKVSVVVARNVIRAAQEAKVDRETTLRTMDDETLDAWIKSRMYDPHTEVQSLEREVGSILSTLGAPQQFVNGSSDEAKL

SEQ ID NO: 696 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 697 - protein, 517 aa, Zea mays
MKNVAKCDTWCELQNPANHRVFERKLRPKPSGGGHVCLGVTPKDTKRKKFHPPPLSPHRVTKPNPNSRPPEMGQGSPGGMGKQPGLPGDRKQGDGKKEKKYEPPAAPSRVGRKQKRQKGSEAAARLPAVAPLSKCRLRLLKLERVKDYLLMEEEFVASQERLRPSEDKTEEDRSKVDDLRGTPMNVGSLEEIIDESHAIVSSSVGPEYYVGILSFVDKDQLEPGCAILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDVKTRRRIFQIHTSKMTLADDVNLEEFIMSKDEFSGADIKAICTEAGLLALRERRMKVTHADFKKAKEKVMFKKKEGVPEGLYM

SEQ ID NO: 698 - protein, 364 aa, Populus balsamifera subsp. trichocarpa X Populus deltoides
MGSTGETQMTPTQVSDEEAHLFAMQLASASVLPMILKTAIELDLLEIMAKAGPGAFLSTSEIASHLPTKNPDAPVMLDRILRLLASYSILICSLKDHPDGKVERLYGLAPVCKFLTKNEDGVSVSPLCLMNQDKVLMESWYYLKDAILDGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHIDVIMLAHNPGGKERTEKEFEGLAKGAGFQGFEVMCCAFNTHVIELRKN

SEQ ID NO: 699 - protein, 359 aa, ASPERGILLUS NIDULANS FGSC A4
MASHGIPRHSSLEATGETRQQELRKIETYRQLEYVVREEIMNRKYTPETLQKLSELLKKNPEYYTMWNYRRRVLLHEFSQAVPELPSETDIERITTLIQTDLQFLIPLLRSFPKCYWIWNYRLWLLDEAKRLLPKAIARKVWQQELALVGKMLNLDSRNFHGWGYRRFVVETLERLSSDEENEKSLTESEFEYAKKMIGTNLSNFSAWHYRTKLIQRLLSEKSASDEERKQILDDELELIHRALCDPYDQSLWFYHQNLMCTFDPTKSSHTMTPNLTKTERLNYIRGEIEKIQEMLDGAEDCKYLYQALIDCTSLEARVEETTLNEDQKTRVLDWLSELKKLDPLRAGRWLELEQSLCS

SEQ ID NO: 700 - protein, 579 aa, GIBBERELLA ZEAE PH-1
MFSAVLLGQLLRGKPLQSITSRNFASGKGSRGSNGRKSGPRRPLLYASAGVGTIGATALALGDDIKNSYEAAERIWRKGYRTDGLHSYRTTLNAREATEDHDEQENMLKACHKRCAERTLVVLEKNGGIFIKLGQHLSAMNYLLPSEWTNTFIPLQDKCPVSSLESIEDMFRQDTGEELWDYFSDFASEPIGAASLAQVHLATIKGSDQKVAVKVQHPELQGWAPLDLALTRYTFSTLKRFFPEYDLEWLSSEMDVSLPKELDFQEEADNARRMKEHFAKIPQLPLIIPEVIWAKQRIIVMACEAGSRLDDLEYMDKNGIDRDEVSATLSRIFNEMIFGDGAPLHCDPHGGNIAIRKNTSRRGLGRGPNFDVILYDHGLYRDIELPMRRSYAKMWLAVIDGDMDRMKKYAHEVAGIEDKDFPLFASAITGRDYSIVSKSGSILENRTADEQKTMSGALQEGLIVDLVQLLSRVPRIILLILKTNDLTRSLDENLQTRQGPIRSFMILARYCTKTVFHEKLEEISQNGSLLWPLNAVRLIAAWVGFMRVEIKLEAFELWLFTKRMLGMGNGEFSGAAFQK

SEQ ID NO: 701 - protein, 323 aa, Synechocystis sp. WH 8501
MYNPKILCIGEILFDCLADQLGKELNEVTSWIAYPGGAPANVACGLIKLGISAAFIGCVGKDKPGDELVKILDKIGVNSTGIQRHTNAPTRQVYVTRSLTGERQFAGFGQIKTEDFADTRLNSQQLTSSLFTQAKYLVMGTLELAYTQSQQAIFKAIQLAKKYQLHILIDVNWRPVFWQNIETAKPLIIQVLQAADFIKCSEEEAHWLFKTEDPQEIAQQFPKIKGILVTLGEKGCHYYLGKNQGIVAGFSVKVMDTTGAGDSFVAGFLSQCCYYEEEILNNAARAKQTIIYSNAVGALTTTKPGAIAAQPSKEEVEIWLKNH

SEQ ID NO: 702 - protein, 161 aa, Pediococcus parvulus
IADTIENYSDLFIQSQNAVFLSIDDPDSMKASLKNAADGRDIRLIVVTDAEGILGIGDWGTNGVDISVGKLMVYTAAAGIDPSQVMPVVLDVGTNNQDLLKNPMYLGNRHERITGDRYYKFVDQFVNTAEDLFPKLYLRFEDFGRDNAANILNKYKDQITT

SEQ ID NO: 703 - protein, 189 aa, Yersinia kristensenii
ESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 704 - protein, 306 aa, Triticum aestivum
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNVLGFTFGVIQMVLYVFYMNKTPVASEVKERERGMEGARRGPGRRDQRRQGRQGLVRGGAPGHREGRRRGRAQEVRCRGGGGAGGGLCPLCGGGLDCARCRGSLSCMAHA

SEQ ID NO: 705 - protein, 349 aa, Bacillus subtilis subsp. subtilis str. 168
MCNQHQTRVLSVSHAKAKFEQTTIERRGLRPHDVLIDIKFSGICHSDIHSAFDEWGGGIFPMVPGHEIAGVVTAVGTKVTKLAVGDRVGVGCFVDSCGECEYCLNAEEQFCTKGVVQTYNSVDYDGNPTYGGYSQKIVVTDRFVVRIPDRLEMDVASPLLCAGITTYSPLKHWNVGPGKKVAIVGVGGLGHLAIQFAHAMGAEVTVLSRSMNKKEEALELGANHYYATSDPATFTALAGRFDVILNTVSANLDVDAYLSMLRIDGTLVSVGAPAKPDTYSVFSLIMGRRSIAGSLVGGIQETQEMLDFAAEHGIEPKIEVIGADQVDEAYERILRSDVRYRFVIDISTL

SEQ ID NO: 706 - protein, 164 aa, Triticum aestivum
GESGDDMSEQYVAVTKQEKRRRRRRMACNRCGKRKWESKEACIVCDARYCGYCVLRMMGSMPEGRKCVSCIGGPIDESKRSKLGKSSRTLARLLSPLEVRQILKAEKECQANQLRPEQLIVNGCPLRPEELTDLLSCSRPPQKLKPGRYWYDKESGLWGKDGQK

SEQ ID NO: 707 - protein, 386 aa, Aspergillus parasiticus
MTGLDMETIFAKIKEEYARTDDVGKRQIQGHIRELQVGFYSDWDVVMRLSSGPLQVALTKVGIDLGIFRSLKESDTPITLAEIVKKTGASPRLLGRILRTQAAFGLIKETGPQEYTSSAFTDVFANSDAAGAVVQLFDISGPCTQILPDFLAERNYQDITSNKDCVFQKAFGSDLTMFEWMPQHPKHMESLGHLMALERPVSWVDHYPVLEELGGFPAPDKVLMVDIGGGFGQQSKALRAKFPDLPGRLIVQDIPQTLANAQPAAGIEFMEHNFFEPQPIQNAKFYYLRHVFHDWPDEQCVLILKQIIPAMGPESQILIDEMVIPSTGVPWQAAFTDLLMMNSLGGVERTRAEWDDLMEQVGLEIIQSKVYDSKEQAILVAVPKRT

SEQ ID NO: 708 - protein, 402 aa, Zea mays
KKNRNEEGVFYALDLGGTNFRVLRVQLAGKDRRVAKRDSKEVSIPPHLMSGNASELFGFIASALAKYVAAAGEGDGRQRELGFTFSFPVRQTSIASGTLIKWTKAFSVDDAVGEDVVAELQTAMEKQGVDMRVAALINDTVGTLAAGRYNDEDVVVGVILGTGSNAAYVEEASAIPKLKLEGGELPKSGNMVINTEWGNFYSPCLPITEYDQALDEESLNPGEQIFEKLVSGMYLGEIVRRVLLKIASQSSILGDVSHTNLKTRFSLRTPDISAMHHDGTPDLRVVAEKLADNLRVRDTSLDTRKMVVEICDIVTGRSARLAAAGIVGILRKIGRAAPGDERRSVVAIDGGLFEHYAEFRKRLEATLVELLGEEASRLVEVKLTKDGSGLGAALIAAAHSQY

SEQ ID NO: 709 - protein, 355 aa, Triticum aestivum
FRRLGWGLLQLSSSGNPLQTSAFIVENIFAIAIGAISLILFAQLIGKMQTYLQSVSKRLEEWRLRQRDMEEWMRHHRLPPDLQERVQRFVQVKWLATRGVEEESILQALPADIRRDVQRHLCLDLVRRVPFFAEMDDQLLDAICERLVSFLCPEGTYISREGDPVSEMLFIIRGKLESSTTNGGRSNFFNSILLRPGEFAGEELLTWALLPKTNIHFPLSTRTVRSLTEVEAFALRAEDLKFVANQFRRLHSKKLQHTFRFYSHHWRTWGACFIQAAWRQHQRRKLSESLSRWESYSWWSEEHPAADKPKQEGTSRTAAEMHKFASASRRFRADDTMIRRLQKPDEPDFSADHFD

SEQ ID NO: 710 - protein, 459 aa, Pavlova salina
DPDYAIKETDVLAMFRLTPQPGVDPVECAAAVAGESSTATWTVVWTDLLTACDLYRAKAFRVDPVPNSSDQYFAYIAYDIDLFEEGSLANLTASIIGNVFGFKAVKALRLEDMRIPYAYLKTFQGPATGVIVERERMDKFGRPLLGATVKPKLGLSGKNYGRVVFEGLKGGLDFLKDDENINSQPFMRWRERFLFSMEGVNRAAAASGEVKGHYLNATAGTMEEMYARADYSKSLGSIITMIDLVIGYTAIQTMAIWARKNDMILHLHRAGNSTYSRQKNHGMNFRVICKWMRMSGVDHIHAGTVVGKLEGDPLMVKGFYNTLLENKTDINLPEGLFFEQDWASLRKCLPVASGGIHCGQMHQLIEYLGDDVVLQFGGGTIGHPDGIQAGATANRVALECMVLARNEGRDYVAEGPQILRDAAKSCGPLQTALDLWKDITFNYTSTDTADFVETATANV

SEQ ID NO: 711 - protein, 382 aa, Glycine max
  unsure (1)..(382): unsure at all Xaa locations
MPVTNTTTPTVAEHIKWRRPRNQFNHHQHPISETDPNPQIPSIIQSTRCKSTISSLLLSTFSNNTSSNNDTPTTFNATAHSKKKSNFSASTFRGLGCTAGASQQVSVPAVIRSSADWQGKKTRKKKHKRSSSSSKNKTFHGGVLEGSNPECVDFQDVWCGPGIGFSTDAAAAASVDCVVASKKKRNFLLSTRXEGEVDLIAHRERSSXMWGRRTETFTFLDSTDPDIFTPRSASDSYGTATYYRHVRDPSSDGFAEIMMLQGSLLMGGQLNSHDHFKDWRLDVDNMSYEQLLELGERIGHVNTGLKEDEMGRNIRKTRLQFWDDTSKHQVDKECSICQEEYEAGNELGRLNCEHIYHFQCIKQWAAQKNFCPVCKQQVAARH

SEQ ID NO: 712 - protein, 482 aa, Escherichia coli K12
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 713 - protein, 591 aa, Streptococcus pneumoniae TIGR4
MTQGKITASAAMLNVLKTWGVDTIYGIPSGTLSSLMDALAEDKDIRFLQVRHEETGALAAVMQAKFGGSIGVAVGSGGPGATHLINGVYDAAMDNTPFLAILGSRPVNELNMDAFQELNQNPMYNGIAVYNKRVAYAEQLPKVIDEACRAAVSKKGPAVVEIPVNFGFQEIDENSYYGSGSYERSFIAPALNEVEIDKAVEILNNAERPVIYAGFGGVKAGEVITELSRKIKAPIITTGKNFEAFEWNYEGLTGSAYRVGWKPANEVVFEADTVLFLGSNFPFAEVYEAFKNTEKFIQVDIDPYKLGKRHALDASILGDAGQAAKAILDKVNPVESTPWWRANVKNNQNWRDYMNKLEGKTEGELQLYQVYNAINKHADQDAIYSIDVGNTTQTSTRHLHMTPKNMWRTSPLFATMGIALPGGIAAKKDNPDRQVWNIMGDGAFNMCYPDVITNVQYDLPVINLVFSNAEYGFIKNKYEDTNKHLFGVDFTNADYAKIAEAQGAVGFTVDRIEDIDAVVAEAVKLNKEGKTVVIDARITQHRPLPVEVLELDPKLHSEEAIKAFKEKYEAEELVPFRLFLEEEGLQSRAIK

SEQ ID NO: 714 - protein, 369 aa, Oryza sativa
MAMMVDPPNGMGNQGKHYYTMWQTLFEIDTKYVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPAQVPIDLDIDENLGVDMIREMMWQEMLHYHPEVVAGVNM

SEQ ID NO: 715 - protein, 480 aa, Rhodoglossum gigartinoides
  unsure (1)..(480): unsure at all Xaa locations
QGIKNERYESGVIPYAKMGYWDPDYVIKDTDVLALFRVSPQPGVDPVEASAAVAGESSTATWTVVWTDLLTACDLYRAKAYKVDVVPNTTDQYFAYIAYDIDLFEEGSIANLTASIIGNVFGFKAVKALRLEDMRLPVAYLKTFQGPATGIICERERMDKFGRPFLGATVKPKLGLSGKTYGRVVYEGLKGGLDFLKDDENINSQPFMRWKERFLYSMEAVNRSIAASGETKGHYLNVTAATMEEMYERAGFAKQLGSIIIMIDLVIGYTAIQTMAVWSRKNDMILHLHRAGNSTYSRQKIHGMNLRXXXXXXXXXXXXXXXXXXXXXXXXXXXXXXXXFYNTLLLPYLEVNLPQGIFFEQDWASLRKVTPVASGGIHCGQMHQLLDYLGNDVVLQFGGGTIGHPDGIQAGATANRVALESMVIARNEGRDFVTEGPQILQDAAKTCGPLQTALDLWKDITFNYTSTDTADFVETPTANV

SEQ ID NO: 716 - protein, 375 aa, Arabidopsis thaliana
MPLSLQSPPCATLSASIRKGRWKTLAAGFSVTPLPAVNFSLRRSIPRILASASSSSSPASSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAASQAGASVIQIFVGRLRDWARNHSGDTEIESAIKSGEDPGLALVKRSYNYIHKYGYKSKLMAAAVRNKQDLFSLLGVDYVIAPLKVLQSLKDSPAIPDDEKYSFVRKLTPETATHYHFTNKELVKWDQLSLASSMGPASV

SEQ ID NO: 717 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKTQ

SEQ ID NO: 718 - protein, 298 aa, Zea mays
  unsure (1)..(298): unsure at all Xaa locations
MDSGSRSSGGAGFDDEDGLTTRREVSSSLQDLAVRVDWKGGSCSDGGTNQGPNTPRSKHSATEQRRRSKINDRFQILRELLPHNDQKRDKATFLLEVIEYIRFLQEKAQKYEATFPEWNQENPTMLPWSKGQIPGDSPPDPSHFVRNGSSPGSNFTGKLDDNHNHLQLHQGHXDQAETNHVASGCYRSSETPANITNNAISQSQPQWTGPSPVDDSAVKSEMLNSQELAIDEGMISVSSTYSPRVLISLSHALQSSGVDLSQTSISVQINLXKACWQEICICWWCILQLQGTTSRSSI

SEQ ID NO: 719 - protein, 430 aa, Zea mays
  unsure (1)..(430): unsure at all Xaa locations
MAAVAVSGGHWRRLRTLGRGASGAVVSLAWDAASGELVAVKSAGAIGAAALRREHAVLAGLRSPHVVRCVGGGDAAEEGSSYQLFLEYAPGGSLADEVARSGGSLGEXAVRAFAADVLRGLAYLHARSVVHGDVKARNVLVGAGGRAMLADFGCARALSGSGSGSARRPIVGATPAFMAPEVARGEDQGPPADVWALGCTVVEMATGRAPFGGMGGAGVLAMVHRIAYTDAVPEVPAWLSPEAGDFLARCFARDAADRWTAARLLEHPFVAFARHDDKAPRPSPKSALDAAAFWESETESEDDADDASGSASASERIDSLACSAGALPDWDGEGGWIDVLGEHCGAPGKASSVLVAVPAGEMDVGGGLPSDDGLEADDVPFGGGDVPVPAADAYEKHCSSSDCHALSCQLVPCNLVFNAIKLWVPKKKKK

SEQ ID NO: 720 - protein, 680 aa, Staphylococcus aureus subsp. aureus Mu50
MEIFETILIFIAVVILSSFVHTFIPKVPLAFIQIFLGMLLFITPIPVQFNFDSELFMVTMIAPLLFVEGVNVSRVHLRKYIKPVMMMALGLVITTVIGVGLFIHWIWPDLPIGAAFAIAAILCPTDAVAVQAITKGKVLPKGAMTILEGESLLNDAAGIISFKIAVGVLVTGAFSLVDAVQLFLIASIGGAVVGLLIGMALVRFRLTLMRRGYENINMFTIIQLLTPFVTYLIAELFHASGIIAAVVAGLVHGFERDRIMQVRTQLQMSYNHTWNILGYVLNGFVFSILGFLVPEVIIKIIKTEPHNLIFLIGITIVVALAVYLFRFVWVYVLYPYFYLAISPFQKMMTKNDDDNPTTEKPPKRSLYALIMTLCGVHGTISLAIALTLPYFLAGHHAFTYRNDLLFIASGMVIISLVVAQVLLPLLTKPAPKTVIGNMSFKVARIYILEQVIDYLNQKSTFETSFKYGNVIKEYHDKLAFLKTVEKDDENSKELERLQKIAFNVETKTLESLVDEGQITNSVLENYMRYAERTQVYRQASLIRRMIVLLRGALLKRRVQTRVNSASSLSVTDNLMELNKINKLVHYNVVSRLSKETTKDNTLEIGMVCDGYLMRIENLTPSNFFNSASEDTITKIKLNALREQRRILRELIDTDEVSEGTALKLREAINYDEMVIVDSMT

SEQ ID NO: 721 - protein, 201 aa, Vibrio cholerae
MANILFIDNFDSFTYNLVDQFRSLGHVVTIYRNNLSADAIEQALLQLDNPVVVLSPGPGAPSETGCMPELLQRLKGKVPMIGICLGHQAIVEAYGGVVAGAGEIIHGKVSMMEHQNHAIYRGLPSPLAIARYHSLVATQVPSALTVTAEVNGLVMSVVNEADKVCGFQFHPESIMTTHGATLLANAIDWALSSTPAQTQFA

SEQ ID NO: 722 - protein, 163 aa, Zea mays subsp. parviglumis
EEGRIIEFAEKPKGEQLKATMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKIHHSVVG

SEQ ID NO: 723 - protein, 68 aa, Zea mays
KKVPFPCRFKSIPSIVELDSLKVSGDVWFGSGITLKGKVTITAKSGVKLEVPDGAVFENKDVNGPEDL

SEQ ID NO: 724 - protein, 803 aa, Catharanthus roseus
MRILIQEMLIRTLFFFYLIISSLEFTPENNYLINCGSFNDTSIDDRIFLADNLNSTVLSTPETIFANSSNSNSVLDLYKSARIFNGSSQYNFSINKKGWHWIRLHFFPFPISNEKFNLSSAKFSVFAQNFTLLKDFQPLNNVPVVKEFSLNVNSNNLLLKFTPSRNSLAFLNGLEVISLPDELIPFSIGNQNLEKNALETVVRVNMGNVTVSSKDDPLGRIWLSDYNYLSNVNLVVFVSNIHLVNYTKGEEKVSENIGPSSVYGTGTKLHSVFDPNTQINATWLFNVDSGFGYFIRFHFCNLLNPIPNNNFFFNVFLNSEFVVKDLNLSTSGAPMYKDVVVVTNVVPQIRISVGPSNVRNSYPDGILNGLEIMKISTSDGSLAAVDADFPSSSSSSKLKVWIIVSLAIGISLILVVFTVVFLFRRRKRHVMIHSTPDHLTEEDDSNSSIFSRSKIGYRFPLAVVQEATDNFSENRVIGIGGFGKVYKGVFKDGTKVAVKRGISCSSSKQGLSEFRTEVELLSQFRHRHLVSLIGYCDEKNEMIIIYEFMENGTLRDHLYGSDKPKLNWRKRVEICIGSAKGLHYLHTGTMKRIIHRDVKSANILLDENLMAKVADFGVSKTGPDHFDQTHVSTAVKGSFGYLDPEYLTMQKLTEKSDVYSFGVVMLEILTGRPVIDPSKPREMVNLVEWAMKCSRKGEEIVDSDIVNEVRPESLIKFQETAEKCLAERGVDRPTMGDVLWNLECALQLQGKQKENEQPEEMRDVSATEISLGSMADLAAVSMSKVFSELVKAQGTRSEFGSAP

SEQ ID NO: 725 - protein, 481 aa, Brucella suis 1330
MPAIGFIIDGKESGGASGKTFERKDPITGKVATVAAAASLADVDTVAEAAAKAFESWSETGPNARRALLNKAADLMDSRTAEFTRLMLEETGATAPWAGFNVHLGANILREAAALTTQITGEIIPSDKPGIMSMAVRQPVGVVLGMAPWNAPVILGVRAVAAALACGNTVILRSSETCPGVHHLIIKILNDAGFPAGVANVISNAPDDAPEIVAALIAHPAIRRINFTGSTQVGRIIARRAAGHLKPVLLELGGKAPFIVLEDADLDQAVDAAAFGAFMNQGQICMSTERFIVHEKVADAFAEKLAAKARSLPAGDPRGNVVLGSLVDLKSAQRMDALIADAVAKGGRVLAGGKRDGAVVEATIIDGVTPQMDIYTQESFGPVKPIIRVKSAEEAIRVANDTEYGLSSAIFSQNVKRALALSRKLETGICHINGPTVADEAQVPFGGVKSSDYGRFGGKAAINEFTELRWITIEGPQHYPF

SEQ ID NO: 726 - protein, 292 aa, Escherichia coli
MKVAVLGAAGGIGQALALLLKTQLPSGSELSLYDIAPVTPGVAVDLSHIPSAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGDVEVPVIGGHSGVTILPLLSQVPGVSFTEQEVADLTKRIQNAGTEVVEAKAGGGSATLSMGQAAARFGLSLVRALQGEKGVVECAYVEGDGQYARFFSQPLLLGKNGVEERKSIGTLSAFEQNAL

SEQ ID NO: 727 - protein, 264 aa, Triticum aestivum
  unsure (1)..(264): unsure at all Xaa locations
MSLDIQLTAPNGRTYKQPTGLFINNEWVKSSNGEKITSINPTNEEEITSVYAGSSEDVDKAVRAARRALHNPSWRDLPGTERGKLLSRLATLVEENKEILATIETWDNGKPYTVALNDDVNEVAETLRYYGGFADKVYGQVIETTGDKFGYTIREPIGVCGQIIPWNFPLAMAAWKLGPALACGNAVILKPAEQTPLSILYLANLIVEAGFXPLGVVNIINGLGTVAGAALASHXGDVDKMAFTGSTPTARSIMKMASSNLKNI

SEQ ID NO: 728 - protein, 125 aa, Zea mays
  unsure (1)..(125): unsure at all Xaa locations
AVREPPTPTAVTRRHLSIVGKLTPNHRLRAAEEDKKPAEGGAHINLNVKGQDGNEVLFRIWRSTHLWKLMNAYCDRQPVDMNDIACLIDGRRVHRXAHPCXLQMHDGYYINAMLHQTVGSVASTS

SEQ ID NO: 729 - protein, 364 aa, Campylobacter jejuni subsp. jejuni NCTC 11168
MKFNEFLNNLSNYEPGKDIEVIAKEYGVKEVIKLASNENPFGTPPKAIECLRQNANKAHLYPDDSMIELKSTLAQKYKVQNENIIIGAGSDQVIEFAIHSKLNSKNAFLQAGVTFAMYEIYAKQCGAKCYKTQSITHNLDEFKKLYETHKDEIKLIFLCLPNNPLGECLDASEATEFIKGVNEDCLVVIDAAYNEFASFKDSKKHLEPCELIKEFDNVLYLGTFSKLYGLGGLRIGYGIANANIISAFYKLRAPFNVSNLALKAAVAAMDDDEFTEKTLENNFSQMELYKEFAKKHNIKIIDSYTNFITYFFDEKNSTDLSEKLLKKGIIIRNLKSYGLNAIRITIGTSYENEKFFTEFDKILR

SEQ ID NO: 730 - protein, 321 aa, Chloroflexus aurantiacus
MARTNLNLGQLNEIEACEEHIMEVGLIGLGRMGANMAIRLRRGGHRVIVYNRTVAKARELAAEHDLIAAEELSDLVAMLTPPRVVWLMLPAGSATDEHLAALTPLLTPGDIVIDGANNNYKASIAHAEQLTAQGLRFLDIGVSGGIWGLQIGYCLMVGGDEETFHYVEPLLQTLAPPEGYLLCGPHGAGHFVKMIHNGIEYGMMQAYAEGFEILRQSRYDFDLAKISHLWNQGSVVRSWLLELAERAFTADADLSSIRGYVEDSGEGRWTVQESIDLDVPAPIITLSLQMRFRSRQEDSFSMKVLAALRQQFGGHAVKKVE

SEQ ID NO: 731 - protein, 465 aa, Solieria filliformis
AKMGYWDPEYVIKDTDVLALFRVSPQPGVDPIEASAAVAGESSTATWTVVWTDLLTACDLYRAKAYKVDAVPNVSDQYFAFIAYDIDLFEEGSIANLTASIIGNVFGFKAVKALRLEDMRIPVAYLKTFQGPATGLVSERERMDKFGRPFLGATVKPKLGLSGKNYGRVVYEGLRGGLDFLKDDENINSQPFMRWKERFLYAMEGVNRSIAATGEVKGHYLNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALESMVLARNEGRDYVAEGPQILQDAAKTCGPLQTALDLWKDITFNYTSTDTADFVETPTANV

SEQ ID NO: 732 - protein, 426 aa, Chlorobium tepidum TLS
MMTVVHEAHESKQKQAKTMTTVHEAHEIIATTTPLIEATVSVPLLQLQGRVLAEDVRAGFAMPRFTNAAMDGFAVRFGEIADASDGAPVTLPVSQELAAGALNVAPLETGTCCRIMTGAPIPEGADTVVPFEETSGFGSDAVEFYKAPKKGANIRHAGEEMQPGALLAAAGTRITPAEIGLFATFGIAVALVRRQPRVSIITVGDELRMPGEQIEPLAIYNSNLALLASCVEGAGAKVVGMRQLRDNRQAIREALALAIAESDVVITTGGISTGEFDFMYDALNELGVEQKFWKVAQKPGKPVYFGTTGSGKIVFSLPGNPVSALVCFLEYGLSALARMQGVAPAPKFTALLNEPFPTDRKRHRFLFGRLSVEAEALRCQLSAQVESYMLTALSGANCLVEAPPSAEPLPAGSLVTCAWLPWANAC

SEQ ID NO: 733 - protein, 335 aa, Fusobacterium nucleatum subsp. vincentii ATCC 49256
MAVKVAINGFGRIGRLALRVMSKNKDFDVVAINDLTDAKTLAHLFKYDSAQGRFDGTIEVTDNGFVVNGDSIKVFAKANPEELPWGDLGIDVVLECTGFFTSKEKAEAHIKAGAKKVVISAPATGDLKTIVYNVNDNVLDGTETVISGASCTTNCLAPMAKVLNDKFGIIEGLMTTIHAYTNDQNTLDAPHKKGDLRRARAAAENIVPNTTGAAKAIGLVIPELKGKLDGAAQRVPVITGSITELVTVLGKDVTVDEVNAAMKAASNESFGYTEEPLVSSDIIGISFGSLFDATQTKVLTVDGKQLVKTVAWYDNEMSYTSQLIRTLKKFVEISK

SEQ ID NO: 734 - protein, 71 aa, Glycine max
  unsure (1)..(71): unsure at all Xaa locations
HSFLSVATIITXRAKSPLVPPSTPVDNALSKHRGILQVIMRPCVALAPQSNMILEPAQVPSINRNGLATCS

SEQ ID NO: 735 - protein, 164 aa, Thermococcus sp. KS-1
MRKMVWRRDRYWDPFDIMREIQEEIDAIFRDFMRGPRLWSYREPGERIEVSETWREPFADIFDRGDRFVITVELPGVRKEDIKLRVTEDTVYIEAQMRREKELEQEGAIRIERYYSGYRRVIRLPEEVIPEKAKARYNNGVLEIEIPKKKPTKPEKEGVEVKIE

SEQ ID NO: 736 - protein, 290 aa, Vibrio vulnificus CMCP6
MIKKCLFPAAGYGTRFLPATKSMPKEMMPVVNKPLIEYGVEEAIQAGMDGMCIVTGRGKHSIMDHFDKNYELEHQISGTNKEALLEDVRALIDSANFTYIRQREMKGLGHAILTGRELVGDQPFAVVLADDLCVNEEQGVLAQMVALFKQFRCSIVAVQEVPENETHKYGVISGEMIKDDLFRVDNMVEKPEPGTAPSNLAIIGRYILTPDIFDLIEQTEPGKGGEIQITDALLKQAKAGCVLAYKFKGRRFDCGSVEGYIEATNYCYQNLYLKDEKTSELGKFSTQKEK

SEQ ID NO: 737 - protein, 376 aa, Zea mays
  unsure (1)..(376): unsure at all Xaa locations
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVAEELMGGMLRGVXRQFNEGPVEXAKQALYSRDLARNLRFASNFDLFKAAAADWRDTLFXEVAPNPPPREELPEPLRNVMLEYGAAVTKLARFVFELLSESLGMPSDHLYEMECMQNLNVVCQYYPPCPEPHRTVGVKRHTDPGFFTILLQDGMGGLQVRLGNNGQSGGCWVDIAPRPGALMVNIGDLLQLVTNDRFRSVEHRVPANKSSDTARVSVASFFNTDVRRSERMYGPIPDPSKPPLYRSVRARDFIAKFNTIGLDGRALDHFRL

SEQ ID NO: 738 - protein, 389 aa, Zea mays
  unsure (1)..(389): unsure at all Xaa locations
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAXKGGGERQFNGLVDVYRKTLKSDGIXAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 739 - protein, 368 aa, Pelargonium x hortorum
MGVLLNICSSPFPVVASAASTSISKVNHIRKVGVTGVMAPQKIEIFKSMEEWGKHNILPLAKPVEKSWQPTDFLPDPSSEGFMEEYNAFKERTRELPDEYFVVLAGDMITEEALPTYQTLVNRPDEVADETGHSESPWAVWSRAWTAEENRHGDLLNKYLYLSGKLDMRQVEKTIQYLIALGQDIGTEKNPYHLFIYTSFQERATFISHANTAKLAQQHGDKQLAQICGTIAADEKRHETAYTRIVDKLFELDPDETMSCLAHMMKRKITMPAHLMRDGRDPHLFQHFSVVASRTGVYTVMDYINILEHFVEKWNIEKITAGLSDKGREAQDYVCKLGERLRKVEERAHQRVVQADPIPFSWIFDRKV

SEQ ID NO: 740 - protein, 492 aa, Methanosarcina mazei Goe1
MIREYKLLIGGKSVDSSTGETFDDINPATLENLATLQVAGIEDVDRAVEAAEAGFRVWSEVPAPGRAEVLFRAARIMQERKEGLARLMTEEMGKVLPETRGDVQEAIDITIYAAGEGRRMFGETTTSELRDKFCMTVLRPVGVVGMITPWNFPIAIPSWKIMPALIAGNAIVFKPASDTPLLTIKLVEILMEAGLPPGVINIVPGPGGSTGKAIVQHPRIRAISFTGSLDTGKWIMEECAKSMKRVSLELGGKNPVIVMDDANLELALEGVVWGAFGTTGQRCTATSRLILHEKIKDEFIKRLLAKTKSLRVGNGLLPETDVGPVINKAQLEKIEKYVRIGKEEGAAILVGGNRIDPGLPGYFFEPTIFTDVSPEMRIAQEEIFGPVLSIITVSDFDEAIEVANNIKYGLSSAIYTENVRTAFRAIEKLEAGITYVNAPTIGAEVHLPFGGIKGTGNGFREAGTEAIKEFTEVKAVYIDYSGRLQKAQIDTE

SEQ ID NO: 741 - protein, 420 aa, Bacillus subtilis subsp. subtilis str. 168
MGNTLFFISLSLIWVMLLYHMFLMQGGFRHYMTFERNIPKWRENMKELPKVSVLIPAHNEEVVIRQTLKAMVNLYYPKDRLEIIVVNDNSSDRTGDIVNEFSEKYDFIKMVITKPPNAGKGKSSALNSGFAESNGDVICVYDADNTPEKMAVYYLVLGLMNDEKAGAVVGKFRVINAAKTLLTRFINIETICFQWMAQGGRWKWFKIATIPGTNFAIRRSIIEKLGGWDDKALAEDTELTIRVYNLGYHIRFFPAAITWEQEPETWKVWWRQRTRWARGNQYVVLKFLAQFFKLKRKRIIFDLFYFFFTYFLFFFGVIMSNAIFVVNLFYDLHLSVGFLAMILWILAFFLFMTEVMITLSIEKTEMNKQNFFIVFLMYFTYSQAWIVLVIYSLFVEIKHRLFKQEVKWYKTERYNQHKSG

SEQ ID NO: 742 - protein, 179 aa, Magnetospirillum magnetotacticum
MTPSARPARIGILTVSDRASSGGYADASGPAMHAVLAEILASPWEAVARTVPDGVESVRDALIRLVDDAHCDLVLTTGGTGPAPRDLTPEGTEAACDRMMPGFGELMRRRGLDQVPTAILSRQTAGLRGKALIVNCPGRPSSIRVSLLAVFPAIPYCLDLIGAARIETDPAVVQAFRPT

SEQ ID NO: 743 - protein, 116 aa, Yersinia bercovieri
FEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTM

SEQ ID NO: 744 - protein, 191 aa, Xylella fastidiosa Ann-1
MASPCLSVALKALCFRGASTHLSINRVRRLSMNVVRYTPWPGQAVLQNEIKQVFDRFFEHNGDTDESAVVTAQWVPRVDIKEEPNQFVLYADLPGIDPADIEVQMDKGILSIKGERKTESSSQTEHFSRIERRYGSFHRRFALPDSADADGITASGSHGVLRILIPKQAATTPRRIQVGNAVSSDVALQSM

SEQ ID NO: 745 - protein, 398 aa, Glycine max
MARSWLIDIGGFAKKVKNTTLSTDDQMKDCGTYRECPKCHYHIDNSDVSHEWPGFPVGVKFDPSDVELLEHLAAKCCIGNREPHMFIHEFIPTLEGEQGICYTHPENLPGAKKDGSYVHFFHRTTNAYATGQRKRRKIHHQQGLTEEHVRWHKTGKTKAIIEDGAHKGFKKIMVLYVRSSENGSRSYKSNWVMHQYHLGTVEEEKEGEYVVSKIFCQQQKQTEKNEGNPMAEDPDNIISRTGPRTPKPNPPNPPRAGKSVDCDDNIDETVLLSSALDTKTIPGESHAPQSDIQDQDFTGNAAWLAGESQAEESTKYDGCDDILLCKEILDSSAILNDPGLDSTNLEDIAGYATQRARNDNESCGISVLDSLELDTPDFDLSSLYFCSQDSILDWMDRL

SEQ ID NO: 746 - protein, 446 aa, Staphylococcus aureus subsp. aureus Mu50
MPKRTFTKEDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILEAGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 747 - protein, 182 aa, Triticum aestivum
  unsure (1)..(182): unsure at all Xaa locations
MAPTVMASSATSVAPFQGLKSTAGLPVSRRSNGASLGSVSNGGRIRCMQVWPIEGIKXFETLSYLPPLNTXEALLKQVDYLIRSKWVPCLEFXSKVGFIFREHNASPGYYDGRYWXTMWKLPNVXGCTDATQVINEVEEVKKXEYPDAYVXRIIGFXDNMRQVQCVSFIAFKPPGCEESGKA

SEQ ID NO: 748 - protein, 419 aa, Carpopeltis phyllophora
ETDVLALFRVTPQPGVDPVEASAAVAGESSTATWTVVWTDLLTACDLYRAKAYKVDAVPNSSDQYFAYVSYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEGVNRAIAATGEVKGHYMNVTAATIENMYERAEFAKQLGTVIIMVDLVIGYTAIQTMAIWARKNDMILHLHRAGNSTYSRQKSHGMNFRVICKWMRMAGVDHIHAGTVVGKLEGDPLMIRGFYNTLLFTHLDINLPQGIFFEQDWASLRKVTPVASGGIHCGQMHQLLDYLGEDVVLQFGGGTIGHPDGIQAGATANRVALEAVVIARNEGRDYVAEGPQILQDAAKTC

SEQ ID NO: 749 - protein, 313 aa, ASPERGILLUS NIDULANS FGSC A4
MTEWKVTIIHADLTSASLTPANGDVQCQFSRQEVYEGLKGIPGTESQWPTPHPPLHSPGSRTPLPRSVNLAVAQNAEFVPSHESQGMLYIRPILFGSSACIQLTPPDKYTFCVYVTPVAAYNGINPLDALILEGFDRAAPRGTGSGKVGGNYAPVMKWSDQARREGYAITLHLDSATRSEVEEFSTAGFVGVKEKADGDGVAVVVPDSGNVVDSVTVRCILAVAARMGWAVERRVTEMVLTGHLGQIKYEELASFSEILACGTAVTVIPIKSITCKSRGNRFTYLEASVSKPGPYAAKLAATLGDIQRGKVET

SEQ ID NO: 750 - protein, 418 aa, Pseudomonas putida KT2440
MGYQKIKVPTDGTKITVNADHSLNVPDHPIIPYIEGDGIGVDVSPVMIKVVDAAVQKAYGGKRKIAWMEVYAGEKATQVYDQDTWLPQETLDAVRDYVVSIKGPLTTPVGGGIRSLNVALRQQLDLYVCLRPVLWFQGVPSPVKKPGDVDMVIFRENSEDIYAGIEWKAGSPEANKVIKFLKEEMGVTKIRFDQDCGIGVKPVSKEGTKRLVRKALQYVVDNDRESLTLVHKGNIMKFTEGAFKDWGYEVARDEFGAELLDGGPWMKFKNPKTGREVIVKDAIADAMLQQILLRPAEYDVIATLNLNGDYLSDALAAEVGGIGIAPGANLSDTVAMFEATHGTAPKYAGQDKVNPGSVILSAEMMLRHMGWTEAADLIIKGTNGAIAAKTVTYDFERLMEGAKLVSSSGFGDEMIKHM

SEQ ID NO: 751 - protein, 831 aa, Streptomyces coelicolor A3(2)
MKAVVMAGGEGTRLRPMTSSMPKPLLPVVNRPIMEHVLRLLKRHGLNETVVTVQFLASLVKNYFGDGEELGMELTYANEEKPLGTAGSVKNAEEALKDDAFLVISGDALTDFDLTDLINFHKEKGSLVTVCLTRVPNPLEFGITIVDEEGKVERFLEKPTWGQVFSDTVNTGIYVMEPEVFNYVDPDVPVDWSGDVFPQLMKEGKPIYGYVAEGYWEDVGTHESYVKAQADVLERKVDVDIDGFEISPGVWVAEGAEVHPDAVLRGPLYVGDYAKVEAGAEIREHTVIGSNVVVKSGAFLHKAVVADNVYVGPHSNLRGCVVGKNTDIMRAARIEDGAVIGDECLVGEESIIQGNVRVYPFKTIEAGAFVNTSVIWESRGQAHLFGARGVSGILNVEITPELAVRLAGAYATTLKKGSTVTTARDHSRGARALKRAVISALQASAIDVRDLENVPLPVARQQTARGSAGGIMIRTTLGVPDSVDIMFFDGQGADLSQGSQRKLDRVFARQEYRRAFPGEIGDLHFPSSVFDSYTGSLLRNVDITGIAESGLKVVVDASNGSAGLVLPSLLGKLGVDSLTINPGLDEARPTESADMRRSGLVRLGEIVASSRAAFGVRFDPVGERLSLVDEKGRIIEDDRALLVMLDLIAAERRSGRVALPVTTTRIAEQVAAYHGTQVEWTTTSPDDLTRVGGEEGAIFGGDGKGGFIVPEFSSVYDGTAAFVRLIGLVARTQLTLSQIDARIPRAHVLKRDLATPWAVKGLVMRRVVEAAGDRFVDTTDGVRVVETDGRWVMVLPDPAEAVTHLWAEGPDDASAQALLDEWAAVVDSAGR

SEQ ID NO: 752 - protein, 478 aa, Gelidium pluma
IKNQRYESGVIPYAKMGYWDPDYVVKETDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIIMIDLVIGYTAIQTMAIWARKNDMILHLHRAGNSTYSRQKNHGMNFRVICKWMRMAGVDHIHAGTVVGKLEGDPEMIKGFYNTLLLTHLDKNLVQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 753 - protein, 577 aa, Oryza sativa (japonica cultivar-group)
MQGSSTSILHFVPSDPTSTSVLDFLSPTPRGTSPVHDRRLHAGDLALRAGGDRLLVADTVAAVVESLVQAWRQVRMELLVPLLRGAVVACMVMSVIVLAEKVFLGVVSAVVKLLRRRPARLYRCDPVVVEDDDEAGRASFPMVLVQIPMYNEKETMQVYQLSIGAACRLTWPADRLIVQVLDDSTDAIVKELVRKECERWGKKGINVKYETRKDRAGYKAGNLREGMRRGYVQGCEFVAMLDADFQPPPDFLLKTVPFLVHNPRLALVQTRWEFVNANDCLLTRMQEMSMDYHFKVEQEAGSSLCNFFGYNGTAGVWRRQVIDESGGWEDRTTAEDMDLALRAGLLGWEFVYVGSIKVKSELPSTLKAYRSQQHRWSCGPALLFKKMFWEILAAKKVSFWKKLYMTYDFFIARRIISTFFTFFFFSVLLPMKVFFPEVQIPLWELILIPTAIILLHSVGTPRSIHLIILWFLFENVMALHRLKATLIGFFEAGRANEWIVTQKLGNIQKLKSIVRVTKNCRFKDRFHCLELFIGGFLLTSACYDYLYRDDIFYIFLLSQSIIYFAIGFEFMGVSVSS

SEQ ID NO: 754 - protein, 276 aa, Xanthomonas axonopodis pv. citri str. 306
MFVKGKKTALVTGASSGMGKAIAHRLIQDGYQVYVAARNVDRMADLALLGAHPLCMDVSRDDDIVAGVNTILAQTGGVDVLVNNAGFGLYGPIEEIGIHEARYQFEVNLFGAARLTQLLLPAMRSKRAGHIVNITSMGGKMYSILGAWYHATKHALEGWSDCLRLEVAEFGIKVVIVEPGVIETGFGDAATDSIAKRSASGPYGRLVQMVTKSIDTTYGHGKGSDPRVIADVVSRAVASNNPRTRYAAGKFARMLIRMRVWLGDRMFDRIILSQTR

SEQ ID NO: 755 - protein, 477 aa, Hymenena venosa
KNERYESGVIPYAKMGYWDPDYVIKETDVLALFRVSPQPGVDPVEASAAVAGESSTATWTVVWTDLLTACDLYRAKAYKVDAVPNTTDQFFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQLFMRWKERFLYSMEAVNRSIAATGEVKGHYMNVTAATMEDMYERAEFAKQLGTVIIMIDLVIGYTAIQTMAIWSRKNDMILHLHRAGNSTYSRQKIHGMNFRVICKWMRMAGVDHIHAGTVVGKLEGDPLMIKGFYDTLLLPYLDVNLPLGIFFQQDWASLRKVTPVASGGIHCGQMHQLLDYLGNDVVLQFGGGTIGHPDGIQAGATANRVALESMVIARNEGVDYVTEGPQILRDAAKTCGPLQTALDLWKDITFNYTSTDTADFVETPTANV

SEQ ID NO: 756 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGH

SEQ ID NO: 757 - protein, 372 aa, Pyrobaculum aerophilum str. IM2
MLEISLEIPTQFKTEVKEPQVFRVLGQDGSPLETYEVGYKPSEGELAKAYRWMVLGRVLDRYALMYHRMGKVKSTYGPHEGHEAADAGTALALRPEDWVAPYYRNLTLLIARGVPLEVIWAKFFAKLGDPDKGRNLTIEWGGFKQWRILSIGAPIGHQYIYAAGFAYALKYLKKKEVVAAYIGDGGTSTNGFHTGLNFAGVFKVPAAFFIYNNQYAISVPVSIQTAVSRLSTKAAAYGLVGVSADGMDLLAVVKTAMWAVEKARRGEPTLVEYVMYRFGPHTTADDPLTKYRDPKEVEEYRRWDPLARLEKFLIRQGIYSEGDVKTIWEEAEREVKEAAKEAEALPDVPAEELINDVYSFVPKSLREWLEWL

SEQ ID NO: 758 - protein, 510 aa, Zea mays
MATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 759 - protein, 427 aa, Audouinella arcuata
IEASAAIAGESSTATWTVVWTDLLTACDLYRAKAYKVDAVPNTTDQYFAYISYDIDLFEEGSIANLTASIIGNVFGFKAVKALRLEDMRLPVAYLKTFQGPATGTVVERERMDKFGRPFLGATVKPKLGLSGKNYGRVVYEGLKGGLDFLKDDENINSQPFMRWRERFLYSMEGVNRAQAAAGEIKGHYLNVTAATMEDMYERAEFAAELGSVICMIDLVIGYTAIQSMAIWARKEDMILHLHRAGNSTYSRQKIHGMNFRVICKWMRMAGVDHIHAGTVVGKLEGDPVMIKGFYNTLLDSKLPVNLPQGIFFEQDWASLRKCTPVASGGIHCGQMHQLLDYLGDDVVLQFGGGTIGHPDGIQAGATANRVALETMVVARNEGRDYVAEGPQILRDAAKTCGPLQTALDLWKDISFNYTSTDTADFV

SEQ ID NO: 760 - protein, 440 aa, Schizosaccharomyces pombe [sequence omitted]

SEQ ID NO: 761 - protein, 349 aa, Xylella fastidiosa 9a5c
MTVKAYGAYAADKPLESLDITRRAPGAHDVQIDIAYCGVCHSDLHQVRAEWAGTQFPCVPGHEIVGRVSAVGAHVSGFQPGDLVGIGCIVDSCKHCDDCAEGLENYCDEMVGTYNGPTPDAPGHTLGGYSQQIVVHERYVLRIRHDESQLAAVAPLLCAGITTYSPLRHWNAGPGKKVGVVGIGGLGHMGIKLAHAMGAHVVAFTTSESKRDAAMALGADEVVVSRNPGEMAAHGQSFDFILNTVAAPHDLNAFMTLLKRDGTMTPVGAPASPHPSPEVFNFILKRRSLAGSAIGGIPETQEMLDFCAEHNIVADIELIRAEEINDAYERMLKGDVKYRFVIDNASLAA

SEQ ID NO: 762 - protein, 378 aa, Oryza sativa (japonica cultivar-group)
MASAASVEEPAAAAAAAAETKRGPSGASFIREHLRSLAPYQPILPFEVLSARLGRKPEDIIKLDANENPYGPPPEVAKALGNLKFPYVYPDPESRQLRAALAEDSGLESEYILAGCGADELIDLIMRCVLEPGDKIVDCPPTFTMYEFDASVNGALVIKDVAQIVKVVEQEKPKSIFLTSPNNPDGSIINDEDLLKILDLPILVVLDEAYIEFSSLQTRMSWVKKHDNLIVLRTFSKRAGLAGLRVGYGAFPLSIIEYLWRAKQPYNVSVAAEVSACAALQNPTYLEEVKNLLLQERDRLYDLLKEIPFLKPFPSHSNFILCEVTSGKDAKKIKEDLAKMGVMIRHYDKKELKGYIRISVGKPEHTDALMKGLKALQL

SEQ ID NO: 763 - protein, 348 aa, Zea mays
  unsure (1)..(348): unsure at all Xaa locations
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHXEGWCPRKVGLSLPQAKMAPMVXLLVVNGGQVPXLRWVNIGFQWLAGHHKLALLXLAXGHSWTTXGIIGGLGXQLVHAITATQKXLVDGPSAKDWRGGRAASFNIIPSSTGAAKXAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 764 - protein, 144 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 765 - protein, 232 aa, Bacillus cereus ATCC 14579
MIYSCYPIIIFRENREMTNNNQIGENKEQTIFDHKGNTIMTEDREIHIISKFEEPLIVVLANVLSDEECDELIEMSKNKMERSKIGSSRDVNDIRTSSGAFLEDNKLTSKIEKRISSIMNVPASHGEGLHILNYEVDQQYKAHYDYFAEHSRSAANNRISTLVMYLNDVEEGGETYFPKLNLSVHPRKGMAVYFEYFYQDQSLNELTLHGGAPVTKGEKWIATQWVRRGTYK

SEQ ID NO: 766 - protein, 358 aa, Wolinella succinogenes
MKKYEIAIIKGDGIGPEIVDEAKKVLDAISYSHGFELSYHDYLMGGIAVDRAGVPLPDETIEGCLRADAVLFGAIGGEKWDSLPRELRPESGLLKLRKSLEIFANLRPTVVYDELIEASTLKESVIKGVDILVVRELIGGIYFGEPKGREGDKAFNTMVYSVPEIERIAHVAFKAAMRRQKRVCSVDKANVLDVSQLWRETVTRIAKEYPEVELSHMYIDNAAMQLIRNPKQFDVILTGNLFGDILSDEASMLSGSIGLLPSASIGGKAALYEPIHGSAPDIAGQGIANPIATIASASMMLRHSLGEVEAADAIDKAIVKTLKEGYRTKDIAAFGAKEICTTDEMGSIIANYAAKKGE

SEQ ID NO: 767 - protein, 311 aa, Lycopersicon esculentum
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDVLWKLEYALRLQESVI

SEQ ID NO: 768 - protein, 668 aa, Shigella flexneri 2a str. 301
MRIADDQNSLRAGNRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKAMKAKGVHAKLLYSRMGEVTADDGTVLPIAATFAGAPSLTVDAVIVPCGNIADIADNGDANYYLMEAYKHLKPIALAGDARKFKATIKVADQGEEGIVEADSTDGSFMDELLTLMAEHRVWSRIPKIDKIPA

SEQ ID NO: 769 - protein, 192 aa, Arabidopsis thaliana
ALVIFNQLYPDHRTKEITKSIEKAVQFIESKQLRDGSWYGSWGICFTYGTWFALCGLAAIGKTYNNCLSMRDGVHFLLNIQNEDGGWGESYMSCPEQRYIPLEGNRSNVVQTAWAMMALIHAGQAKRDLIPLHSAAKFIITSQLENGDFPQQELLGASMSTCMLHYSTYKDIFPPWALAEYRKAAFIHHADL

SEQ ID NO: 770 - protein, 200 aa, Methanosarcina acetivorans C2A
MKIVFINNKDSFVWNLVDYISYFEKDTLVLPNTVTLEELREIKPDALVISPGPGNPSDPKDIGNCLEIIREMGREIPLLGVCLGHQAINVAFGGPVRRCKVGPVHGKSSRIQHTESPLFTTLNEQFEAGRYHSLEIGEPAPGIKITARAEDGTIMAVEHEKYPIYGLQFHPESVLTPEGLKIIERFLEISKNFTKRQPAV

SEQ ID NO: 771 - protein, 154 aa, Glycine max
  unsure (1)..(154): unsure at all Xaa locations
GVFVFTLDPMYGEFVLTQENSPEPKSXGKIYAFNEGNYQLWDEKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 772 - protein, 416 aa, Actinosynnema pretiosum subsp. auranticum
MAAPAGDSLVALLFLDLAVVLALGALLGALARRLGQPSVVGEVAAGIALGPSLLGLLPGDPVALLFPPEARPPLAFAAQLGLVLFMFLVGCELDVAELRGAGRVVGAVSAGSVVLPFCLGLGVAALLWPQGGDALALFTAAALSITAFPVLARILAERRMQRTRSGVVALASAAVNDVVAWCALAVVAGIVTARGPWSAVATLAWTAALVLVAVLLVRPLVGWVARTVGGSPRADAVLFAVVVQGLLLFALATTAIGLHAVFGAFLFGAVVPKDALREAAPTLVDRVGGLSSLLLPVFFVVAGLSVDVGGLGWSGAAEALLVLVAACVGKLVGAAGGGLLAGLPARDAAEVGVLMNARGLTELVVLGVGLELGVLDGRLFTVLVVMALVTTAATGPLLTLIARRSGREVAALEGLR

SEQ ID NO: 773 - protein, 303 aa, Thermosynechococcus elongatus BP-1
MSDFLPYAYLNGQFVPFEEAKISVATHALHYGTAALGGLRGLPNPANPKEILLFRLEDHCRRLSRSAYYLGYELPTSEIKARIIEWVQKNQPRVPFYIRPLVYTSGLGIAPRLHDIEKDFLIYGLPLGDYLAATGVTCRISSWQRQCDRSFPLRGKLTTSYIVSALAKTEAVSSGFDEAILLNEQGKVCEATGMNLFLVREGQLITPSVDQDILEGITRRSVIELAQAAGVKVMERPVDRTELLIADEVFLTGTAARIVPVSRIETYTLPSDRPLTLQLQKQLQAIVEGREPQYRHWVDVIPL

SEQ ID NO: 774 - protein, 221 aa, Oryza sativa
MFIGRDGGRGVEFRRRATTVDGPEEDAAVDVKVITSDADIIIDLGADDDDDTPERVLRPVVTRPARRELDWCEPAEVKHVDLAELMTPRASSASASSEKSISTGKPRRSSVSSRRRLKTRTNSPRLAACRKGKPTARATTTTPTTPLAHSFAVVKTSSDPRRDFLESMEEMIAENGIRDAGDLEDLLACYLSLNSGEYHDLIVEVFEQVWTGLAAACGVMP

SEQ ID NO: 775 - protein, 478 aa, Schizosaccharomyces pombe
MNLICSILPKKEPSYLKLWRKQVIYQVLTDRFALDEDNFYAKASGNLYLGGTWKGITRNLDYIKSLGCTAIWISPIVKNISETTDCGQAYHGYWAQDMTQLNENFGTEEDLKELVNAIHEKNMLCMVDIVVNHMGHAGSKPVNFLLYQPFNSGKYYHNWQFVQNYDDPHETITGWLGDSHVNLPDIRTEKNEVRKFFQNWVSDLIKRYQFDGIRLDTAKHVEKSFFPTFIEAANVFTTGEVFHGDPKVVGDYQKYLPSTLNFPLFFQLRETFLDPKHSMFSFYDKAVLDVRHYFKDVTVLCNFLENHDFPRFFHETKDIALALNALTALIFMDGIPIIYYGQEQMFDGGSDPDNREGLWKSKYNTSNPMFRHLSSMIRTRQNLVETYPEFTYVLSFQLYIDDSVYVFTRPGVIIAISNEGSTSSFKVEIDLKEHWKEVPSSFTDILTQKTIPCKDHKLKIKSKSGLPKILISSDPSFL

SEQ ID NO: 776 - protein, 463 aa, Nannochloropsis gaditana
EMGYWDANYTIKDTDVLALFRITPQPGVDPIEAAAAIAGESSTATWTVVWTDLLTACDVYRAKAYKVDSVPGTSDQFFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLIGSVIIMIDLVIGYTAIQSMAIWSRKNDMILHLHRAGNSAYARQKNHGINFRVICKWMRMAGVDHIHAGTVVGKLEGDPLMVKGFYNTLLQTSLNINLPQGIFFEQDWASLRKTLPVASGGIHCGQMHQLLNYLGEDCVLQFGGGTIGHPDGIASGATANRVAMECVLLAKYEGKDYINEGPKILRAAAESCAPLRTALDLWKDIAFNYTSTDTADYVETTTKQ

SEQ ID NO: 777 - protein, 492 aa, Helianthus annuus
MDPYKQRPSSAYDTPFWTTNAGAPVYNNTASLTVGNRGPILLEDYHLIEKLANFTRERIPERIVHARGASAKGFFEVTHDITHLTCADFLRAPGVQTPVIVRFSTVIHERGSPETIRDPRGFATKFYTREGNFDIVGNNFPVFFTRDAMAFPDVIHAFKPNPKSHIQEDWRILDFLSHHPESLNTMTFWLDDVGIPTDYRHMEGSSVNTLTLVNKEGKIHYVKFTWKPTCGVKCLMDDEAIKIGGANHSHATQDLYDSIQAGNFPEWKLFLQVIDPDHEDRLDFDPLDGTMTWPEDVIPLQPVGRMVLNKNIDNFFAENEQLAFNPGLVVPGIYYSDDKMLQGRIFAYSDTQRHRLGPNYLQLPVNAPKCAHHNNHYDGHMNFMHRDEEVDYFPSRYDRVQHAQKYPINPARVTGTRDRTVIPKYNDFKQPGERYRSWDPARQERFIVRMCKMLSDPRVTHELRSIWISYWTQADKSLGQKIASRLNVRPNY

SEQ ID NO: 778 - protein, 416 aa, Zea mays
MAAAARPASAHLLLLAPLPSPPRLSHLIHTRRLYALAPARRPAAVRARREPSPPSAPSPSAPADSFDCVGTGSDVECFVDAGAEDAAPLLPALSAGASKDDRKSEGDAAVSASPAGRELWEWASLVSPFFFWGTAMVAMKGVIPRTGPFFVAAIRLLPAGALLVAFAAARGRKQPSGWEAWLAIAAFGLIDAACFQGFLAEGLQKTSAGLGSVIIDSQPLTVAILASLLFGESIGAIGVGGLVLGVVGLLLLEVPALSVEGNDTTIWGSGESLMFLSAQSMAVGTIMVRWVSKYSDPIMATGWHMIIGGLPLLVISVLNHDPALSGHIQDLTWSDILALGYTSIFGSAVSYGVYFYNATRGSLTTLSSLTFLTPMFASVFGYLYLGETFSPVQIGGALLTLVAIYMVNYKSIIGEK

SEQ ID NO: 779 - protein, 493 aa, Xanthomonas axonopodis pv. citri str. 306
MYRMLKSLLRVKPIEPAGHVDAGEPVEGSLQGEATLQRTLTAKHLIMLGIGAVIGAGIFVLTGQAAANHAGPAVMLSFVFAGIACAFAGLCYAEFAAMMPVSGSAYSYSYATLGEGIAWFIGWCLVLEYLFAGSSVAVGWSAYLISFITGTLGLPFPAELAGAPLAWDGHGFVSSGNLVNLPAVLIVAAVSILCYVGVTQSAFANAIVVAIKVVVICLFVGFGIAYIDPANWHPFIPENTGPGQFGWDGVFRAASIVFFSYIGFDAVSTSAGETKDPQKNMPIGILVSLAICTIIYIIVCAVLTGLLPYTQLGTAKPVATALEAHPQLTWLKTAVEIGAIAGLSSVVLVMLMAQPRIFYTMAKDGLMPKLFGKVHPKFRTPYVGTLFVGVVAALLAGVIPLNVLGELVSMGTLLAFATVCAGVLVLRFTKPDLARPFRVPLAMVICPLGALACLFLFFQAFQEHWKVFVGWTVIGLAIYFGYGIHHSRLAKRA

SEQ ID NO: 780 - protein, 291 aa, Halobacterium sp. NRC-1
MPAKSYVDLPQYNGDFRSMPAYMDAGDWDAAGIKWVNVHPDNPADHDLPTVMGTMVYSDPETAFPLALMDGTELTMKRTGAAAAVATDHLAVADATSFGVVGAGVQAYTQLEAISKIRDIEEVVVSDVSDDAVQQYVDHFSDRFDVRGGSISEAGHCDILSTVTPVEDPIVTAEDVGDHTHINAMGADAEGKHELADDILLAGTLVIDDHAQTTHSGEINVPYHEDTLADDDIDAEIGEIVVGNADGRTDSDGVTVFDSTGLAIQDVAAAHVVYEHASEHDNGYEFDLLGV

SEQ ID NO: 781 - protein, 306 aa, Xanthomonas axonopodis pv. citri str. 306
MSYRDTIDIRMPHVDIHCRAMTHTDIPTPLADWIVAQAVAGHPPEQALQPLLDQGWNEQDAIDAVEALVRAHIQQHAQANGLPMPVRVPALQQDTDASLLALGDREVRVLVSLLLPRVVVLGGFLSDGECDALIALARPRLARSRTVDNANGEHMVHAARTSDSMCLRVGQDALCQRIEARIARLFDWPVDHGEGLQVLRYATGAEYRPHYDYFDPDAAGTPILLQAGGQRVASLVMYLNTPERGGATRFPDAHLDVAAVKGNAVFFSYDRPHPMTRSLHAGAPVLAGEKWVATKWLRERAVRMPT

SEQ ID NO: 782 - protein, 633 aa, Zea mays
MFSWSRKQSSSGSSSGRRRGGADASMDSSSRGGGGSGSRGRSPRLDRRNAVKRIEYEASAGASASWSSSSSAEQQRSPGLRPSRSLDLAPGADLRISGSVEGEVDELCRSLGLSGPEDFAVPVAAWEARKSRSNSDLLPRSRLDPSTPADETSPIARAVSAPGAQPTRSFPAPIPEESLHSSPASTATESAEEPTVAAPEESPNAAPASAVVAPVGGLPLPSPRRGGGEVGIRGARPPLLSPPPPIGALAPPPVRRSFVDNDMTGSAWDIVQSFAPRDQGSELGLGGSVDSRCNSDKEEENDVEDGDAAVEGELKELRIGETFEGFTGTSSLSTTNDDDASSTTTEAMFIISPNGKFKRNIKSWMRGALLGSGSFGMVYEGISDEGAFFAVKEVSLLDQGSNAQQSIVALEQEIALLSQFEHENIVQYYGTDKEESKLYIFIELVTQGSLSSLYQKYKLRESQVSAYTRQILNGLVYLHERNVVHRDIKCANILVHANGSVKLADFGLAKEMSKINMLRSCKGSVYWMAPEVINPKKMYGPSADIWSLGCTVLEMLTRQIPFPNVEWTNAFFMIGRGEQPTIPNYLSKEAQDFIGQCVRVDPESRPSASQLLEHPFVNRPLRASFESSSPPAI

SEQ ID NO: 783 - protein, 120 aa, Triticum aestivum
  unsure (1)..(120): unsure at all Xaa locations
VVTVDEDKMPVFYGGGAHINLKVNGLDGIEVFFTIKRSTQLEXLMNAYCDRXSVDLNFIAFLFDGAMLTGEQXPLHDLEMEEGDQIDSLLNTTGGCFLGPYKELCCTLIDLCRTLPLELE

SEQ ID NO: 784 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAAFKADHEFLLRGGVFSKDWIDSYIAFKEEDVRRIRMAPHPLEF

SEQ ID NO: 785 - protein, 154 aa, Leuconostoc mesenteroides subsp. mesenteroides ATCC 8293
RIVVTAALRNGLRPIIDVDEDMSTYAQFMDAEPSVAQVAAALAGVSVDQIRNVTLAYEPTWAIGSGEAASAVQAQKAAHLIRQTLAKLYSPVIAEQVRVLYGGSVTPDNAREIMLQKDIDGVLVGTSALDPEKFLQLVAIAQDPEVPEFNIENT

SEQ ID NO: 786 - protein, 199 aa, Zea mays
  unsure (1)..(199): unsure at all Xaa locations
MAYSMLSSAAVVTSPAQATMVAPFTGLKSSSAFPVTRKANNDITSIVSNGGRVSCMKVWPPXGKRKFETLSYLXPDLTEXXNWVRKVDYLSPATGGFLGGESRVGATGFGYRGSTGKHPPETTKGRYWEKGETFPLGRKGPHLWLKGVKEAPKGEKGEPPNRLSTGILGFQNTPGEAGGSCFFPPKKTTNFSGGLKLPL

SEQ ID NO: 787 - protein, 249 aa, Thermobifida fusca
MPSDRDPRGGCRADRGGPRRRHQGDGPHRGPHRGGDGGADLCDDGGTGVDRHGQGPRPGSGGDRRAGRGEDRRENRPVETVGMTAAAPRAVVITVSDRAAAGEYPDRSGPLLVELAAQAGCVVDGPRVVPDGLPVAEALRRALAEGYDVALTTGGTGLAPRDRTPEATRPLLEYEIPGLAEALRAAGRDKGVPTAVLSRGLAGVARRGGHRMLVVNLPGSVGGVRDGMAVLGPILGHAVAQLRGGDHHA

SEQ ID NO: 788 - protein, 149 aa, Oryza sativa
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYEGRYWTMWKLPLFGCTDSAQVLKEVEECKKEY

SEQ ID NO: 789 - protein, 569 aa, Oryza sativa
MDMDEPGGAAAAAADANNGAGSKDCPLPPPPPKTAKACAAAKKPRSQQQERKLSRQDRVELSRSFQHAVSSHDWDGAEALVRRADAQGLNDVLCVAVDAIWFLSDKEELAAVVALIRRIVSEGANDFTRAALRTSFLASCVSACRGRTTSLADAVSFMGQKLNERLQESHGDEVLKAEASAKVHKFTEWALKCIGLHSRVRENKGRGNHGTIIEVQLQLSAFKTFLDLADNDLTGKDFTEAFDAACFPLTLFSNTFDQGWASGISAAAIQGLLELLVEGGADNVNQCFLEAARYGSTELVRILLQIARRNSLDIDVDLALGFAAHYGKLDTMGCLVEEGNAVAFLGPLMRAAERGCLQVVEWFVNLGCRDMELCLALTAATSSSQVAVAAYLLPLVPKHVLAPLSVEILKAAGERSTGSLHGVDFLLRSNFLNDPAATYAVADNIAKSADEAVDAKLRSFMLEHWSEAAFSEGFASAQEHFVNFMRIMEKGESPICLRDLPLELVIAMAYLPLYRECVESGGRLLPQKLRGQLVEAAGRLEGRQLDRASQGTELLAILEHHLPCFMIQT

SEQ ID NO: 790 - protein, 143 aa, Synechococcus sp. PCC 7002
DPVMATGWHMILGGIPLFIASDQLETLQWQFISTSGWWALAYATIFGSAIAYGLFFYLASEGNLTSLSALTFLTPVFALIFGNVLLNEKLSPLQWVGVGLTLVSIYLINQREKIAAWFSQAEAAAGVGTPQDSKIPVESSKRN

SEQ ID NO: 791 - protein, 379 aa, Triticum aestivum
  unsure (1)..(379): unsure at all Xaa locations
HEGGILLCVTGSEAMYADLGHFSQRSIQIAFISVVYPALVLAYMGQAAYISQHHSFENSYHIGFXRPRTRGLRWPVLVIAILASVVGSQAIITGTFSIIKQCSALSCFPGVKIVHTSSTVHGQIYIPEINWILMILCLAVTIGFNNTKHLANAQGLAVITVMLVTTCLMSLVIVLVWNKSIFIALGFLMFFGSIEVMYFSASLGKFHEGAWVPITLSFIFMVVMSVWHYGTIKKYEFDVQNKVSVNWLLNLGPSLGIVRVRGIGLIHTELMSGIPAIFSHFVTNLPAFHQVLVFLCVKSVPVPHVEPEERFLVGRIGPKEYRLYRVIVRYGYRDVQQDDLEFEKELINSIAEFIRSGGSDQNGFVEGSEKLSSISSGAI

SEQ ID NO: 792 - protein, 313 aa, Brachyspira hyodysenteriae
RIGRLVFQALVERGLLGKEIEVVGVVDVSTDAKYFAYQLKYDSVHGRMKADITTEGEDVLVVNGNKIKCIGATKELKDLPWKALGVEYVIESTGLFTEKEKAEGHIAAGAKKVIISAPGKGDLRTFVYGVNHEEYDPANHHVVSNASCTTNCLAPIVHVLLKEGIGIETGLMTTIHSYTATQKTVDGPSKKDWRGGRAAACNTIPSTTGAAKAVGEVLPATKGKLTGMSFRVATPDVSVVDLTFRSEKETSIKEIDVLMKKASETYLKDILGYCNEELVSSDFIHDSRSSIYDSLATTQNNLKDEKRFFKIVS

SEQ ID NO: 793 - protein, 456 aa, Solieria chordalis
YVVKDTDVLALFRVSPQPNVDPIEASAAVAGESSTATWTVVWTDLLTACDLYRAKAYKVDTVPNTSDQYFAFIAYDIDLFEEGSIANLTASIIGNVFGFKAVKALRLEDMRIPVAYLKTFQGPATGLVSERERMDTSGRPFLGATARPKLGLSGKNYGRVVYEGLRGGLDFLKDDENINSQPFMRWKERFLYAMEGVNRSIAATGEVKGHYLNVTAATMEDMYERAEFAKQLGTVIVMIDLVIGYTAIQTMGIWARKNDMILHLHRAGNSTYSRQKIHGMNFRVICKWMRMAGVDHIHAGTVVGKLEGDPLMIRGFYNTLLLPYLAVNLPQGIFFEQDWASLRKVTPVASGGIHCGQMHQLLDYLGIDVVLQFGGGTIGHPDGIQAGATANRVALESMVMARNEGRDYVAEGPQILQDAAKTCGPLQTALDLWKDITFNYTSTDTADFVETPTANV

SEQ ID NO: 794 - protein, 214 aa, Glycine max
MEQEEHEVYGADIPDEEIDMDADAEQQDEQLAPNHTNKELEDMKKRLKEIEEEASALREMQAKVEKEMGAVQDSSGTSATQAEKEEVDARSIYVGNVDYACTPEEVQQHFQSCGTVNRVTILTDKFGQPKGFAYVEFVEIDAVQNALLLNESELHGRQLKVSAKRTNVPGMKQYFGRRPAGFRSRRPFMPAPFFPPYGYGRVPRYRRPTRYRPY

SEQ ID NO: 795 - protein, 583 aa, Bromus tectorum
LRPWGPSEPRKGADILVEALERCGIVDVFAYPGGASMEIHQALTRSPVITNHLFRHEQVEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPAWDTPMSLPGYIARLPKPPSTESLEQVLRLVGEAKRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNDLLNGSKAQKSLDFGPWQEELEQQKRTFPLGYKTFGEAIPPQYAIQVLDELTKGEAIIATGVGQHQMWAAQYYSYKRPRQWLSSAGLGAMGFGLPAAAGASVANPGVTVVDIDGDGSFLMNIQELALIRIENLPVKVMILNNQHLGMVVQWEDRFYKANRAHTYLGNPENESEIYPDFVTIAKGFNVPAVRVTKKSEVRAAIQKMLDTPGPYLLDIIVPHQEHVLPMIPSGGAFKDIIMEGDGRIEY

SEQ ID NO: 796 - protein, 372 aa, Populus deltoides
MLKQESSGSGGGDNRARLCDTCRAAACTVYCRADSAYLCAGCDARVHAANRVASRHERVWVCESCERAPAALLCKADAASLCTACDADIHSANPLARRHQRVPILPISGCLHGSQVGPAAGETEDRFTTQEGEETISEEEEEEEDEAASWLLLNPVKNSKNQNNNGFLFEGEVDEYLDLVEYNSCTENQCSDQYNQQHYCVPPKSYGGDRVVPIQYGEGKDHQQQRQYHNFQLGLEYEPSKAAYSYNGLISQSVSMSSMDVGVVPESTMSEISISQHRTPKRTIELFSSTAIQMPSQLSPMDREARVLRYREKKKTRKFEKTIRYASRKAYAETRPRVKGRFAKRKDVEVEDDRTFSSTLMAGTGCGIVPSF

SEQ ID NO: 797 - protein, 221 aa, Zea mays
MGEEASCNAVSAMEAATNARPAKENGRAPAVAEVVAQEAAADPRLQGISDAIRVVPHFPKHGIMFNDITTLLLRPRVFKDAVDLFVERYRGMRIDAVAGIEARGFIFGPAVALAIGAKFIPLRKPRKLPGEVISEKYVLEYGTDCLEMHVGAIERPGERVLITDDLVATGGTLCAAIRLLERAEADVVECACLIGLPKFKDFYKLNGKPVYVLVESRESDK

SEQ ID NO: 798 - protein, 158 aa, Zea mays
  unsure (1)..(158): unsure at all Xaa locations
QIEKAQEIAKAELAAAVAKEKASQIEQIAEANLNDIDALCMAFYARSEXTRQSHSVHKLALGTLALEHALSSGSPIRSEVELLRKSVEGIDKDSLLELALSSLPEDVLDYGSDTMMGLKQKFNSLKETIRHFPPVTRANKFWRSALYLLAVLTILVAR

SEQ ID NO: 799 - protein, 326 aa, Hordeum vulgare
MDGKGYTTPPTAPAPQAEAGAPHFYPPTEHGTAPQPGSQVSYPPMPKAMDGQDAAAPQPGAPPHPSSPLTQQAMELEGKYAAPQPGTGATPSPLTQQAVDGKDAAPTPPAESARWGTRQMGPPAAPGAHPENQQAAQWTATRGDQELPPYVIMGAPEPAPAASARRTDKEARDSPMEHILDFFNTWSRKAEELSSNIWLNLKTAPSMSDAAMGKLSLGAKAITGGGFEKLYKQTFGSGPDEHVKKTFACYLSTATGPVAGTLYLTNTNVAFCSDRPLSFAAPSGQTAWSYYKVMIPLAKLAAVEPVTAKESPPERYIHIVAAPAYE

SEQ ID NO: 800 - protein, 474 aa, Gracilariopsis panamensis
RYEYGVIPYAKMGYWDPDYVIKDTDVLALFRVTPQPGVDPVEASAAVAGESSTATWTVVWTDLLTACDLYRAKAYKVEAVPNTTDQYFAFIAYDLDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTHLEINLPQGIFFEQDWASLRKVTPVASGGIHCGQMHQLLDYLGNDVVLQFGGGTIGHPDGIQAGATANRVALEAMVMARNEGRDYVAEGPEILRVAAKTCGPLQTALDLWKDITFNYTSTDTADFVETPTANV

SEQ ID NO: 801 - protein, 95 aa, Glycine max
  unsure (1)..(95): unsure at all Xaa locations
ASSKISFPVVTTDNRAGAGMVAPFTGLIFMAGFPTIKTNIDITSIASNGGRVQXFQVWPPAGNKKFETLTFLTDLDNAQLSNEVKYLLKKGWIPC

SEQ ID NO: 802 - protein, 392 aa, Zea mays
MAAAILRRLVPTAASQLVAPLPLLARGVSDSADAVTVDTSVPFKSHIVDPPPREATTSARELLSFFRDMSLMRRFEIAADSLYKAKLIRGFCHLYDGQEAVAVGMEAAATRADAIITAYRDHCAYLARGGDPVAAFAELMGRRDGCSRGKGGSMHFYKRDANFFGGHGIVGAQVPLGCGIAFAQRYRKEGTVTFDLYGDGAANQGQLFEALNMAALWKLPVILVCENNHYGMGTAEWRASKSPAYYKRGDYVPGLKVDGMDVLAVKQACKFAKEHALENGPIILEMDTYRYHGHSMSDPGSTYRTRDEIAGIRQERDPIERVRKLMLVHEFATAQELKDMEKEIRKQVDAAIAKAKECPLPDPSELFTNVYVNDCGLESFGVDRKEVRTVLP

SEQ ID NO: 803 - protein, 457 aa, Pelagophycus porra
  unsure (1)..(457): unsure at all Xaa locations
DYNVKDADILALFRITPQPGVDPVGAAAAVAGESSTATWTVVWTDLLTACDIYRAKAYRVDPVPGTSDQYFAYIAYECDLFEEGSLANLTASIIGNVFGFKAVKALRLEDMRIPFAYLKTFQGPATXVIVERERLDKFGRPFLGATVKPKLGLSGKNYGRVVYEGLTGGLDFLKDDENINSQPFMRWKERFLYCMEGVNRSAAATGEVKGSYLNITAAPIEQMYERAEYAHSIGTVIVMVDLVIGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAAATCGPLKAALDLWKDITFEYTSTDTPDFVEVATESK

SEQ ID NO: 804 - protein, 340 aa, Streptococcus agalactiae 2603V/R
MTVNLDWDNLGFAYRKLPFRYISHFKDGKWDDGKLTDDATLHISESSPALHYGQQAFEGLKAYRTKDGSIQLFRPDQNAERLQRTADRLLMPHVPTDKFIAAVKSVVRANEEFVPPYGTGATLYIRPLLIGVGDIIGVKPAEEYIFTVFAMPVGSYFKGGLTPTNFIVSKEYDRAAPNGTGAAKVGGNYAASLLPGKYAHEKQFSDVIYLDPATHTKIEEVGAANFFGITKDNQFITPLSPSILPSITKYSLLYLAKERFGMEAIEGDVFVDELDKFTEAGACGTAAVISPIGGIQNGDDFHVFYSETEVGPATRKLYDELVGIQFGDVEAPEGWIYKVD

SEQ ID NO: 805 - protein, 259 aa, Zea mays
MSNHHRFKLSHLMPNSWFYKLRDMKKPRPASTRNRQTTRTWSKRSTSHYYHGAISPKPLLPVSPHRSYCYYLNTTHSTSLEKLHPSTSTSTLHRLNTKASDIQFPTDHHRRRPASRTMVIESKHEFQDLQLRPIRTRAVLTGSISGTSPSSPRLRSRRLPPAPNGAGGISTTGSAIGGGRRRTAARRSFAVVKASADPLRDFKESMVQMIVENDMSAPEDLQELLECYLSLNSMEYHGVIVEVFREIWLQIVHDIIDED

SEQ ID NO: 806 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMCSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESAHLVLSVGALLSDFNTGSFSYSYKTKNIVEFHSDYTKIRRPTFPGVQMKFALQKLLTKVADAAKGYKPVPVPSEPEHNEDVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAASNAKN

SEQ ID NO: 807 - protein, 488 aa, Cyanidium caldarium
MAQSVQERTRLKNKRYESGVIPYAKMGYWDPNYVVKDTDILALFRVTPQPGVDPIEASAAVAGESSTATWTVIWCDLLTACDVYRAKAYRVDQVPNSPDQYFAYIAYDLDLFEEGSIANLTASIIGNVFGFKALAALRLEDMRIPIGYLKTFQGPATGVVVERERLNMFGKPFLGATVKPKLGLSSKNYGRVVYEGLKGGLNFLKDDENINSQPFMRWRERFLYVMEGVNRASAATGEIKGSYLNVTAATMEEMYNRAACAKEVGSIIIMIDLVIGYTAIQSMAIWARENNMILHLHRAGNSTYARQKNHGINFRVICKWMRMAGVDHIHAGTVVGKLEGDPIIVKGFYNTLLLPKLDVNLPQGLFFEMDWASLRKTVPVASGGIHAGQMHLLLKYLGDDVVLQFGGGTLGHPDGIQAGATANRVALEAIVLARNEGRDYVNEGPQILKEAARTCGPLQTSLDLWKDISFNFTSTDTADFVETPTANV

SEQ ID NO: 808 - protein, 477 aa, Bradyrhizobium japonicum USDA 110
MTGTPSIQKLSLFALTAMVVGSMVGSGIFSLPRTFGIATGPFGAIFAWCIAGGGMYTLARVFQALAERKPELDAGVYAYAKEGFGDYPGFLSAFGYWIGSCIGNVSYWVLIKSTLGAFFPVFGDGNTVTAIIVASIGIWLFHFMILRGVQQAAAINTIVTVAKIVPILVFIVILIFSFNADMFRGNFWGGEGMPDKGLFEQIRATMLVTVFVFLGIEGASVYSRYAKERAHVGAATLLGFAIVTSLMVLVTMLPYAVLLRAEIAGMRQPSMATVLEAVVGHWGAIFVSIGLLVSVLGAYLAWSLICAEVLSAAGRTRDMPALFGTENANKVPAAALWLTNVIVQLFVISTYWSQDAFALMLNLTSVMSLIPFFLVAAYGLLLVRRGETYEKSGSERTRDTIFAGIAVIYTLFLIYSAGMKFLLLSLILYAPGTALYFWARLEQKARVFTAVEWGIFIAAAVGAAVGIHGLATGYITI

SEQ ID NO: 809 - protein, 197 aa, Vitis riparia
MEAVDKEKLTAGTRVVLDMTTLTIMRALPREVDPVVYNMLHEDPGNVSYAAVGGLSDQIRELRESIELPLMNPELFIRVGIKPPKGVLLYGPPGTGKTLLARAIASNIDANFLKVVSSAIIDKYIGESARLIREMFGYARDHQPCIIFMDEIDAIGGRRFSEGTSVDREIQRTLMELLNQLDGFDQLGESQNDYGNQ

SEQ ID NO: 810 - protein, 336 aa, Novosphingobium aromaticivorans
MRISFGRRGRRDVAFAHGRESMSGPDPALLESMFHKLAVSRAVETLMLRHTREERFSGWWHPGEGQEAAPIGATAALEADDYVWYQGRGCAWAIGKGMDPLPILGDLLGKTNGATGGKGGGVPHWADYSLGIMGEGATLGSVYPLAAGSALASKIRKDGRVSLANFGDGTASRGTFHETMMHAAAWKLPLIYFCENNGLLVGTRTEQVSATADIANLAKGYGIPGVIVDGQDAVAVWEATREAAARARAGKGPTLIEAKVTRKHGHYAGDPQHYRDPDYLRDYRDPLDLLAARLAGNVAARIVEQADAEVAAAYEAARAAPEPDVSVIERDLYHVV

SEQ ID NO: 811 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKIDKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEETQLLYEEGIKPWKSASWVPPSRRGASSRETEAKKKSWKEVLKFPKSFN

SEQ ID NO: 812 - protein, 360 aa, Populus tomentosa
MGSTGETQMTPTQVSDEEAHLFAMQLASASVLPMILKTAIELDLLEIMAKAGPGAFLSTSEIASHLPTKNPDAPVMLDRILRLLASYSILTCSLKDLPDGKVERLYGLAPVCKFLTKNEDGVSVSPLCLMNQDKVLMESWYYLKDAILEGGIPFNKAYGMTAFEYHGTDPRFNKVFNKGMSDHSTITMKKILETYKGFEGLTSLVDVGGGTGAVVNTIVSKYPSIKGINFDLPHVIEDAPSYPGVEHVGGDMFVSVPKADAVFMKWICHDWSDAHCLKFLKNCYDALPENGKVILVECILPVAPDTSLATKGVVHVDVIMLAHNPGGKERTEKEFEGLANGAGFQGFEVMCCAFNTHVIE

SEQ ID NO: 813 - protein, 1279 aa, ASPERGILLUS NIDULANS FGSC A4
MSFLGGAECSTAGNPLTQFTKHVQDDKSLQRDRLVGRAPGMQEGMRSQGMMGGHDQMMDEFAQQSAQLPGGPQQHMRMEMEQVRQQLEQMHTTPRTGSPGWAAEFDPGEQARMEAAFAGPKGPMMNNGSGFTPAEFARFQQQSTMSVPQSASPVTAGQSPMMGGYQRSMGMGYMGYGGMGMMQPGFGPMGMQHQQPAEASTQDKGKGRMIELDDENWEAQFKEIETADQGKLDDEANAAIEAELNDLDRSVPTTSSTEDLSHFERVWERVQAETATNRKLAEDSEYNIDDNLHMGDMAEWDGFDNLNTRFREPRLGDYSFEQENVFRDIANPFEEGMKIMQEGGNLSLAALAFEAAVQKDPQHVKAWTMLGTAQAQNEKELPAIRALEQALKVDPNNLDALMGLAVSYTNEGYDSTAYRTLERWLSVKYPQIISRDDLSSDADLGFTDRQILHERVTDLFIQAAQLSPSGAQMDPDVQVGLGVLFYCAEEYEKAVDCFTTALASTESGTTNQREQLHLLWNRLGATLANSGRSEEAIEAYEQALNINPNFVRARYNLGVSCINIGCYPEAAQHLLGALSMHRVVEEEGKERAREIVGGNDGRINEAELNRMITANQSTNLYDTLRRENTVMAIRTGAQIIARSLRDLGVTVIFGIVGIPVVEIAEEAINLGIRFVAFRNEQACSYAASVYGYMTGQPGVCLVVGGPGVLHALAGIGNSSANNFPLLVLAGSAETSAVTKGAFQELDAISLLTPHTKFAARASSLDFIPDAIKNAYRTCWYGRPGPTFIDLPADIIQGKLTSQFELPKPENLLVSAPPKASGDPALILKATQLLKAASAPLIIVGKGAAYARAELGIRKLVDQTQVPFLPTPMGKGVVPDSHPLNASSARSAALKHADVVLVLGARLNWILHFGEPPKWSPKVKIIQVDICAEEIGRNAGTSELGILGDISLVVDQFRASLSSWKYSSSAKFPLLLAESAKKNEDKAQKAALRQTPAGKPLTYQRAYHIIKTALNALTPVEDGNIVYVSEGANTMDISRSIFPLYHPRQRLDAGTYATMGVGMGYIVAAHEAFNANPGASTSRPKKIVAFEGDSAFGFSAMEIETLARYRIPALIFVINNSGIYHGDSISKEDWKTLQNQTVANDTKTSESDSGTNAKTKGLRSTSLLYETRYEMLATMCGGKGYFVKSEEELERATKEGFDTLFAYFFVIFVAENLMRSHAPSSIAEWRCFTLISTTSTWKLNPIHRYITIGSQLASLLISMGLWVPTVAVRPCAVSRM

SEQ ID NO: 814 - protein, 357 aa, Streptomyces griseoflavus
MTITASGSLPPSAPVAVQILDLLMGGWRAGVVSTFAELGVADGLAAGGLTPAQLAVRLGLEHDTAERFFRAGASVGLLRRGEHDTLELTELGRALASDDGSMRNFARWTGSTAERATWAHLATAVRTGRSPFAAMHGSGVWEFMESDPDTAAVFNSAMTELSKRVIQPVIEAFDFSRFSSVTDVGGGRGALLAAVLRKHPEMTGVLFDQPDVVSRSLPELSDAAVAHRVTVKSGSFFDGVPSGSDLFMISNVLHDWDDGRSRLILRNIAEAMHEGAHIAVVEAVAGLDDTADKAISLMDMDMLLLCEGKQRTVEEFRLLMAEVGIELVGVSRAGLQSVVEGRKVSGETGTPGSPRSR

SEQ ID NO: 815 - protein, 246 aa, Oryza sativa
MGRGKVQLKRIENKINRQVTFSKRRSKLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQVQWDQTQPQTSSSSSSFMMREALPTTNISNYPAAAGERIEDVAAGQPQHERIGLPPWMLSHING

SEQ ID NO: 816 - protein, 169 aa, Lactuca sativa
DEIDFEFLGNSTGNPYTIHTNVYSQGKGNKEQQFHLWFDPTAAFHTYTIVWNSLRIIFLIDNIPVRVFNNNDAAGVPFPKSQPMRVYASLWNADDWATQGGRVKTDWTNAPFTALYRKFNANAKKVGPNSVSTSSINDNQSWSTQGLDAAGRNRIRWVQTKHMIYNYCT

SEQ ID NO: 817 - protein, 597 aa, Agrobacterium tumefaciens str. C58
MTDKDNTENSNRMTGAEIVLQALKDNGVEHIFGYPGGAVLPIYDEIFQQEDIQHILVRHEQGAGHAAEGYARSTGKVGVMLVTSGPGATNAVTPLQDALMDSIPLVCLSGQVPTSLIGSDAFQECDTVGITRPCTKHNWLVKDVNELAGIIHEAFRIAQTGRPGPVVVDIPKDIQFATGTYTPPSAAIQQKSYKPKVQGDLNAIHAAIELMSKAKKPVFYTGGGVINSGPEATRLLRELVELTNFPITSTLMGLGAYPASGKNWLGMLGMHGSYEANMTMHDCDVMVCIGARFDDRITGRINAFSPNSKKIHIDIDPSSINKTVRVDVPVIGDVGHVLEDMVRLWRALPKKPEKAQTADWWSQIERWRARNSFAYKNSKDVIMPQYALQRLYEASKGRDTYITTEVGQHQMWAAQFFGFEEPNHWMTSGGLGTMGYGLPAAIGVQVAHPEALVIDIAGDASIQMCIQEMSCAIQYGLPVKIFILNNQYMGMVRQWQQLLHGNRLSNSYTEAMPDFVKLAEAYGAVGMYCDDPKELDDKIAEMIAVNKPVIFDCRVANLANCFPMIPSGKAHNEMLLPDEATDEAVANAIDAKGRQLV

SEQ ID NO: 818 - protein, 208 aa, Zea mays
MDEEEHEVYGQEIPVDGDMEAADVDMTAAGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFNPYHAYPYRSYGAPYFPLYGYGRVPRFRRPTRYRP

SEQ ID NO: 819 - protein, 377 aa, Triticum aestivum
  unsure (1)..(377): unsure at all Xaa locations
MDTSGGGDDAAGGAAQIQGTATHGGRYVLNNVYGNLSEAASXXAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLARTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAPFSFDFEQPSFTEEHMKELIWRETLAFNPDPPY

SEQ ID NO: 820 - protein, 518 aa, Zea mays
  unsure (1)..(518): unsure at all Xaa locations
MQFALALDTNSGPHQIRSCEGDGIDRLEKLSIGGRKQEKALRNRCFGGRVAATTQCILTSDACPETLHSQTQSSRKNYADANRVSXIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVXVGIGRNTKIRNCIIDMNARIGKNVVITNSKGIQEADHPEEGYSYYIRSGIVVILKNATINDGSVI

SEQ ID NO: 821 - protein, 75 aa, Zea mays
KGVPLIFISGLKWNGARKPPLYLVATVAIFRLCNMGLLSKVPQVVCFAFHDSKLLMETCPGAQNLWKIVTLFYLG

SEQ ID NO: 822 - protein, 404 aa, ASPERGILLUS NIDULANS FGSC A4
MYLRYAAALASVLPLAVAQTFTDCNPLEETCDPDPGLNSKTFSSDFTQGESALDGWVKASGDVTFGPDGAEFTVAKKGDAPTIDTDFYFFFGKAEVVMKAAPGVGIVSSIVIESDVLDEVDWEVLGGDTTQVQTNYFGKGDTSSYDRGTFEAVATPQEIFHTYTVTWSPDAISWIIDGNTVRTLNYADAKGGSRFPQTPARLRLGIWAGGDPDNAPGTIEWAGGQTDYSAGPFTMYIKSVHIENTYPGSEYTYSDNSGDWQSIKVDDSTPPQETTKTSSTTTSTAEPTSSTSSDSETTTTTTSATDSETETETSTPTSSSETTSSSSESEPASPTATETGSGSGSGSSSESDSASSTPSDSGSATPTSNETSEDPEFTGAASSLTRSAGGLFTVLGMMAAMLQL

SEQ ID NO: 823 - protein, 104 aa, Zea mays
  unsure (1)..(104): unsure at all Xaa locations
VAFICLKSRSLNHEADHIAGSRNHTAPDEDGLPFDTVMWAAEDVEDTINLVDKFVVLKISXRVDMTMGSTGPKSXIEARSAXTFLELIGIQLECVNKMYGRNEA

SEQ ID NO: 824 - protein, 324 aa, Zea mays
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWITYLTLVPVVTGVIIASGGEPSFHLFGFIMCIGATAARALKTVLQGILLSSDGEKLNSMNLLLYMAPIAVIFLLPATIFMEDNVVGVTIELAKKDFTIVWLLLFNSCLSYFVNLTNFLVTKHTSALTLQVLGNAKGAVAVVVSIMIFRNPVSITGMLGYTLTVFGVILYSESKKRSNKP

SEQ ID NO: 825 - protein, 622 aa, Yersinia pestis CO92
MSTEHKQYLSAVTLAAIGVVYGDIGTSPLYTLRECFSGHYGFDVRPDVVFGFLSLIFWMLILVVSVKYLTYVMRADNAGEGGILTLMSLAGRNTSSRATSILVVLGLIGGSFFYGEVVITPAISVMSAIEGLEIAAPALDPYIVPCSIAVLTLLFVIQKHGTGSVGKLFAPVMLVWFLTLALLGLRSIIANPEVLAALNPKWAISFFVEYKSVSFFALGAVVLAITGVEALYADMGHFGKFPIRLAWFTVVLPSLVLNYFGQGALLLKNPEAIKNPFFLLAPDWALIPLLILATLATVIASQAVISGVFSLTRQAVRLGYLPPMRIIHTSEMESGQIYIPVINWTLYLAVVLVIIGFERSSNLAAAYGIAVTGTMVITSILFCTVAWKNWHWNRFLVVFLLMVLLIIDIPMFSANVLKLFSGGWLPLSLGLVMFIIMTTWKSERFSLLRRMHEHSNSLEAMIASLEKSPPVRVPGTAVYMSRAMNVIPFALLHNLKHNKVLHERVVLLTMRTDDVPYVHNVERVTIEQLSPTFWRVVARYGWRETPNVAEIFHRCGLEGLSCQMMETSFFMSHESLILTKRPWHLFLRGKLFIALSRNALRAPDQFEIPPNRVIELGTQVEI

SEQ ID NO: 826 - protein, 313 aa, Zea mays
MPFVSACFCRRQRAGPGILQPAEHSQLTQAPYLCSIVGTRVSRARRDSAGMARWRARRLLPLATFVTLGMILGSLLQLALLHRLDGYSVHADSDPEAVLLRLGYVKPEVISWTPRIIVFHNFLSSEECDYLMAIARPRLQISTVVDVATGKGVKSDVRTSSGMFVNSEERKSPVVQAIEKRISVFSQIPKENGELIQVLRYEASQYYRPHHDYFSDTFNLKRGGQRVATMLMYLTDGVVGGETHFPQAGDGECSCGGNVVKGLCVKPNKGDAVLFWSMGLDGNTDPNSIHSGCPVLKGEKWSATKWMRQKMTF

SEQ ID NO: 827 - protein, 327 aa, Leptospira interrogans serovar lai str. 56601
MMNHPKTKQETQDLFELYRQMLLIRRFEEGAAKSYSTGKIGGFCHLYIGQEAVGVGSIAALKEQDYIVSTYRDHGHALARGLDPKALMAELFGKRTGISSGYGGSMHFFDKNKRFMGGHGIVGGHISLAAGIAYASKYKNENSVTICFFGEGAANIGSFHEGMNLAAIWKLPLVMICENNHYAMGTPEYRSLSVKDVSVRATAYDIARDHIEGDEVRKVRDHVSVAVERARRGEGPTLMEISTYRFRGHSMSDPAKYRTKEELDRYKKSDPLLKAKDDLIHSEWKEEELEKLDIDIQAQVEDAIVFADKSEEPPLGWLYKHVYAEDV

SEQ ID NO: 828 - protein, 181 aa, Magnetospirillum magnetotacticum
MEARRHSALKDSVRSIPDYPKPGIIFRDITTLLSDPRSFRRAVDSLVHPFAGGRIDQVAGIEARGFILGGAVAHQLSSGFVPIRKKGKLPHKTVSTAYALEYGTDEIEIHVDAIRPGDRVILVDDLIATGGTATAAVNLLRQLGAEVVAACFVIDLPEIGGAQRLRDLGVTVRTLMEFEGH

SEQ ID NO: 829 - protein, 165 aa, Aegilops tauschii
VMASSATTVAPFQGLKSTAGLPVSRRSSGSLGSVSNGGRIRCMQVWPIEGIKKFETLSYLPPLSTEALLKQVDYLIRSKWVPCLEFSKVGIVFREHNSSPGYYDGRYWTMWKLPMFGCTDATQVLNEVEEVKKEYPDAYVRVIGFDNLRQVQCVSFIAFRPPGCE

SEQ ID NO: 830 - protein, 181 aa, Brassica napus
MAYSMLSSAAVVTSPAQATMVAPFTGLKSSSAFPVTRKANNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 831 - protein, 271 aa, Oryza sativa (japonica cultivar-group)
MEGGGGGGGGGGGGGGGGGGGGAPYATRTAEEVFRDLRGRRAGMIKALTTDVEKFYKLCDPEKENLCLYGYPNETWEVTLPAEEVPPEIPEPALGINFARDGMNEKDWLALVAVHSDSWLLSVAFYFGARFGFDREARRRLFNMINNLPTIFEVVTGAAKKQAKEKTPNSSSKSNKPSSKVSKAESRSKSKLSAPKDEEGSGDDEGEEEEDDHDNTLCGTCGTNDGKDEFWICCDNCEKWYHGKCVKITPARAEHIKQYKCPDCTNKRARA

SEQ ID NO: 832 - protein, 489 aa, Mycobacterium tuberculosis H37Rv
MSAASQRVGAFGEEAGYHKGLKPRQLQMIGIGGAIGTGLFLGAGGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 833 - protein, 337 aa, Anabaena variabilis
MKIRVGINGFGRMGRLALRAAWGWPELEFVHINEIKGGAVAAAHLLKFDSVHGRWTPEVEAEGERVLIDSTPLSFSEYGKPEDVPWEDFGVDLVLECSGKFRTPATLDPYFKRGVQKVIVAAPVKEEALNIVMGVNDYLYEPEKHHLLTAASCTTNCLAPVVKVIHEGLGIKHGIITTIHDNTNTQTLVDAPHKDLRRARATSLSLIPTTTGSAKAIALIYPELKGKLNGIAVRVPLLNASLTDCVFEVNRPTTVEEINALLKAASEQAPLQGILGYEERPLVSIDYKDDPRSSIIDALSTMVVDETQVKILAWYDNEWGYVNRMVELARKVALSLK

SEQ ID NO: 834 - protein, 607 aa, Schizosaccharomyces pombe
MNRVNDMSPVEGDLGLQLSSEADKKFDAYMKRHGLFEPGNLSNNDKERNLEDQFNSMKLSPVASSKENYPDNHMHSKHISKLPIASPIPRGLDRSGELSYKDNNHWSDRSSTGSPRWENGSMNLSVEEMEKVVQPKVKRMATICQMFFLDHYFEQLHYLYTRKQRARLFEEQLLKEPDSRRDELVKRYNGRERVYLRKRRTRISHGDFQTITQVGQGGYGSVWLARKRDTKEIVALKIMNKSVLHKMDEIRHVLTERDILTTANSEWLVRLLYAFQDTSNIYLAMEFVPGGDFRTLLSNSGVLRDHHAKFYATEMFLAIDALHQLGYIHRDLKPENFLVGASGHIKLTDFGLSSGIISKKKIESMKIRLQEVNNVVVPERSMRERRQVFRTLLSQDPVYAHSVVGSPDYMAPEVLRGENYNHSVDYWSLGCIMYECLSGFPPFSGSNVNETWSNLKNWRKCFQRPHYDDPRDLEFNWRDDAWDFVCHCITDPKDRFCSLKQVMQHPYFSKIDWKNVRTAYRPPFVPDLNSEIDAGYFDDFTNENDMSKYKEVHEKQAAIANMVNTFNKPKRNAFIGFTFRHQKNSHPTSSSSALSSPLSAPSFGTLL

SEQ ID NO: 835 - protein, 173 aa, Lemna gibba
MMVSTAAVARVRPAQTNMVGAFNGCRSSVAFPATRKANNDLSTLPSSGGRVSCMQVWPPEGLKKFETLSYLPPLSVEDLAKEVDYLLRNDWVPCIEFSKEGFVYRENNASPGYYDGRYWTMWKLPMFGCTDASQVIAEVEEAKKAYPEYFVRIIGFDNKRQVQCISFIAYKPT

SEQ ID NO: 836 - protein, 861 aa, Streptomyces lividans
MTADVAVETTPEIPLWNDPNHPVASRVDALVAAMTLEEKIAQLYGVWVGASDQGGEVAPISTTWRRPSTSTRSCPPGSVSSPGPSAPSRSTPRSAPSRSCARRPRITSAGRFGIPAVAHEECLAGFAPWGATAYPVPLSWGATFDPDAVRRMAAAIGRDMRSVGIHQGLAPVLDVVRDGRWGRVEETIGEDPYLVGTIGTAYVQGLESAGIVATLKHFVGYSASRAGRNLGPSSVGTRERTDVLLPPFEMAVREGGSRSVMSAYTDIDGVPAAADEALLTGAVRDTWGFEGTVVADYFGIAFLKTLHGITADWADAAGAALKAGLDVELPTVQDFGTPLVDAVTDGRVPEALIDRAAPRPGTEGGARTARPGLEPGPAALDGVDLSHPEALRGRIDLDRPENRELAREIAEKAVVLLTNDGTLPLARPRRIALIGPNAAEATAVLGCYSFPRHVGVQHPEVPVGLDLPTLYDTLTAEFPDADIALARGTGVDDGEVSGIGEAVDAARAADVVVAVLGDRAGLFGRGTSGEGCDAESLTLPGAQQRLLDALLDSGTPVVTVLLAGRPYALGRARQSAAIVQSFFPGEEGTAALAGVLSGRTSPTGRLPVSVPGSAAQPTTYLGARLAQASEVSNIDPTPAFGFGHGLTYTTFAWSDLVAHTKEAPTDGAFSLELTVRNTGERHGTEVVQLYLHDPVASVVQPVQRLIGYTRVPLRPGEARRVRVEVPADLASFNRRDGRRIVEPGDLELRFAASSTEPRLTATVALTGPERRVDQHPATARRLRAGDRGRRGRGRLSGPWEAPVVPATTARRAVQRTTSKTFFWMPLAYTSCSTSLSFRASLSVSLNSRLPAPSSSGKTSRW

SEQ ID NO: 837 - protein, 822 aa, ASPERGILLUS NIDULANS FGSC A4
MSAACMLIQPRDLCSQKHELVRHVETTLARSLYNCDELAAYSGTALAFRDRLIIEWNKTQQRQTLNDQKRVYYLSLEFLMGRTLDNAMLNVGMKDVAREGLSDLGFRIEDVVSQEHDAALGNGGLGRLAACLLDSLATLNYPAWGYGLRYRYGIFKQEIVDGYQVEIPDYWLDFNPWEFPRHEITVDIQFYGWVRTYEDENGKTVHSWQDGETVQAVAYDVPIPGYGTRTTNNLRLWSSKAASGEFDFQKFNAGDYESAVADQQRAETISAVLYPNDNLDRGKELRLKQQYFWCAASLHDIVRRFKKTGRPWSEFSDQVAIQLNDTHPTLAIVELHRILIDIEGLDWDVSWEIVTNTFGYTNHTVLPEALEKWSVPLLQNLLPRHMQLIFEINLYFLQFVEKKFPDDREILSRVSIIEESHPKMVRMAHVAVIGSHKVNGVAELHSDLIQSTIFRDFVAIYGPDKFTNVTNGVTPRRWLHQANPRLSDLIASKLGGYDFLTDLTLLDQLEDYADDKDFQREWVEIKTSNKLRLAKHIKETTGYSVNPNSLFDVQVKRIHEYKRQQLNIFGVINRYLKIKSMSGEEKKKVQPRVSIFGGKAAPGYWMAKTIIHLINEVSVVVNNDPDVGDLLKVIFIEDYNVSKAEIICPASDISEHISTAGTEASGTSNMKFVLNGGLIIGTCDGANIEITREIGEQNIFLFGNLAEDVEEIRHKHMYSGFTLDPQLARVFDAIRSGTFGEASHYSALLASIAEHGDYYLVSDDFNSYIKTQEMVDEAFKDREEWVSKSITSVARMGFFSTDRVINEYAESIWNIEPLPVRD

SEQ ID NO: 838 - protein, 499 aa, Lipomyces kononenkoae
MRLNLKQQALLGLLATFVTNVQAKTAAEWKELSIYQVITDRFATTNLTAPDCWIRAYCGGTWKGLERKLDYIQNMGFDAVWISPVIHNIEVNTTWGFAFHGYWGDDPYRLNEHFGTAADLKSLSDSLHARGMSLMVDVVINHLASYTLPQDVDYSLYPAPFNTSSAFHQPCPIDFSNQSSIEDCWLVTEPAPALVDLKNEDQVILDALINSVVDLVETYDIDGIRLDTARHVPKPSLAKFQEKVGVFVTGEALNQSVPYVAQYQGPLNSAINYPLWYALVDSFMGRTTFDYLESVVKSEQATFSDAHALTNFLDNQDQPRFASYLGDGNGDDVLRDENAATFLFFVSGIPVIYYGFEQRFDGGFDPVNREPMWTSGYNTSTPLYNYLARLNAIRKYAASITGTQVFYSDDTVFLGSGVSHMAMQRGPLVIVLTNVGQHIIDNTGYTVTGSQFSAGDSLTDLVSCTKVKVVGANGTFTSPSNGGKARIWIKSKYAGKFCS

SEQ ID NO: 839 - protein, 525 aa, Novosphingobium aromaticivorans
MRKGGSRSNGWCRPSRFPASTRRSTRRRAATASRSSSSPDPRDTRSKTMEFNNNYHMLIGGELVAAEARLDVVNPANEQVIACVPDAGAAELDAAVAAARKAFPGWAATPIAERKAMLDALADSIFANVDGFKRLLTAEQGKPHHEAQGEIMGAGYWLKAYTALDLPETVNEDSDERLSITRHVPLGVVGAIAPWNFPMILAMFKVAPGLLAGNTMVLKPSPFTPLCTLKFAELAKEILPAGVLNVITGGDHLGPLMTAHPGFDKISFTGSTQTGRRVMASAAPTLKRVTLELGGNDAAIVMPDVDVEKIAEQLFWAAFTNNGQICIATKRMYIHKDIYEPLRDALVAYARTVKVGDGSEQGTQIGPINNEAQYNRVLDLIQDAKDNGYKFLLGGEKAEVPGYFVPITILDNPPEDSRIVQEEQFGPVLPLIRFDDFEDVLNRVNASDYGLGGSVWGSDEDKAFELAQRVQSGTVWVNETQHLSPLAAFGGMKQSGVGVEGGLEGLLEYTSAQTLVRRKKAAFVN

SEQ ID NO: 840 - protein, 197 aa, Syrrhopodon confertus
GGAKKVVISAPSKDAPMFVMGVNEDKYTNEDIVSNASCTTNCLAPLAKVINDKFGILEGLMTTVHATTATQKTVDGPSNKDWRGGRSAASNIIPSATGAAKAVGKVLPELNGKLTGMAFRVPTTDVSVVDLTVRLEKPASYDAIKAALKEASKGKLKGILGYTEDEVVSSDFITDSRSSIVDAKAGIALSDTFVNLS

SEQ ID NO: 841 - protein, 143 aa, Bacillus subtilis subsp. subtilis str. 168
MAYNKEEKIKSLNRMQYEVTQNNGTEPPFQNEYWDHKEEGLYVDIVSGKPLFTSKDKFDSQCGWPSFTKPIEEEVEEKLDTSHGMIRTEVRSRTADSHLGHVFNDGPGPNGLRYCINSAALRFVPKHKLKEEGYESYLHLFNK

SEQ ID NO: 842 - protein, 347 aa, Pseudomonas syringae pv. tomato str. DC3000
MPQPRPYKVALNGYGRIGRCVVRALCERGTKAGFEVVAINDLADMASLEYLTRFDSTHGRFPGEVRVEGQYLHINDHRIKVLRSATPEGIDWAGLEVDLVLECSGVYNTRDDGQRFLAAGAPRVLFSQPMASERDVDATVVFGINQQKMTGRELLVSAASCTTNCSVPLLRLLDQAIGLEYITITTIHSAMNDQPVIDAYHHEDLRRTRSAFQSIIPVSTGLARGIERLLPELAGRIQAKAVRVPTVNVSCLDITLQTARDTDAVEINRILREAATSGPLKGLLAYTELPHASCDFNHDPHSSIVDASQTRVSGPRLVNLLAWFDNEWGFANRMLDVADHFLRVADQ

SEQ ID NO: 843 - protein, 476 aa, Pseudophycodrys phyllophora
NERYESGVIPYAKMGYWDPDYVIKETDILALFRVSPQPGVDPVEASAAVAGESSTATWTVVWTDLLTACDLYRAKAYKVDAVPNTTDQFFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAASGEVKGHYMNVTAATMEEMYERAEFAKALGTVIIMIDLVIGYTAIQSMAIWSRRNDMILHLHRAGNSTYSRQKIHGMNFRVICKWMRMAGVDHIHAGTVVGKLEGDPLMIKGFYDTLLLPHLDINLPLGIFFTQDWAALRKVTPVASGGIHCGQMHQLLDYLGDDVVLQFGGGTIGHPDGIQAGATANRVALESIVIARNEGRDFVTEGPQILRDAAKTCGPLQTALDLWKDITFNYTSTDTPDFVETPTASV

SEQ ID NO: 844 - protein, 533 aa, Saccharopolyspora spinosa
MSSNELAATIAEAVAAAGADTVFGMPGGGNNLDFIGAAEAIGLRFVLAHAETPAAMMASVYGDLTDSPGVCVVTRGPGAASAVNGVANAMLDRQPLVLVTDTVSAADAERIAHQRLDQRALYAPVTKCSATAGSGGDAGATVRHAVGAAMSLPRGPVHLDFDPSATSSATPSEIAAEPSPDTVDDALRLVSQAKRPLVLLGVGARGLAEPVRTLLAESAAPTLMTYRAKGLVPDSWSNSAGLVTGATTEAPLLHAADLIVMIGVDTVEFIPNAWPYQAPVVSFSSWAETSPYLRPDVEVVGNLEKLVTELSQIWPATTWPPGAGNRHRDDELARLCAATPGIPEGVTPQEVVLRTRAAVPTATIATVDAGAHMLPATSLWTTEDVDEMIISSGLATMGFAVPAAVAAALARPSRRIVCFTGDGGLGMCLGELETISRLGLNVTIVVFNDSRLSLIAIKAKPDGNGGENAIGYGETDFAQIGRGYGLAGFSADSADELDTALARALGQHGPSIVDVRVDSRAYGEVLAAIRGKR

SEQ ID NO: 845 - protein, 382 aa, Arabidopsis thaliana
MVPFHGGCSRRYGFFTDSYDLFVISLITKLLGRIYYQVPGSSSPGSLPDGISVAVSGVAFAGTFLGQIFFGCLGDKLGRKRVYGLTLLIMTICSIASSLSFGKDPKTVMVTLCFFRFWLGFGIGGDYPLSATIMFEYANKRTRGAFIASVFAMQGVGILAAGGVSLLVSYLFEIEFPSRAYILDGAASTVPQADYVWRIILMVGALPALLTYYWRMKMPETARYTALVAKNAEQAALDMNKEIFTEVDEKRFALTICQSENCLIDRLGRYWIQIIGFGMMTVFMLVLAVPYHHWTLPANRIGFVIFYSFTFFFSNFGPNATTFIVPAEIFPARIRSTCHGISAASGKAGAMVGSFGFAALGISLEELTGETKPERVKEKIGV

SEQ ID NO: 846 - protein, 337 aa, Zea mays
  unsure (1)..(337): unsure at all Xaa locations
MGKIKIGINGFGRIGRLAARVALQSEDAELVAGNDPFITTDYMTYMFKDDTVHGQWKHSDIALKDSKTLVFGEKPVTVSGIRNPXEIPRARPGASNGWESPGGFTDKDKAAAHLKGGAKKVGISAPSKDAPMFVVGVNEDKFTLDVIICSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 847 - protein, 523 aa, Medicago truncatula
MLVELAVTLLVIALFIHLRPTPTAKSKALRHLPNPPSPKPRLPFIGHLHLLDNPLLHHTLIKLGKRYGPLYTLYFGSMPTVVASTPDLFKLFLQTHEATSFNTRFQTSAISRLTYDNSVAMVPFAPYWKFIRKLIMNDLLNATTVNKLRPLRSREILKVLKVMANSAETQQPLDVTEELLKWTNSTISTMMLGEAEEVRDIARDVLKIFGEYSVTNFIWPLNKFKFGNYDKRTEEIFNKYDPIIEKVIKKRQEIVNKRKNGEIVEGEQNVVFLDTLLEFAQDETMEIKITKEQIKGLVVDFFSAGTDSTAVATEWTLAELINNPRVWKKAQEEIDSVVGKDRLVDESDVQNLPYIRAMVKEVFRLHPPLPVVKRKCTEECEINGYVIPEGALILFNVWQVGRDPKYWEKPLEFRPERFLENASQGEGEAASIDLRGQHFTLLPFGSGRRMCPGVNLATAGMATLLSSIIQCFDLQVPGPHGQILKGDDVKVSMDERPGLTVPRAHNLMCVPLARAGVAAKLLS

SEQ ID NO: 848 - protein, 488 aa, Vaucheria eurythrospora
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLVVERERMDKFGRPFLGATVKPKLGLSGKNYGRVVYEGLRGGLDFLKDDENINSQPFMRWRERFLYCMEGVNRAAAATGEIKGSYLNTTAGTMEEMYERAEYAKQLGTIIVMIDLVVGYTAIQSMAIWARKADMILHLHRAGNSTYARQKNHGINFRVICKWMRMAGVDHIHAGTVVGKLEGDPLMVKGFYNTLLETKLDINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 849 - protein, 129 aa, Triticum aestivum
MADHDPELEAIRQRRMQELMGQRGGAASPQNAGQQKAQEDAKQEAEERRQMMLAQILSSEARERISRIALVKPDKARGVEDVLLRAAQTGGISEKVSEERLISLLEQINTHTSKQTKVTIQRRRFDDDD

SEQ ID NO: 850 - protein, 442 aa, Chlamydophila caviae GPIC
MIENDFQGYSPSYQASHFYRDKVGVIVLCGGEGKRLSPLTYWRCKPTVSFGGRYKLIDVPISHAIASGFSKIFVIGQYLTYTLQQHLVKTYFYHGVLQDRIHLLAPEGREGSQVWYQGTADAIRQNLLYLEDTEIEYFLVLSGDQLYNMDFRKVVDYAIAMQSDMVIVAQPIQEKDASRMGVLQIDKDANLVDFYEKPQEEEILNRFRLSSEDCRKHKLDPQYGNFLGNMGIYLFRRESLFQLLLEEQGDDFGKHLIQAQKQRGSIKTFLYDGYWTDIGTIESYYEANIALTQRPKPQVRGLNCYDDAGMIYSKNHHLPGTIVTDSMISSSLLCEGAVIDSSNVSHSVVGIRGVIGKNSIIDHSIVMGNDRYGNPQQNALGIGDNCEIYKTIIDENCRIGNGVKLTNIQGHKDYNSPDGKLVVRDGIIIIPRGTRIPDNYTF

SEQ ID NO: 851 - protein, 583 aa, Enterococcus faecium
MMMAQTNPRSRLAEIIRVFINYNVVPNFVQQKNPEQVKKAFEELGPTFIKIGQMLSVREDLLSSAFTQTFKTLQDSVPSDTFSTVKKTIETELSLSLSDIFDDFSKSPFASASMGQAHRAKLKNGDAVVVKIQHPNIAEEIRLDLQLFERAIPLIKYIPETSVVDLKGVLQEVKRSLINEMDFLKESQNGEQFYQKNNGWKEIRSPKIYDAFCSKKVIVMEEMSGKNLNHLMNAENKTETFITGIQNKQLKQEVAKLLVENFMKQVFDDGFFHADPHPGNLLFHVLTKEEQTQASRKTETVHEKEFGSFAFRASTSAEDPVAPYTINYIDFGMMGHLSAGLRQKLTQAVLALYTKDAYRIEKAVLRLCQQEGSFDESRFHQELTSFLEQYYDSPIDEINLQEVFTHVVTICHQNNLQFDRDITLLLKAFGTLEGVIRVLDPEVSLMEVASPFAQHYFLTHLDVEDTLKQSGLDLLEGMKAAPKIPQQLHHLLEMWTSGQGKVNLELKKQDKLLSRIESMINRLVFGMILAALIVGSSLLVQAAPVENAEVVSLLGIFTYAIAAFVIIFLAIDALIQMYKKRKK

SEQ ID NO: 852 - protein, 249 aa, Oryza sativa
MGRGKVELKRIENKINRQVTFAKRRNGLLKKAYELSVLCDAEVALIIFSNRGKLYEFCSTQSMTKTLEKYQKCSYAGPETAVQNRESEQLKASRNEYLKLKARVENLQRTQRNLLGEDLDSLGIKELESLEKQLDSYLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEAMNSACMNTYMPPWLP

SEQ ID NO: 853 - protein, 292 aa, Haemophilus influenzae Rd
MSYAKEIDTLNQHIADFNKKINVSFEFFPPKNEKMETLLWDSIHRLKVLKPKFVSVTYGANSGERDRTHGIVKAIKQETGLEAAPHLTGIDATPEELKQIARDYWDSGIRRIVALRGDEPKGYAKKPFYASDLVELLRSVADFDISVAAYPEVHPEAKSAQADLINLKRKIDAGANHVITQFFFDIENYLRFRDRCASIGIDTEIVPGILPVTNFKQLQKMASFTNVKIPAWLVKAYDGLDNDPTTRNLVAASVAMDMVKILSREGVNDFHFYTLNRSELTYAICHMLGVRP

SEQ ID NO: 854 - protein, 202 aa, Desulfovibrio desulfuricans G20
MSESLQFFFWRCDMDIDFKKLAPWNWFKKEQEEQQSTASLPMQRNDLPVAGGPVSPILQLHREIDRLFDDAFRGFGFPALAMPRWPSDWPGLLKPALDIQETDKLYKISLEVPGVEEKDIQITLDNDVLLVRGEKRQEQETKDGGFHRVERSYGSFQRALNLPADANQDTIKAAFKNGVLTITMEKREACAPKQGRSIPING

SEQ ID NO: 855 - protein, 708 aa, Glycine max
MAVIMALNGYYYNNIKLGNQRRAPHNLSFPGSISVHKLPKNRRSKSYKSGNDKFPRFLVEMRQTELPPSKYGTNGRAVQMVPANEVVKRKTMSENKVEMARGSKQAVNGASLVERDPSLALTKTKKSTTSKELPPLEELKVFHSDEGFSCANENYNSLQRTIDVWSFVISLRIPVLLDNAKWAYLGDYTEQKQKSRRRKTAAWLRECVLQLGPTFIKLGQLSSTRSDLFPREFVEELAKLQDRVPAFSPKKAICPGESELGAPINILFKEFEDRPIAAASLGQVHRAILHNGEKVVIKVQRPGLKKLFDIDLKNLKLIAEYFQRSETFGGPPRDWVGIYEECATILYQEIDYINEGKNADRFRRDFRNIKWVRIPLVYWDYTALKVLTMEYAPGIKINEVDMLASRGYDRLRISSHATEAYLIQILRTGFFHADPHPGNLAIDVDEAIIYYDFGMMGEIKSFTRERLLELFYAIYEKDSKKVMQCLIDLGALQPTGDLSSVRRSIQFFLDNLLSQTPDQQQTLSAIGEDLFAIAQDQPFRFPSTFTFVIRAFSTLEGLGYILNPDFSFVKIAAPYAQELLDIRQKRPTGPQLVEEIRKQADDARTNSISMPYRVQRIEEFVKQLEAGDLKLRVRVLESERAARKATILQMATMYSVLGGTLLNLGVTLSSQGNQAFANGSFIGAGILGALFLRSMQRVKKLDKFENMI

SEQ ID NO: 856 - protein, 466 aa, Clostridium tetani E88
MNNFVFLATSVFQIVVFLMAMYYFILSIFGLHKKDEPDGNTIEPEKTFALIVAAHNEEMVIDHIIDSLQKLDYPNNLYDIFIIADNCTDDTAEISRKLGVNVFERNVPSKRGKGYALEWMFDKIFKMEKKYDAIAVFDADNLVSANFLKEMNAKLLNGYKVVQGYIDSKNPEDSWITQSYSISFWTANRLFQLARWNLGLSNQIGGTGFCMETDILKKLGWGATCLTEDLEFTCKLVLNGHKVGWSHNAIVYDEKPLTLKQSWSQRKRWMQGFADVSSRFFGKLMKKAVKDRDFKAFDCALYSIQPFFTLLLAISAILTMVQNGSESGLNIFVMNSLLAPWIWKIFSIFQFLFTPFILLLEEKLHKKMFFMFSIYSFNVFFNEIVFGKNPKFFEVVLGSVLYFSLFILILFIFNKKHYITLFIWYLLYGFYTLTWIPITVQGILNKDNKEWSHTKHTRKITIQEVE

SEQ ID NO: 857 - protein, 269 aa, Synechocystis sp. WH 8501
MTPTAVITGASAGIGQATAILLAQKGYNLVLAARTNDRLEAVAQQAIELGSQVLAIPTDVTDVKQVNNLVEKALDTYTQVDILINNAGICMTAPMSQTSLEDWQKILNVNLWGYIYPIHALLPHFLSRQQGTIVNVGSFGGKMPLPNMTAYCTSKYAVTGLTETLRLELEPKGIHVCGVHPSVTNSDFLERAVFRGPQETYSEQMRASMKDILNSPLASQPQDVAKAIFQIIEHPQREVVVGTGAIATSLYSLAPSLSQWLLQQSQGKS

SEQ ID NO: 858 - protein, 116 aa, Zea mays
  unsure (1)..(116): unsure at all Xaa locations
MGCSISGLNALYDAATGGGDVWINERRFRVLRQIGEGGFAFVYLVREHQPASDAAFARRDPAHVSEDGTYAMKKVLIQSKEQLDLVREEIRVSSLFNHPNLLXXLLDHAINSREDV

SEQ ID NO: 859 - protein, 163 aa, Glycine max
  unsure (1)..(163): unsure at all Xaa locations
HAGAGMGAPFTGLKSMVGFLTRKTNNDITFIDSNGGRMQCMQVWTRVGMKKLDTLSYLPDLDDAQWAKEVQYLLRKGWIPCLECKLXHGFVYREHNRSPGYYDGRYWIMWKLPMIGCTDASQVTKELQDAKTAYTNGLIPIFGFDNVRXVQSIIFVVYKPPSF

SEQ ID NO: 860 - protein, 424 aa, Shewanella oneidensis MR-1
MEVANVLATNGQLLIAIAAAFGFLMAWGIGANDVANAMGTSVGSNAITIKQAIIIAMIFEFSGAFLAGGEVTNTIRSGIVDSNYFTETPELLVYGMIGSLLAAGIWLVVASALGWPVSTTHSIVGAIIGFAAVGVGTEAVAWEKVGGIVGSWVITPAISGFMAFILFQSTQKLIFNTDDPLANAKRYVPFYMAFAGFIMALMTILKGLSHVGLHFSITESYLLAAVIAAVVGIAGKIAISRLKMSDKANRQTMFANVEKVFAILMVLTACCMAFAHGSNDVANAIGPLAAVVSVVNSGGEIASKSPLVWWILPLGAIGIVMGLAIFGQRVMQTIGKNITHLTPSRGFAAELAAATTVVIASSTGLPISTTQTLVGAVLGVGMARGIAAINIGVVRNIVVSWVVTLPAGAGLSIIFFFTIKGIFN

SEQ ID NO: 861 - protein, 369 aa, Oryza sativa (japonica cultivar-group)
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQANVIVLRPGTAS

SEQ ID NO: 862 - protein, 356 aa, Nostoc sp. PCC 7120
MQLKLSASKFPIAPLLLIAPFFLWGTAMVAMKGVMPHTTPFFLAGVRLLPAGVLILIAAALSGRPQPNSWQAWLWISLFGLVDGTLFQGFLAEGLVRTSAGLGSVMIDSQPLAVALLSLWLFQERIGLWGWLGLGLGVTGISLIGLPDEWIFSLLGTGAEVTIGNWQNLFASGEWLMLLAALSMAVGTVLIRFVTRYVDPVTATGWHMIIGGLPLWGISSVVESQQWENLVGSEWLALAYATVFGSAIAYGLFFYFASSGSLTSLSSLTFLTPIFALLFGHLLLSEVLSTLQWVGVFLTLISIYLINQRDNLAGQNKQSVMEEISAKSQPILAEATAKKLNPLTVKVRESEPETLP

SEQ ID NO: 863 - protein, 325 aa, GIBBERELLA ZEAE PH-1
MENYQKLEKIGEGTYGVVYKARDLANGGRIVALKKIRLEAEDEGVPSTAIREISLLKEMRDPNIVRLFNIVHSDGHKLYLVFEFLDLDLKKYMESLPISDGGRGKALPEGSSPHLQHLGLGDTVVRKFMYQLCDGVKYCHSHRVLHRDLKPQNLLIDKDGNLKLADFGLARAFGVPLRTYTHEVVTLWYRAPEILLGGRQYSTGVDMWSVGCIFAEMCTRKPLFPGDSEIDEIFKIFRTLGTPSEDNWPGVTSYPDFKASFPKWQRDYSKSLCSTLDDHGLELLEMMLVYDPAGRISAKGAFNHPYFEPHLAQKQASAQTNGYYH

SEQ ID NO: 864 - protein, 146 aa, Glycine max
MHNFLIVSGLAGLRVGYGAFPLSIIEYLWRAKQPYNVSVAAEISACAALQNPTYLENVKNALLKERGRLYDLLKEVPFLRPFPSHSNFILCEVTSGKDAKKLKEDLAQMGVMIRHYDKKELKGYVRVTVGKPEQTDTLMKCLKRLS

SEQ ID NO: 865 - protein, 631 aa, Halobacterium sp. NRC-1
MSDDRREFRDLASPARAREVLAALDVTPAPETVPLAEARGRVLAERVDATIDVPGFDRASMDGYAVRAADTFGASEADPARLSVAGTVHAGEEPAVEVTAGRAVVVSTGAVMPPGADAVVKVEATTEADGGDAVDVRTSVAPGTAVMLAGADIAAGSRAIGPGTKLTAREIGVLSALGVGSVRVRGAPTVGIISTGDELVRPGDPLDSAAGQIHDVNSHTIAAAVEAAGGEPVVYPHAGDDYAEMERLLVESAADCDLVLSSGSTSASAVDVIYRVAEERGDLLLHGVAVKPGKPMLVGEIEGTAYVGLPGYPVSALTIFRVFVAPVVREAAGRGQPEPTVVTGEMARQERSAEGRRRLLPVGLVEDGAGDRLVYPVDKGSGATTSLVDADGTVTVPADTAYVAAGDSVDVALFAPDARAPRVLAVGEDDPLFSRVLDDVARPRFLPVGTREGLRRLREGVPDVVVVAGPATPDGDAVSLGGWTREWGIVVPAGNPAGVDSVADLVDRDLGLVNRARGSGLRRCFDDAIAALAAERPASRRALTDAIDGYELTTTAHESPARKVAAGDADAGLGLAATAASLDLGFVPLGTQSVTVVAAPDRVDKPGVRDLAAALDDCGGLAAPLEGIDPQ

SEQ ID NO: 866 - protein, 98 aa, Zea mays
VMQSKQLGRLPVVQFAAGGVATPADAALMMQLGCDGVFVGSGIFKSGDPARRARAIVQAVTHYSDLEMLVEVSCGLGEPMVGINLNDEKVERFANRSE

SEQ ID NO: 867 - protein, 481 aa, Zea mays
  unsure (1)..(481): unsure at all Xaa locations
MSSSSGTTMPLAYQTSASSPEWLNKGDNAWQLTAATLVGLQSFPGLVVLYGGVVKKKWAVNSAFMALYAFAAVWICWVTWAYNMSFGDRLLPLWGKARPALSQGGLVGQAGLPATXHHFASGALETPAAEPLYPMATVVYFQCVFAAITLVLVAGSLLGRMSFAAWMLFVPLWLTFSYTVGAFSVWGGGFLFQWGVIDYCGGYVIHLSAGFAGFTAAYWVGPRAQKDRERFPPNNILFTLTGAGLLWMGWAGFNGGGPYAANVVASMSVLNTNICTAMSLLVWTCLDVVFFKKPSVVGAVQGMITGLVCITPAAGLVQGWAAMVMGVLAGSVPWYTMMILHKRSRLLKHVDDTLGVIHTHGVAGLLGGLLTGLLADPTLCALFLPVTNSKGAFYGDGAQLGKQLAGALFIIGWNVAVTSIICVAINAVVPLRMTQDKLEVGDDAVHGEEAYALWGDGELYDVTDHGPRAAAAVAPMSTPPN

SEQ ID NO: 868 - protein, 243 aa, Zea mays
MFGYRKADPDLEAGGSSLLYPGMTESPELRWAFVRKIYAILTVQLAMTAAVSAFVVKVPAVSNFFVSSNAGIALYIFLIVLPFIVLCPLHYYHQKHPVNLLLLGLFTVAISFAVGMTCAFTSGKIILEAAILTAVVVNSLTAYTFWAAKRGHDFNFLGPFLIAAIMVLMVFSLIQIFFPLGKISVMIYGGLASLIFCGYIIYDTDNIIKRHTYDQYIWAAVSLYLDVINLFLSLLQLLRAADS

SEQ ID NO: 869 - protein, 278 aa, Glycine max
PRVPLPTPPIKPHSEPKVWNFFKLPFRHSAATNTTPSSANLHHLHHHHHNHHHHHHHHHNPNNNLPLEGSTSHTSNSVSSVARSLLPTRRRLKLDPSNKLYFPYEPGKQVRSAIRIKNTSKSNVAFKFQTTAPKSCFMRPPGAILAPGESIIATVFKFVEQPENNEKPEKTGLKFKIMSLKVKGLIDYVPELFDEQKDQVAVEQILRVVFLDPERPCPALEKLNRQLADADAALEARKKPAEDAGPKIIGEGLVIDEWKERRERYLAKQQGEVVVDSV

SEQ ID NO: 870 - protein, 525 aa, Zea mays
MAGGGEREGAQAMDSGEKRLNELGYKQELRREMTLFKTLAISFSTMTLFTGITPLYGSSLQYAGPAPLVWGWVVVSFFTCFVGVAMAEICSSFPTTGSLYFWAAHLAGPVWGPLASWCCAWLEAIGLIAGIGTQAYAGSQVLQSIILLCTGTNTGGGYLAPRWLFLVMYIGLTLIWAVLNTFALEVIAFLDVISMWWQVIGGTVIVVMLPLVAKTTQPASYVFTHFQTAPDVTGIGSSAYAVVLSFLVSQYSLYGYDAAAHLTEETKGADKNGPIAILSSIGIISVFGWAYILALTFSIQDFSYLYNPNNETAGTFVPAQILYDAFHGRYNSSAGAIVLLFVIWGSFFFGGLSITTSAARVVYALSRDQGVPLSSVWRRIHPRHKVPANAVWLCAAVCTLLGLPILRINVVFTAITSIATIGWVGGYAVPIFARMVMREDDFRPGPFYLGRASRPVCLVAFLWICYTCSVFLLPTVYPIKMDTFNYAPIALGVCLGLIMLWWLLDARKWFKGPVRNIDDHNNGKV

SEQ ID NO: 871 - protein, 151 aa, Leuconostoc mesenteroides subsp. mesenteroides ATCC 8293
GTAGMGIVNQIFSELKQAGLSDAEARSHFYLVDKQGLLFDDTEDLTEAQKAFTRSRKELVNSEQLDNLEAVVNEIRPTVLIGTSTQPGTFTEAIVKSMAQNTERPIIFPLSNPTKLAEATAENLIKWTDGKALIATGIPAANVTYKGVTYK

SEQ ID NO: 872 - protein, 200 aa, Pseudomonas aeruginosa
MRITLLDNFDSFTYNLVEQFCLLGAEVRVMRNDTPLPTIQAALLADGCELLVLSPGPGRPEDAGCMLELLAWARGRLPVLGVCLGHQALALAAGGAVGEARKPLHGKSTSLRFDQRHPLFDGIADLRVARYHSLVVSRLPEGFDCLADADGEIMAMADPRNRQLGLQFHPESILTTHGQRLLENALLWCGALAVAERLRA

SEQ ID NO: 873 - protein, 344 aa, Corynebacterium glutamicum ATCC 13032
MPIATPEVYNEMLDRAKEGGFAFPAINCTSSETINAALKGFAEAESDGIIQFSTGGAEFGSGLAVKNKVKGAVALAAFAHEAAKSYGINVALHTDHCQKEVLDEYVRPLLAISQERVDRGELPLFQSHMWDGSAVPIDENLEIAQELLAKAKAANIILEVEIGVVGGEEDGVEAKAGANLYTSPEDFEKTIDAIGTGEKGRYLLAATFGNVHGVYKPGNVKLRPEVLLEGQQVARKKLGLADDALPFDFVFHGGSGSEKEKIEEALTYGVIKMNVDTDTQYAFTRPIVSHMFENYNGVLKIDGEVGNKKAYDPRSYMKKAEQSMSERIIESCQDLKSVGKTTSK

SEQ ID NO: 874 - protein, 520 aa, Brassica napus
MATMAAIGSLKVPSSSSNHTRRLSSSSQRKTLSFSSSSLTGEKLNPTQEIIISNLPRGNERRTPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 875 - protein, 404 aa, Haemophilus somnus 129PT
MLSLEQALQQMLSQLATINKTETLTLEQAVARICAEDIISPINVPSFDNSAMDGYAVRLADLKHSTTLSICGKSFAGNPFNEQWQEKSVIRIMTGAMLPEGTDAVVMQENVTINEDGTVTINEIPKLHQNIRRLGEDIKVGDIALKMGSKLTALSLPLLASLGISHVKVYKKPKVALFSTGDELVSVGQPLVQGKIYDSNRFTIRLMLEKFPCDILDFGILPDDEQLFEQTFFKAQKQADLVISSGGVSVGEADFTKAVLEKCGEINFWKIAMKPGKPFAFGKLNNAWFCGLPGNPVSALVTFYQLVQPVIAKLSGYTQWKMPQQLKAISATKLKKSIGRIDFQRGFYQLNTQGQIEVYPVGQQGSHLFSAFVNSNCFIRLEQERGNVEAGSIVTIEPFSDILN

SEQ ID NO: 876 - protein, 165 aa, Triticum aestivum
IGDRRMVLFGGRGSEYEVLSDVWLFDIGDHLLQWKEQKYDLSSILGELPSPRAGHSATFLFGGKILVYGGEDKERRRMDDFWILDIPALLQFESGNRKMAKRMWKKLRIDGQSPNCRSFHGACVDTSGYCVYVFGGMVDALLHPAESLGLRFDGQLYQVELVLHL

SEQ ID NO: 877 - protein, 492 aa, Soldanella alpina
MDPYKYRSSSAFNTPFWTTNSGAPVWNNNSSLTVGTRGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNFPVFFVRDGMKFPDMVHALKPNPKSHIQENWRILDFFSHHPESLHMFTFLFDDLGVPQDYRHMEGSGVNTYTLINKAGKAQYVKFHWKPTCGVKCLLEDEAIKVGGANHSHATKDLYDSISAGNYPEWKLFIQIIEPDHEDKFDFDPLDVTKTWPEDIIPLMPVGRLVLNKNIDNFFAENEQLAFCPALIVPGVYYSDDKLLQTRIFSYADTQRHRLGPNYLQLPPNAPKCAHHNNHHEGLMNFMHRDEEVNYFPSRFDPVRHAERHPIPPPVLTGKRDRCMIEKENNFKQPGERYRTFAPDRQERFVCRWVDALSDPRVTHEIRSIWISYWTQADKSLGQKLASRLNVRPTM

SEQ ID NO: 878 - protein, 251 aa, Pseudomonas syringae pv. syringae
MRRPMVAGNWKMHGTRASVAELIEGLCKQSLPGSVDIAVMPASLFTCQVVDGLKATSIIVGAQDAAIQAEQGALTGEVASSQLADAGCKLVLVGHSERRQLIGEQDDVLNKKFAAIQAKGLTPVLCVGETLEERKAGQTLEVVGRQLDSVIAEFGVNALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 879 - protein, 362 aa, Pseudomonas fluorescens
MKSALKTFVPGALALLLLFPVAAQAKEVETKTKLANVVILATGGTIAGAGASAANSATYQAAKVGIEQLIAGVPELSQIANVRGEQVMQIASESINNENLLQLGRRVAELADSKDVDGIVITHGTDTLEETAYFLNLVEKTDKPIIVVGSMRPGTAMSADGMLNLYNAVAVAGSKDARGKGVLVTMNDEIQSGRDVSKMINIKTEAFKSPWGPLGMVVEGKSYWFRLPAKRHTMDSEFDIKTIKSLPDVEIAYGYGNVSDTAVKALAQAGAKAIIHAGTGNGSVSSKVVPALQELRKQGVQIIRSSHVNAGGFVLRNAEQPDDKYDWVVAHDLNPQKARILAMVALTKTQDSKELQRMFWEY

SEQ ID NO: 880 - protein, 181 aa, Vibrio vulnificus CMCP6
MTTNTIAQIQASIKSIPDYPKPGILFRDVTSLLEDAQAYQATIQLLVDKYKDMGFTKVVGTEARGFLFGAPLALQLGVGFVPVRKPGKLPRNTIAQSYELEYGVDTLEIHTDAIVEGDKVLVVDDLLATGGTIEATTKLIRQLGGVVEHAAFVINLPEIGGDKRLEGLGLNVYSICEFEGH

SEQ ID NO: 881 - protein, 475 aa, Pleurochloridella botrydiopsis
DRYESGVIPYAKMGYWDADYNIKATDVLSLFRITPQPGVDPVEAAAAVAGESSTATWTVVWTDLLTACDVYRAKAYRVDPVPGTTDQFFAYIAYECDLFEEGSLANLTASIIGNVFGFKAVKALRLEDMRIPFAYLKTFQGPATGLVVERERMDKFGRPFLGATVKPKLGLSGKNYGRVVYEGLRGGLDFLKDDENINSQPFMRWRERFLYCMEGINRAVAATGEIKGSYLNITAGTMEEMYTRAEYAKAVGSIIIMIDLVIGYTAIQTMAIWARKHDMILHLHRAGNSTYARQKNHGINFRVICKWMRMAGVDHIHAGTVVGKLEGDPLMVKGFYNTLLLTKLDINLPQGIFFKMDWASLRKVVPVASGGIHCGQMHQLVYYLGDDCVLQFGGGTIGHPDGIQAGATANRVALEAMLLARNEGRDYLGQGPQILRDAAKTCGPLKTALDLWKDITFDYTSTDTPDFVETPTGSK

SEQ ID NO: 882 - protein, 146 aa, Magnetococcus sp. MC-1
MAALMEYDPFRNVRTLQNEINRLFDHNWEEPNGQMAKWPMRVDIREDENQIMIKADLPGMTQQDISVDVDNGTLTISGERKFDDEQNRDGYHRIERAYGRFSRSFQLPNTTDTGNIAAKYQNGVLEVTLPKLDEAKPRSIQVEVLN

SEQ ID NO: 883 - protein, 158 aa, Triticum aestivum
  unsure (1)..(158): unsure at all Xaa locations
PLWLMLSYTVGAFSLWGGGFLYHWGVIDYSGGYVIHLSSGIAGFTAAYWVXGPRLKSDRERXSPNNILLMIAGGGXLWMGXAGFNGGAPYAANITASXAVLNTNVKRGDSSLTWTCLEVIFXFGKXSXIXAXQSMMTGFFXITPGXRXGNGGHGSPEL

SEQ ID NO: 884 - protein, 304 aa, Glycine max
  unsure (1)..(304): unsure at all Xaa locations
MMEAGTALSLRLHTRIPIPINTANSNTLLFQPRFTLSSHSPSSFSAYSYRGPTPKRPFLADWVSQNDDVVRTLPIYVGSASLFAILLNRSLSGIAPVVDAGRHVPXSQSRADLLTLGLAVTNILAGLVWLSVKPKSITVVNPRGVECKSLCATLPEVARNELLWVWESLSDATCCRSLGVVYESSCVLPIGFAAESSPGDGDAVSVDANKLMQGSVYQGVMKSGAQSYLANLSLYPGKSELPFVPSNTQAVILQPLGDKGIAIIGGDTIRGFTGSDQVWITYIGAKLDSSLAKYLKHHPLTSQD

SEQ ID NO: 885 - protein, 362 aa, Xanthomonas axonopodis pv. citri str. 306
MSVAAQFQIDYLQYMDADGQWVRDDLPADAANPQHLLALFKRMLFVRTFDTKSVALQRTGKLGTYAACIGHEATHVGIGASMRSGDVFAPSYREYGTMFERGVRPRDVLLYWGGDERGSDYPRDADAAIDFPICVPISTQCLHAAGSALSFKLQGKQHVAVACCGDGGSSKTDFYAALNSAGAYKLPLILCVINNGWAISVPRSAQTGAQTLAQKGLAGGLHCLQVDGNDLVAVLEAMRQARVRALAGEGGTVIEFLTYRLSDHTTADDARRYRGEEEVKQGWAREPLLRLRRYLTAQGLWDEAQEDAWKADCSARVDEEVNAYLNTPVQPVEAMFDYLYGDPPAELLAQRAEVMALESRHG

SEQ ID NO: 886 - protein, 194 aa, Oryza sativa
  unsure (1)..(194): unsure at all Xaa locations
MANTKQPELKEPGPSDNQLPDFKKSHKSEQLTTGFGRPLGERTTVVTVGPRGPMLLSDFPYIEDTQRFDRERIPERVVHAKGAGAFGVFEATDDMSDICKAKVFVKGTKTRVLARFSTVAGESXSADTARDPRGFAIXMYTDERLWXDLVGNNTPIFFIRDPFLFLMFIHSQKRYPETHFKDPNMVWDFLARNR

SEQ ID NO: 887 - protein, 759 aa, Paracoccidioides brasiliensis
MASKATEGLRKIQGMVESMHPGNKKVADLARDTVDVHAPAPFTTDHGTKVSNTDNWLRAASENQTGPSLLEDQIAREKIHRFDHERIPERVVHARGTGAFGHFKLVESAEDATSAGVLTDTSRTTPVFVRFSTVQGSKGSFDTVRDVRGFATKFYTQEGNWDLVGNNIPVFFIQDAIKFDISKQSIPFSFLSRCYLSSVHAVKPERQRSPQGNCHNNFWDFVSCILKATHMFMWAMSDRAIPRILPVCRGFGVNTFVLVNRQGKRHFVKFHWMPELGVHSLVPDESFKLGGQDPDYHRKDLMEAIDNKVYPKWKFGIQVIPEEKEHEFEFDILDATKIWPEDLVPVRYIGEMELNRNVDEFFPQTEQVAFCTSHIVPGIEFSDDPLLQGRNFSYFDTQISRLGVNWEELPINRPVCPVMNHNRDGAMRHKITQGTVNYWPNRFEACPPTNPEDGGFVTYPQKITRTLSYMVSNKFANTSPAQLFYNSLSYEQLHIQNAFCFELDHCYDPVVTTDSSSDLLKSPYRSHELSQSKSALQHQTGLDVPTKGQKTINLSQEYINERQPFCTHNPRGENTILIGDGTTQSPSPLSNRGNSHECSAHHNGTKRQPIFADHEDRETGAGVIPDHNYIGQRSTLLTPRSYPVARISRSCASLGAFRHWIAEQFGHCKAIGATGEAVDLIAQVLNSLPGLNVALASSSDVVEWYGVVTSSKLHEPHTLTEGFKLFPEAKDFLGKFLYQVSQHRNYQRDMVGLTDQVAF

SEQ ID NO: 888 - protein, 183 aa, Shigella flexneri 2a str. 2457T
MTATAQQLEYLKNSIKSIQDYPKPGILFRDVTSLLEDPKAYALSIDLLVERYKNAGITKVVGTEARGFLFGAPVALGLGVGFVPVRKPGKLPRETISENYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 889 - protein, 522 aa, Oryza sativa (japonica cultivar-group)
MAAATAADVAEDTASVYSGKLTLYVFLTCGVAATGGLIIGYDIGISGGVTSMDTFLGKFFPSVLHQEQTAQGTSQYCKFNSQPLTAFTSSLYLAALVASFFVASFTRALGRKWSMFGGGVSFLAGATLNGAARNVAMLIVGRILLGIGVAFCGLSTPIYLSEMAPPRLRGMLNIGLQLMITVGIFSANLVNYGAAKIRGGWGWRVSLGLAAAPACVIAVGSLFLPDSPSSLINRGRHEQARRVLRRIRGTDEVDDEYGDLVAAASEIEVYSGCSARRRPWRDVLQRRYRPQLAMAVLIPFFQQLTGINVIMFYAPVLFKTIGLGGDASLMSAVITGLVNIVATFVSIATVDSLGRRKLLFQGGCQMLVSQVIIGTLIGVVFGTSGDGNISRALAVCIVVFICVYVAGFAWSWGPLGVLLPSEIFPLEVRPAGQSISVAVNMLCTFAVAEAFLPMLCHMRFGLFYFFSGWVLVMTLFVSAFLPETKGVPIEKMTVVWRTHWFWGRFYCNQDADAHVQVANSKV

SEQ ID NO: 890 - protein, 155 aa, Triticum aestivum
  unsure (1)..(155): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREXHNASPGYYDGRYWTMWKLPKFGCTDATQVXNEVEXVKERXPDXISATSGFNKMR

SEQ ID NO: 891 - protein, 411 aa, Pseudomonas aeruginosa PAO1
MAESRPARRFARIDRLPPYVFNITAELKMAARRRGEDIIDLSMGNPDGPTPPHIVEKLCTVAQREDTHGYSTSRGIPRLRRAISHWYRDRYDVQIDPESEAIVTIGSKEGLAHLMLATLDHGDTILVPNPSYPIHIYGAVIAGAQVRSVPLVPGIDFFNELERAIRESIPKPRMMILGFPSNPTAQCVELDFFERVVALAKQYDVMVVHDLAYADIVYDGWKAPSIMQVPGAKDIAVEFFTLSKSYNMAGWRIGFMVGNPELVSALARIKSYHDYGTFTPLQVAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKAMFRADGLLSPQRKVDSLAE

SEQ ID NO: 892 - protein, 271 aa, Sporobolus stapfianus
NEVEEEGEEFAAYCRRGKGRRRVEMEDRHVAKVALGGDPKAALFGVFDGHGGKNAAEFAAENMPKFVAEEMTKADGGESEIEGAVKRGYLKTDEEFLRRGESGGACCVTAVLQKGGLVVSNVGDCRAVLSRSGKAEALTSDHRASREDEKERIENLGGFVVNYRGTWRVQGSLAVSRGIGDAHLKQWIVADPDTRTLLVDQHCEFLILASDGLWDKIDNQEAVDLARPLCTSNDKASRMAACRMLVETSISRGSTDDISVVIIQLQNFSSS

SEQ ID NO: 893 - protein, 230 aa, Solanum tuberosum
SRVDKFSKSDIIVSPSILSANFSKLGEQVKAIEQAGCDWIHVDVMDGRFVPNITIGPLVVDSLRPITDLPLDVHLMIVEPDQRVPDFIKAGADIVSVHCEQSSTIHLHRTINQIKSLGAKAGVVLNPGTPLTAIEYVLDAVDLVLIMSVNPGFGGQSFIESQVKKISDLRKICAERGLNPWIEVDGGVGPKNAYKVIEAGANALVAGSAVFGAPDYAEAIKGIKTSKRPE

SEQ ID NO: 894 - protein, 371 aa, Arabidopsis lyrata subsp. petraea
CLSDQTLKPGSSKWVKVRSDVRKALEEYGCFEAQCDQVSMELQESVLKAMEELFALPKEAKQRNVSPKPFTGYLTHNDISESFGIKDANILEKAHEFTQQLWPEGNKSISKTIQLYSEKLAELDVMVRRLIMESYGIEKFIDEHLNSTYYRLRMMKYIARPDNDVNATVGANEDDGASDNADGDANLNNDGAIIGVKVNVDVGDDVNAETNVNGDVNAGAVGGVSGNASVGAKDANVEAELGLPCHTDKSLIGIIYQHQIDGLEVKTKEGKWIRVKPAPNTVIVIAGDALCALMNGRIPSPYHRVRVTEKKKTRYSAALFAYPKAGYIIDSPKELVDEKHPRAFKPFDFVDLFNFYHTEAGRSAQSTLQAF

SEQ ID NO: 895 - protein, 374 aa, Zea mays
MAPTTATKDDSGYGDERRRELQAFDDTKLGVKGLVDSGVKSIPSIFHHPPEALSDIISPAPPLPPSSPSGAAIPVVDLSVTRREDLVEQVRHAAGTVGFFWLVNHGVAEELMGGMLRGVRQFNEGPVEAKQALYSRDLARNLRFASNFDLFKAAAADWRDTLFCEVAPNPPPREELPEPLRNVMLEYGAAVTKLARFVFELLSESLGMPSDHLYEMECMQNLNVVCQYYPPCPEPHRTVGVKRHTDPGFFTILLQDGMGGLQVRLGDGQNGGCWVDIAPRPGALMVNIGDLLQLVTNDRFRSVEHRVPANKSSDTARVSVASFFNTDVRRSERLYGPIPDPSKPPLYRSVRARDFIAKFNTIGLDGRALDHFRL

SEQ ID NO: 896 - protein, 690 aa, Schizosaccharomyces pombe
MHSLKRRRNHAPDWQDFYKNGVPQEVIVIEDSASPRLTPNLPPPFSVHQLQSFVPPQPPSSSSPSTTGTVAVPINGANAVYPSTNSVSLPQSYDPWLDANGVVPLPHDVASHPSYMVQSPTSYHACSNNQSPFPHSHHPPLHNPLPVSCQPVLRPPPVPQVPSHWYPVSLPSPNLPHQPISKPPVIPNLPKLQVHPNRLPHPIHNHPYSSPTSYPPPLCPATYCPSNPPQLAPATAIAPSSQSSQHKSVNYSVTPSSINNHTAVPLSPTLAVWLPMTQPTFQPPSANVYQPASNANQVITPVSISDYRPPKKRKRAAWPPYKKVDRVNVPVVHDTTAFDPSTFDDDDGHYKVVPNSKFANRYTVVRLLGHGTFGKVIQCYDQSTGRHCAIKVTRAIPKYREASLIELRVLQTIAHSDPTNENKCIQLRDYFDYRKHICIVTDLFGWSVFDFLKNNNYIPFPLKHIQMLSQQLFKSVAFLHSLGLVHTDLKPENVLLVSNASRTIRLPYRNYSQKVLNSCEIRLIDFGSATFEDEYHSSVVSTRHYRAPEIILGLGWSYPCDVWSIGCILVELFTGQALFQTHEDSEHLCMMEKILGPFDRNMISRSSRTSQRFFKSDGKVRYPLSNTPKKSINYLQSLQTLEQIFAVSSPEVALLLDLLKKVFVYDPKRRITAKEALWHPFFTQPISSNL

SEQ ID NO: 897 - protein, 187 aa, Streptococcus mutans UA159
MILLIDNYDSFTYNLAQFIGHFTEVKVLRNDDADLYEAAQEADGLVFSPGPGWPADAGRMEALIKDFTGEKPILGVCLGHQAIAESFGGKLGLAHQVMHGKQSQMAITKSSPIFKELAEKLEIMRYHSIVVDKLPENFEVTARTVDDGEIMAIQHKTLPIYGLQYHPESIGTPEGLKMIENFVRLVG

SEQ ID NO: 898 - protein, 506 aa, Rhodococcus erythropolis
MTKYARPGTADAIMSFQSRYDNWIGNEWVAPVKGQYFENPTPVTGQNFCDVARSTAEDIELALDAAHAAAPAWGKTSVAERAIILNKIADRMEENLESIALAESWDNGKPIRETLNADIPLAIDHFRYFAGAIRAQEGSLSEINSDTVAYHFHEPLGVVGQIIPWNFPILMAVWKLAPALAAGNAIVLKPAEQTPVSILHLIGIIGDLLPAGVLNIVNGFGVEAGKPLASSPRIKKIAFTGETTTGRLIMQYASQNLIPVTLELGGKSPNVFFSDVLASNDDYQDKALEGFTMFALNQGEVCTAPSRALIQEDIFDEFLAMAAIRTKAVRQGDPLDTDTMIGAQASNDQLEKILSYIEIGKAEGAKVITGGERAELGGDLSGGYYVQPTVFTGNNKMRIFQEIFGPVVSVTSFKDYDEAIEIANDTLYGLGAGVWSRDGGVAYRAGRDIQAGRVWTNTYHQYPAHAAFGGYKQSGIGRENHLMMLSHYQQTKNLLVSYAQKAQGFF

SEQ ID NO: 899 - protein, 101 aa, Triticum aestivum
MSGVTADEDKKPAGDGGGAHINLKVKGQDGNEVFFRIKRSTQLKKLMNAYCDRQSVDLNSIAFLFDGRRLRGEQTPDELEMEEGDEIDAMLHQTGGCFPRP

SEQ ID NO: 900 - protein, 100 aa, Persea americana
PLLGGVRDVPDHNSAETEELARFAVQEHNKKANTRLEFSRVVKAKEQVVAGTMYYITLEVVEAGQKKIYEAKVWVKLWENFKELQEFKPVGDSSSTSSDA

SEQ ID NO: 901 - protein, 150 aa, Glycine max
  unsure (1)..(150): unsure at all Xaa locations
KSKASFPTRRHNNDIHSIASNVERVQSMQAWPPDGRQKCETLSYLPDIDHAQLATEVEYLFRKGCIPCMEFELEHGFVHREHDRSAGSFDGGSWTTCKMPTFGCTEASQVFKEXLYRVRXACPYGFIRIIGIVNVRRVQGIGFFADKPTG

SEQ ID NO: 902 - protein, 214 aa, Zea mays
  unsure (1)..(214): unsure at all Xaa locations
METFTQEHVIGIPLTSFAYADEERQGKSSCSAMVHKKNKKSSFIHRMNKLSHKTDSYMQGFKEHLTMGPKISETIKGKLSFGAKVLQAGGIDKVFREYFAVEKDEKPRKAFQXYFSTTTGPIARMLFISTKKIAFHSDRPLSFTSPKGGSTRVPYKVLIPTERMKXALVRENLYNPDETYIDVVTVDGFDFWFMGFVSYEKSFKYLQQVIMELR

SEQ ID NO: 903 - protein, 562 aa, Desulfovibrio desulfuricans G20
MESSGARILLECLKKEGVDVIFGYPGGAVIDIYDELPRHDLRHVLVRHEQAAVHAADGYARASGRVGVCLVTSGPGATNTVTGIATAYCDSIPLVVLTGQVPRALIGNDAFQEVDIVGITRPCTKHNYLVKELSDLPRIIREAFYLARSGRPGPVLVDLPKDIMVARAEFQIPEEVKLRSYNPTYRPNLNQLRRAAELVLSARRPLLFAGGGVVGSDASEELGWLARTLQIPVTSSLMGLGSFPGDDPLFLGMLGMHGTFAANKAVNSCDVLIAAGARFDDRVTGKLSAFAAGAKIIHIDIDPTSIRKNVGVEVPVVGDCRMALAGMREILSARFEENIPVPRWTEWLATVHDWAQSHPLGYVPSEGIKPQQVVETVFGITRGECIVTTEVGQNQMWAAQFFKYRKPRTLLTSGGLGTMGYGFPAAIGAQMAFPGHLVIDFAGDGSIQMNIQELATAVCNKLPVKIIILNNGYLGMVRQWQELFYQRNYCSTCMEAQPDFVKLAEAYGAEGYRITAQADLEPVLRQALQSPAPAIVDVRVEREENVYPMVPAGAALDEMLLV

SEQ ID NO: 904 - protein, 265 aa, Oryza sativa
GLRNRHEGLNQTLVPCTEPVKFLQIYSRGSTIQMALSRSVEVAVPADPAGDGDRDKIRLRQLGYKQELKRGLSVLSNFAFSFSIISVMAGVTTTYSTGLRYGGPVSMTLTRPVVSAFNGCMALSMAEICSAYPTSGGLYYWSAKLAGNDWAPFASWITGWFNITGQWAATTSVDFALAQLVQVIVLLSTGGANGGGYMASNYVVLAIYGAMLVIHGAINSLPIQCLSWFGQLGAFWNAAGVFVLVALIPAVATERASVEFIFTHF

SEQ ID NO: 905 - protein, 404 aa, Triticum aestivum
MAFCSPHSTTSLRSPCTTIPNSGFRQNQVILFTTRSSRRSNTRHGARTFQVSCAVEQPIVIGLAADSGCGKSTFMRRLTSVFGGAAEPPKGGNPDSNTLISDTTTVICLDDYHSLDRTGRKEKGVTALDPKANDFDLMYEQVKAIKEGKAIEKPIYNHVTGLLDPAELIQPPKIFVIEGLHPMYDERVRELLDFSIYLDISNEVKFAWKIQRDMAERGHSLESIKASIEARKPDFDAFIDPQKQYADAVIEVLPTQLIPDDNEGKVLRVKLIMKEGIKFFNPVYLFDEGSTINWIPCGRKLTCSYPGIKFSYGPDTYFGQEVSVLEMDGQFDRLDELIYVESHLSNLSTKFYGEVTQQMLKHADFPGSNNGTGLFQTIVGLKIRDLYEQIIAERAGVPAEAAKV

SEQ ID NO: 906 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 907 - protein, 333 aa, Zea mays
MASSNSNSSSNPLEAMGAFFSKQVDRRKLVTTEKRALATRLSSSGDTFPGSEHRPADRKRWMAELGADKLRVHQVVWPGTHDSATNKIGVPLVTRPFAQCQSMSVYEQLAMGTRVVDVRVQEERRVCHGILATYPVDVVLDDVSRFLSETESELVILEIRTEFGHEDPPGFDRFLADKLGEHLIPQDEAVFHRTVAELLPRRVICVWKPRKSPPPRPGDPLWSAGYLKDNWIDTDLPETKFESNLKFLGQQPPVAGRRFFYRVENTVTPKADNPVLCVWPVTKRIHGYARLFIAEAFAKGLGDKLQVFSTDFIDGDFVDACAGVTKARVDGTA

SEQ ID NO: 908 - protein, 664 aa, Nicotiana sp.
MAAAAAAPSPSFSKTLSSSSSKSSTLLPRSTFPFPHHPHKTTPPPLHLTPTHIHSQRRRFTISNVISTTQKVSETQKAETFVSRFAPDEPRKGSDVLVEALEREGVTDVFAYPGGASMEIHQALTRSSIIRNVLPRHEQGGVFAAEGYARATGFPGVCIATSGPGATNLVSGLADALLDSVPIVAITGQVPRRMIGTDAFQETPIVEVTRSITKHNYLVMDVEDIPRVVREAFFLARSGRPGPVLIDVPKDIQQQLVIPDWDQPMRLPGYMSRLPKLPNEMLLEQIVRLISESKKPVLYVGGGCSQSSEELRRFVELTGIPVASTLMGLGAFPTGDELSLSMLGMHGTVYANYAVDSSDLLLAFGVRFDDRVTGKLEAFASRAKIVHIDIDSAEIGKNKQPHVSICADIKLALQGLNSILESKEGKLKLDFSAWRQELTVQKVKYPLNFKTFGDAIPPQYAIQVLDELTNGSAIISTGVGQHQMWAAQYYKYRKPRQWLTSGGLGAMGFGLPAAIGAAVGRPDEVVVDIDGDGSFIMNVQELATIKVENLPVKIMLLNNQHLGMVVQWEDRFYKANRAHTYLGNPSNEAEIFPNMLKFAEACGNPAARVTHRDDLRAAIQKMLDTPGPYLLDVIVPHQEHVLPMIPSGGAFKDVITEGDGRSSY

SEQ ID NO: 909 - protein, 598 aa, Leptospira interrogans serovar lai str. 56601
MLDHNLLINLIVFLSAAVISVPLFKRIGLGSVVGYLVGGTIIGPWGIGLITDVDSILHLSEFGVVLLLFLIGLELKPQRLWILRRPVFGLGGLQVILTSLTFFILLSLLGLEKRQAIVISISISLSSTAFALQVLGEKNELNTTHGRSAFAILLFQDLAIIPIMATLSFLTESSSNPGSHGSIKEILFPIGTIIAVILAGRFLARPLFKLVASSANHEIFTALSLLIVIGVSILMNQVGLSMALGSFLGGVILADSEYRHELESNLEPFKGLFLGLFFLAVGMSINLGEVLKDPILVILLAFILILVKTIILYFIGIITKHSKEVSLNLSTIISQGGEFAFVILGVGVSLSILPKERADLVIAVVTLSMGLTPILGILKDKTSKWILKEDQNIKEDTIEEQNRVIVAGFGRFGQIIARMLFVHKIGFTALEHNPDQVNLARKFGYKIYYGDASKLSLLRSAGAEHADLFILAIQDIDVSVKIAELIKKNFPNLTIIARARNREHVFKLMELGIQIIRRDTFASALELAGETLSQLGFIDSEVEKKVKKFRAHDELTLKGQFQIRGDEKEFIQFSKNSMRQLEDAFEADRQEKEGKIAG

SEQ ID NO: 910 - protein, 62 aa, Brassica rapa
ATLKMIVSKYPDLKGINFDLPHVIEEATSHPGIDHVGGDMFVSVPKGDAIFMKWICHDWSDE

SEQ ID NO: 911 - protein, 131 aa, Narcissus pseudonarcissus
RMFHELDAESKAEFYSRDPKKSVKYNSNYDLYESPTAYWSDTISCHFDKLMDPEELPSVCRAEMLNYHQHVMTLVEMLCELLSEALGLPSSYLKNINSTESQLLAAHNYPPCPEPTLTLGMPKHIDPSFLT

SEQ ID NO: 912 - protein, 303 aa, Streptomyces netropsis
MRGILLAGGTGSRLWPVTRAVSKQLMQIFDKPMIYYPLSTLMMAGIREILIITTREDQPGFRRLLGDGSHLGIEITYAVQECPEGIAQAFLIGSDFIGAETVALALGDNIFHGQAFGRRLRAHRNLSGARVLAYPVADPSAYGVVEISETGAAVSVEEKPEKPKSRYATVGLSFYDHRVVDIARGLRPSERGELEITAVNEEYLRRGELAVTVLDRGTAWLDTGTFSAMVQASEYVRVMEERQGLKIGCVEEVAWRCAYIDDDQLRELGRPLLKSGYGDYLLALLDEPRTHHGFPLPAAEDAW

SEQ ID NO: 913 - protein, 206 aa, Xylella fastidiosa Temecula1
MPYRVIVVDAYDSFVHILVSYFEQLGCKVTVLRKDDPGLLALIDPLYSDIIVLGPGPGHPSQSGYDIILNKNSGRLPVLGVCLGHQAIGLYYGCIIEYAKNLMHGKTSLIKHDGQGCYVSLNSRTLKVMRYHSIIVANKDIPSHMAVTSYSIDDNYIMGLRHQSLPIESVQFHPESIATECGLDLIKNFITTYTFNKKGCKYEELH

SEQ ID NO: 914 - protein, 294 aa, Escherichia coli K12
MHPRFQTAFAQLADNLQSALEPILADKYFPALLTGEQVSSLKSATGLDEDALAFALLPLAAACARTPLSNFNVGAIARGVSGTWYFGANMEFIGATMQQTVHAEQSAISHAWLSGEKALAAITVNYTPCGHCRQFMNELNSGLDLRIHLPGREAHALRDYLPDAFGPKDLEIKTLLMDEQDHGYALTGDALSQAAIAAANRSHMPYSKSPSGVALECKDGRIFSGSYAENAAFNPTLPPLQGALILLNLKGYDYPDIQRAVLAEKADAPLIQWDATSATLKALGCHSIDRVLLA

SEQ ID NO: 915 - protein, 222 aa, Vibrio vulnificus CMCP6
MKDFLIAPSILSADFARLGEDVEKVLAAGADVVHFDVMDNHYVPNLTFGAPVCKALRDYGITAPIDVHLMVKPVDRIIPDFAKAGASMITFHIEASEHVDRTLQLIKEHGCKAGVVLNPATPLAHLEFIMDKVDLILLMSVNPGFGGQSFIPHTLDKLRAVRKMIDATGRDIRLEIDGGVKVDNIREIAEAGADMFVAGSAIFGQPDYKAVIDEMRAELAKA

SEQ ID NO: 916 - protein, 446 aa, Oryza sativa (japonica cultivar-group)
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 917 - protein, 240 aa, Magnolia praecocissima
MGRGRVQLKRIENKINRQVTFSKRRMGLLKKAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRRPIMLIHCGASKKEKSLREQNNMLEKEIQEKEKAMAQQAQWEQQNQSQSSHPSWLASPLPTLNIGTYHQGNEVEEEGARPPARTNSLMPPWMLRHVNE

SEQ ID NO: 918 - protein, 347 aa, Guillardia theta
CELRDGDKSRYLGKGVSKAVKNVEEKIAPAIKGMDPTDQEGIDKKMIEVDGTPNKTNLGANAILAVSLAVAKAGAAQKGVPLYQHFADMAGVKKYVLPVPWMNVINGGSHAGNRLAMQEFMIGATGATSFKEAVRMSCEVYHALKAVIKKKYGMDACNVGDEGGFAPNIQDNKEGLSLLTEAIANAGYTGKIKIGMDVAASEFYQDGKYNLDFKNANADPSMVVSGDELIEVYKSFTQDFPVVTIEDPFDQDDWEHYNKFNSQMPHTQIVGDDLLVTNPNRITMAIEKKACSGLLLKVNQIGTVSESIKACKMSQEQGWGVMRSHRSGETEDTTIADLVVGLATGQI

SEQ ID NO: 919 - protein, 368 aa, Coxiella burnetii RSA 493
MTPKTTTVANFTIRYLQFLDANSNPTQPFPDFADPDMLLYLYRRMALIRQLDNKAINLQRTGKMGTYPSSRGQEAVGIGMGSAMQKEDIFCPYYRDQGALFEHGIKLSEILAYWGGDERGSRYANPDVKDDFPNCVPIAGQLLHAAGVAYAVKYRKQARAVLTICGDGGTSKGDFYEAINLAGCWQLPLVFIINNNQWAISVARGEQTHCQTLAQKAIAGGFEGWQVDGNDVIAVRYAVSKALEKARDGGGPTLIEALSYRLCDHTTADDATRYIPQEEWKVAWQKEPIARLGYYLESQGLWSREKEAVLQKELAQEVDQVVEEFLTMPPPKATDMFDYLYAELPVSLEKQREELADNKPSHPSGREG

SEQ ID NO: 920 - protein, 114 aa, Zea mays
  unsure (1)..(114): unsure at all Xaa locations
THRTSLRSARAPSKLHNTCTDSLLAXPIILVLXLLSELMARSHVKPEGTXKYHSFHPAXTIPRYLTKAPLDRPDTPLGNAITXPMAMLYNIIRAWAVLTPHNHMILEYLGRIPH

SEQ ID NO: 921 - protein, 516 aa, Blumeria graminis
MHRTFHPYFLLKMSGSSQRHSHVTGYLILLVAVATLGPLQYGYHLAELNAPQDVITCHSLLGRQNVASKSLSNPSQCIPMTEAEFAALSSIYILGGLAGAITAGPISSSHGRLLTMRITGIFFILGSLIETIAESVPVMSTGRFLAGLGAGAATVVAPMYISEISPAEKRGLFGTMTQAMISVGIFVTQSLGYFFSRGMLWRIILGVGAGFGLLLGAGLCFIPESPSWLASHHNPTLAVKTLQRIRGAGTPIHKETAGWNVQEINGEEERLIRPSDLSSTSQYNQHNLATPNLKLPSVGFFGVLQDPLYRPAIMAVCGIMIAQQLSGINSIMMYSVSLLRGVLPIPSILLTIIMSAMNVITTIVCAPLADRIGRKSCLLLSIAGMGTMSLLLAISLRMEWKLFSAIAVISFVAFFATGLGPVPYIMASELVGQEAVGAAQSWALAANYLASFLVAQFFPLLNSWMNNRWGGAGWVYFIFTAFAGVSWIFVTYYVPETNGKTGPDEVWGRTTGEVAD

SEQ ID NO: 922 - protein, 111 aa, Glycine max
  unsure (1)..(111): unsure at all Xaa locations
RGTVAPGSFFGSPIALSMRGQIDPWRKPKKLGGTWMFSEYMLAYGRDLLAMHAGTVEPWARALGVDNXTATGGSLWAALCLLKRRGSXVMACRSAIDLPYXKGRRRLDGNP

SEQ ID NO: 923 - protein, 488 aa, Heterosigma akashiwo
MSNNVYERNRIKNDRYESGVIPYAKMGYWDANYSVKDTDLLALFRLTPQPGVDPVEAAAAVAGESSTATWTVVWTDLLTACDVYRAKAYRVDPVPSAADQYFAYIAYECDLFEEGSLANMTASIIGNVFGFKAVAALRLEDMRIPYAYLKTFQGPATGIIVERERLDTFGRPLLGATVKPKLGLSGKNYGRVVYEGLRGGIDFLKDDENINSQPFMRWRERFLYCMEGINRASAASGEVKGSYLNVTAATMEEMYERADYAKAVGSVIVMIDLVIGYTAIQSMAIWARKNDMILHLHRAGNSTYARQKNHGINFRVICKWMRMAGVDHIHAGTVVGKLEGDPLMVKGFYDVLRETELSINLPQGIFFEMDWASLRKCCPVASGGIHCGQMHQLVYYLGDDVVLQFGGGTIGHPDGIQAGATANRVALEAMILARNEGRDYVSEGPEILRDIAKLCGPLKTALDLWKGITFNYTSTDTADFVETATSNP

SEQ ID NO: 924 - protein, 98 aa, Buchnera aphidicola
LPSASLNDSNFGLYEPAGGSAPDIAGKNIANPIAQILSIAMLVRYTMKLPMISDHIESAVIDTLKKGYRTLDIANDKEQYVSTNDIGDIISDILKKRI

SEQ ID NO: 925 - protein, 350 aa, Euphorbia esula
MANHSPLFLYDALYCSEEDNWEGEVVDIFHEQEDQGENTSVFPQNSSPVDLNWEEDELTSVFSKQEQNQLYKKLEINPCLAKSRRDAVDWMMKVNAHYSFTALTSVLAVNFLDRFLFSFDLQTEKPWMTQLTAVACLSLAAKVEETQVPLLLDLQVVDSKYVFEAKTIQRMELLVLSTLQWRMNPVTPLSFIDYMTRRLGFKDYLCWEFIRRCELIVLSIISDMRFIPYLPSEIASAIMLHVINGIEPSLGDEFETQLFGILGIDKEKVNNCREMIIELGSRYYGNQSNKRKYGSDPGSPNCVMDVSFSSDNSNDSWAVGSKSSSVSSSPAAKKLRAVSGMNHENAIILS

SEQ ID NO: 926 - protein, 394 aa, Zea mays
MGSFAKLARRAVETDAPVMVKIQELLRGAKDVMSLAQGVVYWQPPESAMDKIEKIIREPIVSKYGSDDGLPELREALLEKLSRENKLTKSSVMVTAGANQAFVNLVLTLCDAGDSVVMFAPYYFNAYMSFQMTGVTDILVGGCDPKTLHPDVDWLEKVLKENEPIPKLVTVVNPGNPSGAFIPRPMLERISDLCKNAGAWLVVDNTYEYFMYDGMEHYCLEDAHIVNLFSFSKAYGMMGWRVGYIAFPNEADGFHDQLLKVQDNIPICASIIGQRLALYSLEAGPEWIKERVKDLVKNRALLVEALSPLGEDNVKGGEGAIYLWAKLPDSCSDDFEAVRWLANKHGVAVIPGSASGGPGYIRVSFGGLKEEDTRLAAERLRRGLQELVTDGMVQ

SEQ ID NO: 927 - protein, 363 aa, Shigella flexneri
MSKNYHIAVLPGDGIGPEVMTQALKVLNAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDIQCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 928 - protein, 492 aa, Hypericum perforatum
MDPYKYRPSSAFNSPFWTTNSGAPVYSNDHSLTVGSRGPILLEDYHLVEKLANFDRERIPERVVHARGASAKGFFEVTHDISHLSCADFLRAPGVQTPVIVRFSTVIHERGSPETLRDPRGFAVKFYTREGNFDLVGNNFPVFFIRDGMKFPDMVHALKPNPKSHIQEDWRILDFFSHHPESLHMFSFLFDDIGIPQDYRHMEGSGVNTYTLVNKAGKVHYVKFHWKPTCGVKSLLEDEAIKVGGSNHSHATKDLYDSIAAGNYPEWKLFIQTIDPDHEDRFDFDPLDVTKTWPEDILPLQPVGRLVLNKNIDNFFAENEQLAFCPAIVVPGIYYSDDKLLQTRIFSYSDTQRHRLGPNYLQLPVNAPKSAHHNNHHEGFMNFMHRDEEVNYFPSRYDPVRHAEKYPIPPVVLNGRREKCMIAKENNFKQPGERYRSFSPDRQERFLNRWISSLSDPRVTHEIRAIWVTYWYQADKSLGQKLASRLNVRPNM

SEQ ID NO: 929 - protein, 567 aa, Zymomonas mobilis
SYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 930 - protein, 656 aa, Yersinia pestis CO92
MSVEKQFSVSAEKTCNTENKCNTEKKFDVICMGRIAVDLYGQQIGARLEDVASFAKYLGGSSGNVAYGSARQGLRSSMLARVGDEHMGRFLREELHQVGCDTSHLTTDKKRLTALVLLSIKDRDTFPLIFYRDNCADMAITAQDFSEQYIASARSLAITGTHLSHPNTREAVLTALRYARRNGVRTVLDIDYRPVLWGLTSLGDGETRFIESHQVTAELLAVFNLFDVIVGTEEEFHIAGGSTNTLDALRGVREVSDAALVCKRGALGCSVYTEAIPQTLDEGLTVSGVRVKVLNVLGAGDAFMSGLLRGYLNDEGWPQACRYANACGALVVSRHGCAPAMPSKIELDNYLARADAVVRPDLDVHLNHLHRVTTRRRQWPELCVMAFDHRSQLEEMALQCGADLCHISTLKTLILQASREAVHTAGLQGKAGLLCDGTFGQDALNAITGAGWWIGRPIELPGSRPLAMEHGNIGSQLIGWPQEHIVKCLVFFHPEDAYSLRLEQEQKIIEVYRACCQSGHELLLEVILPAGMPRSDELYLRAISRFYNLGVYPDWWKLPPLASEGWAALNKLIERRDPHCRGVVILGLDASLEALRTGFNAAAGYPIVKGFAVGRTLFGDASLAWLKRDIDDTQLIARIRDNYLQLITLWRERGQK

SEQ ID NO: 931 - protein, 118 aa, Zea mays
DLHKTSAGLGSVIIDSQPLTVAILASLLFGESIGAIGVGGLVLGVVGLLLLEVPALSVEGNDTTIWGSGESLMFLSAQSMAVGTIMVRWVSKYSDPIMATGWRLYCFNLAFLCSILAN

SEQ ID NO: 932 - protein, 308 aa, GIBBERELLA ZEAE PH-1
MSDYKTYSFNPAQDIPSLDGKVILITGANTGLGKATALELAKHNPAHIYITARNSTKGNTALEEVKGVASEGTQVSLLELDLSSFDSIKAAAKDFLDREVRLDVLLLNAGVMGAPPVLTKDGYEMHIGTNHLGHALLLKLLTPVLDKTPNARVVHLFSAGFRHVGPNGIEFDTLKSATSPTPLPLRYAQSKLACLLYAREAAKRYNFTNIAINPGEVQTELFSRKAGDEMMKHLQENVAPKMAGPISEGVKNHLWAATSTEIKNGEFYEPVGKTGGLEGAGLDEEMANKLWDWTEEQLEGLRVSEIDR

SEQ ID NO: 933 - protein, 150 aa, Fusarium cerealis
WRVIMGVGIGGDYPLSSIITSEFATTKWRGAMMAAVFAMQGIGQLVAALVMMFLTLGFKPSLEQAADTKSCTGDCQIAVDKMWRTLVGFGAVPACIALYYRLTIPETPRYTFDVARDVEQADEDVKAYINGKSEGNTDEVSRAQNLQSAK

SEQ ID NO: 934 - protein, 280 aa, Arabidopsis thaliana
MVPFHGGCSRRYGFFTDSYDLFVISLITKLLGRIYYQVPGSSSPGSLPDGISVAVSGVAFAGTFLGQIFFGCLGDKLGRKRVYGLTLLIMTICSIASSLSFGKDPKTVMVTLCFFRFWLGFGIGGDYPLSATIMFEYANKRTRGAFIASVFAMQGVGILAAGGVSLLVSYLFEIEFPSRAYILDGAASTVPQADYVWRIILMVGALPALLTYYWRMKMPETARYTALVAKNAEQAALDMNKEIFTEVDEKRFALTICQSENWFSRFVFSFNFGPNYPGKT

SEQ ID NO: 935 - protein, 136 aa, Zea mays
MRAVQFSGRAGHGSITFWGCHLWQQQQAHSGAQTQLALAARRDVSPDTVASIILGGGAGTRLFPLTRTRAKPAVPVGGCYRLIDIPMSNCINSKINKIYVLTQFNSQSLNRHIARTYNFGEGVGFSGGSVEVHSSV

SEQ ID NO: 936 - protein, 396 aa, Solanum tuberosum
MDASAPQMDTMMPDVAAPAVQQPPPPPQPLPGMDNIPATLSHGGRFIQYNIFGNIFEVTAKYKPPIMPIGKGAYGIVCSALNSETNENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLASLHDISDEPICMTPFNFDFEQHALTEEQMKELIYRESIAFNPEYQRM

SEQ ID NO: 937 - protein, 489 aa, Zea mays
MPDKAVDDVMEAAVGAHFSGLRLEALRLPTSAPSSPSSSPAAAAHTHSNGAVYANGTTELPSPAAARQPFVIGVSGGTASGKTTVCDMIIQQLHDHRVVLVNQDSFYRGLTADESAHAQDYNFDHPDAFDTEQLLECMGQLKCAQPVNVPIYDFKKHRRKTTKLEVNASDVIILEGILVFHDQRVRNLMDMKIFVDTDADIRLARRIRRDTVERGRDISSVLDQYGRFVKPAFDDFVLPSKKYADVIIPRGGDNHVAVDLIVQHIRTKLGQHDLCKIYPNVHVVQSTFQIRGMHTLIRDRDITTPDFVFYSDRLIRLVVEHGLGHLPFTEKQVITPTGSVYMGVDFCKKLCGVSIVRSGESMENALRACCKGIKIGKILIHRVGDNGQQLVYHKLPMDIAERHVLLLDPVLGTGNSVAQAIDLLIRKGVPEDRIIFLNLISAPEGIQCICKRFPSLKIVTSEIDYGLNEEFRVIPGLGEYGDRYFGTDN

SEQ ID NO: 938 - protein, 124 aa, Zea mays
MATQSPHVLVVDHSRVDCLVASIVLNSFNIRVTVAGGAMEALEFLDANNSHVDLILTDYCMPDMTGYDLLREVKESPRLKHIPVVITCTDVIPERIIECFEGGAEEYMIKPLKVSDVPRILSYM

SEQ ID NO: 939 - protein, 515 aa, Glycine max
  unsure (1)..(515): unsure at all Xaa locations
RQDVHPNSPSCLLFIDGDWKVPVLKNRIPIINPSTQHIIXGDIPAATKEDVDLAVAAAKAALSRNKGADWASASGSVXRARYLRAIAAKITEKKPELAKLEAIDCGKPLDEAAWDIDDVAGCFEFYADLAEKLDAQQKAHVSLPMDTFKSYVLKEPIGXVVALITPWNYXLLMATWXKVAPALAAGCACNIXKPSELASVTXLELAEICKEVGLPPGVLNILTGLGPEAGXAPLAAHXNVDKISFTGSSATGSRIMTAAAQLTKPVSLELGGKSPIIVFEDVDLDKTAEWTIFGCFFTNGQICSATSRLIVHESIATEFVNRLVQWAKNIKXISDPFEEGCRLGPIVSEGQYKKVLNCISTAKSEGATILIGGSRPXEHLKKGYFVEPTIITDVTTSMQIWREEVFGPVLCVKTFSTEEEAIELANDTHYGLGSAVMSKDLERCEXRISKAIQAGIVWINCAQPSFIQAPWGGVKRSGFGRELGEWGLENYLSVKQVTKYISDEPWGWYQSPSKL

SEQ ID NO: 940 - protein, 151 aa, Hordeum vulgare
MSIVRRSNVLDPFADLWADPLDTFRSIFPAISGGNSETAVRERRMDWKGRRLEAHVFKADLPGVKKEEVKVEVEDGNVLIVSGERTKEKEDKNDKWHRVERRSGKFVRPFRLPEDGKVDEVKAGLENGVLTVTVPKAEVKKPEVKAIEISG

SEQ ID NO: 941 - protein, 736 aa, Bifidobacterium longum NCC2705
MAIVALGVVYGDIGTSPLYTAQTFLAGQGGLGSVDREAVLGMLSLVFWSITLITTVKYVLIAMRIDNNGEGGIFALYSLIRKYGAWLAIPAMLGGAAFLADSVLTPAVSISSAVEGLQTLPPLEGLFDENPSLTLMITVVIIVILFSVQSRGTESIGKVFGSMVLVWFGFLAIVGVTNLSNDWSVFEALNPVYGIKFLFSPNNAAGIALMGTVFLSTTGAEALYSDMGHVGRGNIYFTWPFIKVALVLNYFGQGAWMLANSDNPQYTAMESLNPFFQMMSPNVRYLAVILSVSAGVIASQALITGAFTMVSEATRLNWMPHLQVRYPARTRGQLYIPVVNGVLCVSTLAVLAIFKDSEHISAAYGLALTITMITTTVLLGVYLWHSGKRVGAIVFTVLFLAIQAMFFIASMAKFLHGGWFTMLLTAAILFVMYTWNEGTKLERAQRRHMRPNDFLPALDKLHSDFRIPYFADNIVYLTSDSETKRLDTDIFFSIFADHPKRARAWWAVSVETTDEPFTREYSVEDFGTNYIYRVRFRLGFKVSQSIPAYIHQIMHDLSKTGELPKQKSIYPKVDADPDIGTIRYVLIHKALMPESKVSARGALSLQAKYAIRHMAGSPVKWFGLAPYNPLVEVQPLFVSTRRPPRLKRTDTAKTIPTPTPTRAVADPAAVPDPMDTTSGLGRLVQELDAAVSAEARKTAEAAAADAPAEQGDKGDKGKAENGKPAAKPQRSAKQKR

SEQ ID NO: 942 - protein, 514 aa, Zea mays
  unsure (1)..(514): unsure at all Xaa locations
MAYPAAPHTSAAFLASFATPLPARCASPPTRRRAVSDAAIATTTTCGFADAPRGIKEEHPDSGAQAPAAATARKDLSPDTVSCIIYGGVAGARHLPLKRKRAATAXACGGCYSLIDIRMSNWSESKIKKHLPYSHSTNSHCTCSQIARVQKRGSVLEFRGWSVEVLAATQTAGESGKKWFQGTADAVRQFLWLFEDARLKCIENILILSGDHLYRMDYMDFVQKHVDSGADISVACVPMDESRASDFGLMKADRNGHITDFLEKPKGADLESMQVDMGLFGLSPEFASTYKYMASMGIYVFKADVLRKLLRGHYPTANDFGLEVIPMAAKDYDVQAYLFDGYWEDIGTIKSFFEANLALTDQSPNFYFYDPVKPIFTSPRFLPPPSRNCRXLNSIVSHGCFLTECSVEHSVIGIRSRLEPGVQLKDTMMMGADYYQTEAERLSELSVGKVPVGVGENTKIRNCIIDKNARIGKNVVIMNSENVQEADRPAEGYYIRSGITVVLKNAVILNGTKI

SEQ ID NO: 943 - protein, 253 aa, Zea mays
  unsure (1)..(253): unsure at all Xaa locations
RHTHERRNPTRPPRTTAPTMDAGAARPSAPSTAAVAGASVADEPRDARVVRELLRSMGLREGEYEPRVVHQFLDLAYRYVGDVLGDAQVYADHAGKAQIDADDVRLAIQAKVNFSFSQPPPREVLLELARSRNRMPLPLRSVLPCAGLPLTTSHQLGSLLLADTLLAQNYQLLAXPLKPPPQYEETEDETEEPNPSNPANSNPSYSQDQSSKEQQQQHTPQHGQRVSFQLNAVAAAAAAAKRPRMAIDQLNMG

SEQ ID NO: 944 - protein, 317 aa, Zea mays
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEALGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSTGIGEAMVGINLNDPKVERYAARSE

SEQ ID NO: 945 - protein, 412 aa, Nicotiana tabacum
MAATSATTFSVGSATSLGCKGSSVSQSKAFSVKFYSKNSLKSFSGLKAATDVSCESESSFLGKESVAVLKQSFTPKAQKENKGYGNCVQPQASYKVAVLGASGGIGQPLSLLVKMSPLVSELNLYDIANVKGVAADLSHCNTPSKVSDFTGASELANCLKGVNVVVIPAGVPRKPGMTRDDLFNINANIVKTLVEAVADNCPDAFIHIISNPVNSTVPIAAEVLKRKGVYDPKKLFGVTTLDVVRANTFVAQKKSLRLIDVDVPVVGGHAGITILPLLSKTKPSTTFTDEEVQELTVRIQNAGTEVVEAKAGAGSATLSMAYAAARFVESSLRALDGDSDVYECAFVQSDLTELPFFASRVKLGKNGVEALIPSDLQGLTEYEQKALDALKPELKSSIEKGIGFVQKEPVAA

SEQ ID NO: 946 - protein, 476 aa, Schizosaccharomyces pombe
MESIQSTMKNINLYDIKAAVRKAQNVVMNYTSMEARVREATNNEPWGASTSLMMEIAQGTHNYSQLNEILPMIYRRFTEKTAEEWRQIYKALQLLEFLVKNGSERVVDDARAHQATIKMLRNFHYIDHRQKDQGLNVRTRAKELVELLNDSERIRKERKRARQNRGKFIGVGSDGDSRISTSSKSRFPSFGSSRGSYRTRVYGDGGGFTDYGNGYHDSSSMSDSRDASDNDVEEYNEDGDGGSSDAATANSTRGSRRTTTKQSDKAPEQPKQESAMIDLLGLDNEPSPAQPQTNTSAPLAFEDDGFGDFQSSAAAPASSTLNNASLFMGSQTASTAAKNDDDAFDDFQSAPSAKPASNTAAFSSISFGGFNSLNQLPTSSSAFTPQPTTFNTGYTSAFGMSSGLSNTSSQAGLGLTSQQPTAAKSSGSNGDAFGSLWSSAVNKVHQENSTRERVVSSSSEPVSKTQNFLDNDNLLL

SEQ ID NO: 947 - protein, 291 aa, Clostridium thermocellum ATCC 27405
MNLVDLFKKKKPVISFEIFPPKLDTPIESIFGTLEQFKELKPDFISVTYGAGGSAKDRTIEIASKIKNEYGIESMAHLTCVGHSKEEIDALLTSMREHNLENILALRGDPPANQPDFDFSNNAFKYANELIAHVRKQNRNDFCIAAAAYVEGHVNSKRLKDDLLYLKQKVDTGVDFLVTQLFFDNRLFYDFLDKTASIGITCPITPGIMPIFKADQIKRITYLCGASIPAKLVIMMDKYGDNDEDMRKAGIEYASNQIRDLIDNGVDGIHLLTMNRPKSTREILTNIGLLK

SEQ ID NO: 948 - protein, 294 aa, Citrobacter freundii
IVFRAAQERSDIEIVAINDLLDADYMAYMLKYDSTHGRFNGTVEVKDGHLIVNGKKIRVTAERDPANLKWDEVGVDVVAEATGLFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDNFVKLV

SEQ ID NO: 949 - protein, 110 aa, Glycine max
  unsure (1)..(110): unsure at all Xaa locations
PVAFARTPVTSSGVSSCGGTAQARIEARGFIFGSPIXGAKFVPLRKPKKXPGKVISQEHILEYGRDCLEMHVGLXAVEPAEHALVVDDLIATGGTLCAAMDLLGFDAWCS

SEQ ID NO: 950 - protein, 416 aa, Shigella flexneri 2a str. 301
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIKNM

SEQ ID NO: 951 - protein, 451 aa, Shigella flexneri 2a str. 2457T
MTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 952 - protein, 752 aa, Coprinopsis cinerea
MTFASPRILLVDSYDSFTHNLAALCRRSIPNCSVHIIKNDELFLEAVKPNLQYFSAIIVGPGPGSPSKPEDIGIVRDLWKLDSEHVLPIFGVCLGLQSLVLEFGGELKRLHTVKHGQISKVEHVPSEIFQDVGEIHAVRYHSLHVALPSDGSVEELAWVDEEENGHVVMAVKHTRLPFWAVQYHPESVRTEGGGWKVLSNFWTLCQEWSKNNGRAPTPWNPSIQNEVGALWPYNHSFSVKRPSTTPSFASVLSRAVNLPITSLPAVCEHLGVLDERSKFVVLDSASNPGRFSIIGCLLPNSLHITHYVGDPFVTLTRGSQTASELLGSQDIWQWLASYIRTKSGPKGDPAIPFWGGFIGYFSYESGLPTLHVPLIHRKDRRHPDVNLVYVERSIVFDNETGKAHIQSLLPSDEDWMDQKSKDLSILAQPQPRRRSSISLPPVSKVILPEQDQYIYKIKQAKEYLYSGDSYELCLTAQTKILIPHQQSKGSTTSTSWERYLRLREKNPAPHSAYIRLHPTTLMSSSPERFLSYSRPPHSVCQLRPIKGTVRKGPGITREVATQLLAGSPKEVAENLMIVDLIRHDLHGVVGDNVVVSKFCGVEEYETVWQLVSVIEGKEDPSASVEEELGWNVLKASLPPGTMTGAPKKRSVEILQHLEGAEREVYSGVFGYWDIGGGGDWSVTIRSCFKYDDRSSSKDKTEEWAIGAGGAITALSDPDAEWDEMEVKLQSVLKSFGCHITNFVNGGEAEAPL

SEQ ID NO: 953 - protein, 148 aa, Glycine max
  unsure (1)..(148): unsure at all Xaa locations
MACSMISYAAVTTVNRACAGMVAPFTGLKTMAGWLPRMRAFDITSIASNGGRAQCVQVWPPXWIKKFETLIYLPDXLEDAQLRKEVEYLLRKGWMPSLQFELDHGFVYREHNRSPGYYNGRYWTMVKLPMFGCTEATQVVNELQEAKT

SEQ ID NO: 954 - protein, 214 aa, Michelia figo
  unsure (1)..(214): unsure at all Xaa locations
RPCAEMSMLCDAEVALIVFSSRGKLYEFGSAGVNKTLERYQRCCYTFQDANITDRDTQGWYQEVSKLKAKCDSLQRSQRHLLGEDLGPLSVKELQKLERQLESALTQTRQRKTQIMLEHMEALREKERQLGDINKELKNKLEAKGQGAFRAMQASWESGPLVGNNGFPMHPSQSAAIECEPTLQIGYHSFAAPEASIPRTVVAESNFMPXGMLC

SEQ ID NO: 955 - protein, 475 aa, Arabidopsis thaliana
MAGAYDPSLPEVPEWLNKGDNAWQLTAATLVGLQSMPGLVILYASIVKKKWAVNSAFMALYAFAAVLLCWVLLCYKMAFGEELLPFWGKGGPAFNQGYLKGQAKIPNSNVAAPYFPMATLVYFQFTFAAITTILVAGSVLGRMNIKAWMAFVPLWLIFSYTVGAYSIWGGGFLYQWGVIDYSGGYVIHLSSGVAGFVAAYWVGPRPKADRERFPPNNVLLMLAGAGLLWMGWSGFNGGAPYAANLTSSIAVLNTNLSAATSLLVWTTLDVIFFGKPSVIGAIQGMVTGLAGVTPGAGLIQTWAAIIIGVVSGTAPWASMMIIHKKSALLQKVDDTLAVFYTHAVAGLLGGIMTGLFAHPDLCVLVLPLPATRGAFYGGNGGKQLLKQLAGAAFIAVWNVVSTTIILLAIRVFIPLRMAEEELGIGDDAAHGEEAYALWGDGEKFDATRHVQQFERDQEAAHPSYVHGARGVTIVL

SEQ ID NO: 956 - protein, 238 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQQGQAVELEPEQQLDPRAQPAHDAEETAAEPPPAASNGTADGGNKRKAAAMEEEGMLAVMTVAAPESSTKPRLSTTSNSLAVET

SEQ ID NO: 957 - protein, 488 aa, Colpomenia bullosa
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIIMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRKAAATCGPLKAALDLWKDITFDYTSTDTPDFVEVATGSR

SEQ ID NO: 958 - protein, 722 aa, Thermosynechococcus elongatus BP-1
MRLKSLPTDGWLLLLGILALLGILLWQLDWRNLLPNLVGFWHEGQAIMRPQGTTLEALLLPAFVWLAITFLLKELSPKPTFWSRLIVSVGIALLGIRYELWRFFGSLNLDDRLNGTISLALFLAELLTVLNSVAFFFHCIFSIDRTPEADRLSQAVIRGEYLPWVDVILPTYNEGVEILRRSVIACQAMDYPHKRIYLLDDTRRPAVRALAKELGCEYRDRPDNRHAKAGNINHALPTLTGELIAVFDADFMPTRNFLTRTVGFFQDAKTAMVQTPQHFFNEDPVTVNLGLEGIVNNEQTLFFRFIQPSRDFFNAVVCCGTCFVIRRSALDEIGGIPTDSITEDYMTTIKLQTRGYRVKYLNEALAAGMSPETISAYINQRLRWGQGTLQMLFLGGNFLTAPNLRLTQRLSHALSIIYWFLSIPRVIFLLAPLAFLLFGIAPLRATVNEILYFYFPYYLGNIMAFSWLTEGRRSAFWSDVYETIIAFPMAITVIRTLISPRGKTFKVTPKGVVDPHRININWPLIRPLMIIAILTIGGLIWRSSPLQETIVNPDSLAVNVVWSIYNLSLLLVCMLVAIDVPQRRHPRFLRSEPCELIVGGDRYRGQTVDISEEGVRIRLNRFPPESLGQSVGELHFLEPSPFINLRLPVQVRWSRTANLGSKSLVLEIGVQFLSLSIAQQRHLINYLYCQPGQWDEVRVPEVKTTWALLQSIFRLYPLAESR

SEQ ID NO: 959 - protein, 504 aa, Schizosaccharomyces pombe
MSSDNLDISMEKKYSADVDVEKAPTPEYGEVETAPLSQSSWIYRRPRIGRFKSLAYGSALTQTIIVSWVCFLCPGMFNALSGLGGGGEVNADVANDANVALYSTFAGLGFFAGSICNLIGVKLTLAIGGTGYSVYTASLLCYKHVYNRGFVIFGGCYLGLTAGMLWAAQGAVIMSYPREENKARYIAIFWGIFNLGAVIGSIVPLAQTMHSSVNSVGDGTYAGFIVLMAVGSALALFMVSPEKTVKEDGKFVHIEKSMGWKKELLGLVQTLYKEYWVLLLFPMFFSSNWFTTYQFNDFNLAYFNIRTRSLNNLLYWFAQIMGSAVAALFLDWQRFNRVIRARVGWGLVFVLICVIWGGGLAFQLKYTRKSVAESDFVVTDFTHRGYTGYAFLYIFYGMLDAIFQSYAYWIIGSLSNDTNKLAVYMGFYKSLQSAGAAITYRMDTLNIPYMNYFASCWALLCGSLIVASPVIWKKIKLTTEGIEDEIPPLANGLAVDGPVVPLKE

SEQ ID NO: 960 - protein, 382 aa, Escherichia coli O157:H7 EDL933
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESDQSAAICEELANFDYLYLSGISLAILSPTSREKLLSLLRECRANGGKVIFDNNYRPRLWASKEETQQVYQQMLECTDIAFLTLDDEBALWGQQPVEDVIARTHNAGVKEVVVKRGADSCLVSIAGEGLVDVPAVKLPKEKVIDTTAAGDSFSAGYLAVRLTGGSAENAAKRGHLTASTVIQYRGAIIPREAMPA

SEQ ID NO: 961 - protein, 346 aa, Vibrio parahaemolyticus RIMD 2210633
MEKLARKQVQELTPYLSARRIGGTGDVWLNANESPFNNEYKTDFARLNRYSECQPKALISAYAAYAGVKPEQTLTSRGADEGIELLVRAFCEPGQDAILYCPPTYGMYAISAETIGVERKTVPLTSDWQLDLAGIESNLDNVKLVFVCSPNNPTGNLVKREDIVSLLEMTKDRAIVVMDEAYIDFCPEASTVDLLAQYPNLAILRTLSKAFALAGLRCGFTLANEELINVLLKVIAPYPVPVPVAEIAVQALSEAGLARAKFQVLDLNANRAYLQVGLSMIPGLQVFEGWGNYLLVKFPDGDALFKAAWDTGIILRNSPIENCVRISVGNRDECEKTLGFIRNYYS

SEQ ID NO: 962 - protein, 468 aa, Chorda filum
IPYAKMGYWDADYNVKDTDILALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPYAYLKTFQGPATGVIVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQPLYYLGDDVVLQFGGGTIGHPDGIQSGATANRVALESMVLARNEGRDYFGEGPEILRNAASTCGPLKAALDLWKDITFDYTSTDTPDFVEQATESK

SEQ ID NO: 963 - protein, 525 aa, Cicer arietinum
MAVSATGQIMLSSTVQLREPTIMGSTRNLRFVKFCNGEIMGRKIELKAGGAISNCCTKNVIRQNISMSLTADVAAESKLRNVDLEKRDPSTVVAIILGGGAGTRLFPLTKRRAKPAVPIGGAYRLIDVPMSNCINSGINKVYILTQFNSASLNRHIARAYNSGTGVTFGDGYVEVLAATQTPGEQGKKWFQGTADAVRQFHWLFEDARSKDIEDVLILSGDHLYRMDYMDFVQNHRESGADITLSCLPMDDSRASDFGLMKIDNKGRVLSFSEKPKGEDLKAMQVDTTVLGLSKDEALEKPYIASMGVYVFKKEILLNLLRWRFPTANDFGSEIIPASAREFYMKAYLFNDYWEDIGTIRSFFEANLALTEHPSKFSFYDAAKPMYTSRRNLPPSKIDNSKIVDSIVSHGSFLNNSFIEHSVVGIRSRINSNVHLKDTVMLGADFYETEAEVAALLAEGRVPIGIGENTKIKDCIIDKNARIGKNVIIANSEGIQEADRSAEGFYIRSGVTVVLKNSTIEDGLVI

SEQ ID NO: 964 - protein, 538 aa, Prunus cerasus
MADRRAEYNAVVSGQPQKNIADFDPPGKPKRNKYAFACAILASMTSILLGYDIGVMSGAVIYIKKDLKVSDVEIEVLVGILNLYSLIGSAAAGRTSDWIGRRYTIVLAGAIFFAGALLMGFAPNYAFLMFGRFVAGIGVGYALMIAPVYTAEVSPASSRGFLTSFPEVFINAGILFGYVSNYGFSKLPTHLGWRLMLGVGAIPSIFLAIGVLAMPESPRWLVMQGRLGDARKVLDKTSDSLEESKLRLGEIKEAAGIPEHCNDDIVEVKKRSQGQEVWKQLLLRPTPAVRHILMCAVGLHFFQQASGIDAVVLYSPRIFEKAGITNPDHVLLCTVAVGFVKTVFILVATFMLDRIGRRPLLLTSVAGMVFTLACLGLGLTIIDHSGEKIMWAIALSLTMVLAYVAFFSIGMGPITWVYSSEIFPLQLRAQGCSIGVAVNRVVSGVLSMTFISLYKAITIGGAFFLFAAIAAVGWTFFFTMLPETQGRTLEDMEVLFGKFYRWRKANALLKQKKQVDHGDGNNNPNNPQIQLGTKGQAN

SEQ ID NO: 965 - protein, 225 aa, Halobacterium sp. NRC-1
MTIPSFAIGIAGGTGAGKTTVAREITDNVGESATLIPLDNYYEDLSDRPFEERANANYDHPSAFEWELLRTHIDALLSGQSIEMPQYDFERHVRKADRVVVEPTDVIVLEGILALSDETVNDMLDLHIYVETDADVRILRRIERDVVERGRELEGVMDQYLSTVKPMHEQFIEPTKRHADIIIPEGANSVAVNLLEEKVQAETSEMTAWAARDDTAFEDATYNPQ

SEQ ID NO: 966 - protein, 334 aa, Bacteroides thetaiotaomicron VPI-5482
MVNYKDLGLVNTRDMFAKAIKGGYAIPAFNFNNMEQMQAIIKAAVETKSPVILQVSKGARQYANATLLRYMAQGAVEYAKELGCAHPEIVLHLDHGDTFETCKSCIDSGFSSVMIDGSHLPYEENVALTKKVVEYAHQFDVTVEGELGVLAGVEDEVSSDHHTYTDPEEVIDFATRTGCDSLAISIGTSHGAYKFTPEQCHIDPATGRMVPPPLAFEVLDAVMEKLPGFPIVLHGSSSVPEEEVETINKFGGALKAAIGIPEEELRKAAKSAVCKINIDSDSRLAMTAAIRKTFAEKPAEFDPRKYLGPARDNMEKLYKHKILNVLGSDNKLAE

SEQ ID NO: 967 - protein, 427 aa, Nostoc punctiforme
MGRSTYQSNKNIGFHRRLKATIVVLLVWGGVSLLHWLPETQWLMLGLTAILTVQTLRMLVAKPDAAVMESKIYLPPVLILVPAKNESSVLANLVDSLYQLNYPSNSLDIWIVDDGSTDETPEILRELQTQFPSLQVHRRESKGGKSGALNAVFPFTQGEIILVCDADAQLPVNFLQQTVPLFQKQAIGAVQVRKTISNANTNFLTRCQQMEMCCDSFLQTHRIAIGGMSELRGNGMLVRRELLEKCQGWNENTVTDDLDLCFKLYLAGAEIEFVTVPSIQEESVTSWEKLWHQRCRWAEGGYQRYLDYFPQILTLGWAKEIDLLLFFLLQFLLPIGLIPDLLWTIFYSHHPVLFPLQTLLSIILTIAFIAGLYQFQNLRGWSLLWATIQGSFYMVHWIPVMIVTTLKMCVQKERSHWVKTEHHGRMD

SEQ ID NO: 968 - protein, 625 aa, Rhizobium sp. NGR234
MSSTIRLTAAQATIKYLQKQYSVFDGKRERLIGGIFGIFGHGNVASISQAIEEYGEELPYYQPKNEQAMVHAAMGYAKMKNRRATLACTASIGPGSTNMITGAATATVNRIPVLLFASDTFAHRRTGNVLQQLEHPVDGDLTVNDCFRPISRFFDRISRPEQILTALPEAMRVLTDPADTGAVTISFPQDVEGEAYDYPVEFFRERNWVIRRRDPSQDDVNEAIAALSQAHAPLIIAGGGVRYSAAERALRDFANQFGIPVAETHAGKGVSLDTPLCLGGMGVTGTGAAGRIAERADVVVAIGTRLQDFQTGSRSAFHAPNVTFVSINTNSYDAHKLRGVPVVGDARLSIERIAAGLREAGYSTASTYRDEIKSRQREWKEAYRNDIAVPPGGELNQGTIVRIVNESTRAGDVVIAAAGTPPGEIHKAWDNSNGSKAFLEFGFSTMGHEIPAAIGARLANRSDEEIFVIIGDGTYLMGPTEIVTAVQENAKITVVVIENYGYQCIRDLQENSTGIDNLGNEFRARDNDVLRPNGSYLEVDYAANARSMGAAVLSASDEEQFKDALAKARDVRGPTVIVVKAEKRGRSIGSGVWWDVGASEVTNTKSVSDATTKFRAGERNQRYLG

SEQ ID NO: 969 - protein, 106 aa, Methanosarcina barkeri
LVGSLGLVPSANIGEKYAFFEPVHGSAPDIAGKGIANPLAAILCVKMLLEWMGEPRSQIIDEAIAYVLQKKIITPDLGGTASTMEVGNAVAEYVLSNIQDRRSPPW

SEQ ID NO: 970 - protein, 355 aa, GIBBERELLA ZEAE PH-1
MGACMSSSNEEVDQKKKSQAIDKILEEDSKRLRKECKILLLGSGESGKSTIVKQMKIIHLKGYSEDELFNYRPTVFKNLVECAKAVIMAMQQFDIEPQNEENKAHAEFLLEYQAESGPQAHIDAKVGAAVQALWNDPAKDLLMEHQTEFYLMDSAEYFFQEAMRIVATDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLSRSPLGNYFPDYSGGNDVNKAAKYLLWRFNQVNRAHLNLYPHLTQATDTSNIRLVFAAVKETILNNALKDSGIL

SEQ ID NO: 971 - protein, 488 aa, Vaucheria bursata
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRACAATGEVKGSYLNTTAGTIEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNTLLDTKLEINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVETATQSK

SEQ ID NO: 972 - protein, 393 aa, Zea mays
  unsure (1)..(393): unsure at all Xaa locations
MADQANQPTVLHKLGGQFHLRSIISEGVRARNICPSVSSYERRFATRNYMTQSLLGPSMSVSGGINVPVMRTPLCANAPAEKGGKNFMIDFMMGGVSAAVSKTAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKXEGPKSLFKGAGANILRAIAGAGVLSGYDQLQILFFGKKYGFRRCLNGEI

SEQ ID NO: 973 - protein, 513 aa, Yarrowia lipolytica
MIIIETLIGAVVFVAVYVAFVKLDYYRRKAKFETSDMPVAYNGLLGWKGLRHMLTVFNNDIGPVGWREVFATYGKTLKYYAFPSNTILTYDPDNIKAMLATQFKDFSLGLRKEALAPSLGYGIFTLDGSSWSHSRALLRPQFSREQISRLESVETHVQEMMSCIDRNQGAYFDIQRLFFSLAMDTATDFLLGEAVGNLQEILHPEMPRTGTTFQVAFDRAQRLGSLRIICQEAFWVVGSLFWRRDFNNTNQHIHDYVDRYVDKALLARKEKSEIYTNPDKYIFLYELARETTNKITLRDQVLNILIAGRDTTASTLSWIFMELAKKPDIFHKLREAILNDFGTSCESISFESLKKCDYLRQVLNEGLRLHPVVPVNLRVAVRDTTLPRGGGPQGDKPIFVAKGQKINYAIFWTHRDKEYWGEDAEEFRPERWETTSGGALGKGWEFLPFNGGPRICLGQQFALTEMGYVITRLLQEYSDISIQPSDAAVKVRHSLTMCSAQGINISLTRAKEE

SEQ ID NO: 974 - protein, 292 aa, Bacillus subtilis subsp. subtilis str. 168
MVKVMLGIISVTLIWGYTWVAMKVGIHDIPPLLFSGLRLFIGAVPLFLILFIQRKKLSIQKEHLKSYIIMSLLMGLGYMGILTYGMQFVDSGKTSVLVYTMPIFVTVISHFSLNEKMNVYKTMGLVCGLFGLLFIFGKEMLNIDQSALFGELCVLVAALSWGIANVFSKLQFKHIDIIHMNAWHLMMGAVMLLVFSFIFEAVPSAEWTYQAVWSLLFNGLLSTGFTFVVWFWVLNQIQASKASMALMFVPVLALFFGWLQLHEQITINIILGALLICCGIFMNTFTFSRRKV

SEQ ID NO: 975 - protein, 443 aa, Synechocystis sp. WH 8501
MNLPPTLSQPRLLRLFKLIFYPLDYLEDNYQRYGDIFVAGKSETPFVYISNPQGIQTILTRDKTDFKTGGGSGFLSTLLGDNSLLFLQGERHRRERKLLMPPFHGERLKSYANLIYSISDKVTDKLQINRSFNVRDIMQEITLKVILKAVFGITEGERYQRLQELLKSWLSFFDSPANAILIFFPWLRKNWGNWTPWGRFLQIKAEIQELIYTEIRERREQKKYEGTDILTLLMLAKDEEGKPLSDQELHDELITLLIAGHETTASALTWALYWIHFCPDVEDKLRFHFSNLNNNTDLLDIVKLPYLDAVCKETLRIYPVLLTTFIRVLQTPLELMGYQFKPGTVFAPAIYLVHHREDIYPNSQQFRPERFLERNFSPYEYFPFGGGSRRCIGMELAKMEMKIVLYTILSKHKLKLPSSRPLKAVRRGLTVAPPSNFKMILSN

SEQ ID NO: 976 - protein, 318 aa, Shewanella oneidensis MR-1
MANTLEQLKSYTTIVADTGDIEAIKRYQPEDATTNPSLILKAAQIPEYSALIDNAIAWAKLQSTDIEQQIDDASDKLAVNIGVEILKLVPGRISTEVDARLSFDKEKSIAKAHKLVRLYQEAGVDKSRILIKLASTWEGICAAKELEQEGINCNLTLLFSFSQARACAEAGVYLISPFVGRILDWYKKDTGKDYDAVNDPGVVSVTEIYNYYKQHGYNTVVMGASFRNIGEIIELAGCDRLTIGPSLLEELANSQLAIQPKLVPTSTTVAVAEPLTEAQFRWEFNQDAMAVDKLAEGIRNFAIDQGKLEVMLKAKLAN

SEQ ID NO: 977 - protein, 561 aa, Citrobacter freundii
MASSGTTSEKMRFTGAQLVIHLLERPGDYDRCRHPGSCSILPIYDALSQSTQIRHVLARHEQGAGFIAQGMARTEGKPAVCMACSGPGATNLITAIADARLDSIPLVCITGQVPASMIGTDAFQEVDTYGISIPITKHNYLVRDIAELPQVMSDAFRIAQSGRPGPVWIDIPKDVQTATIELEVLPEPGARTAPPTFDSASVHDAAAMINAAKRPVLYLGGGVINAPEQVRSLAEKANLPTTMTLMALGMLPKAHAVAGMLGMHGARSTNFILQEADLLIVLGARFDDRAIGKTEQFCPNAKIIHVDIDRSELGKIKQPHVAIQGDVADVLAHDAAGRRQSRDEWRQLVADLQREFPSPIPQESDPLTHYGLINAVAACVNDEAIVTTDVGQHQMWVAQAYPLNRPRQWLTSGGLGTMGFGLPAAVGAALANPQRKVICFSGDGSLMMNIQEMATAAENQLDVKIILMNNEALGLVYQQQSLFYQQGVFAATYPGMINFMQIAAGFGLQTCDLNHEADPQAALQAIIDRPGPALIHVRIDAEEKVYPMVPPGAANTEMVGE

SEQ ID NO: 978 - protein, 632 aa, Nostoc sp. PCC 7120
MLNSIYSREVYDIFNQAKCNALNKATKSVQVGDEVKEIPSPFPSPADWRDLWIYFIMTDRFNNPSAPPTMSWNAFDGNDFLGKKALGFQGGTFEGIRQQLGYLEKLGVGAIWITPPFKNCQYEPTYHGYGIQDFLQIDPRFASNKDNPEAELQALIDEAHARGIYVIFDIVLNHTGNVFSYFIEGKNVKSTETDRDLPLLPYDIKWHNKTGEPQWINAPDDQDPDLHPNAAVWPRELCKNEYFRRRGTRKGDTGEGGDFTDLRELLTEKEEVRNILIRIHQYLIAKFDIDGFRIDTLRFIEPEFARIFGNSMHEFALSIGKKNFFSFGEVWADEDKTEKKISQFIGRKATEPGDLLGIDAALDFPLFFKLRYVLKGLQPIKELAEVYEKRKESLRGIISSHGEVSKFLVTFLDNHDWKRRFYYSNPANPQKFDDQLTLGITCLFALQGIPCIYYGTEQGLNGYLTENRDFGDLVVREALWGKPGGGFKQDHPFYKTIAKLSEYRNSHPALRYGRQYFRPISGDRINYAISPYPSGVLAFSRILNETEVVVVANTNTEFTQSVYVIVDDNLHSENPTFKILFSNKSRDNSIQPEKVEEHHGVNITEVNGHKNYGPVRVMKVTLQPMEVQILVK

SEQ ID NO: 979 - protein, 341 aa, Daucus carota
APSMTTPEPASKRRVVLGEISNNSSAVSGNEDLLCREFEVPKCVAQKKRKRGVKEDVGVDFGEKFDDPQMCSAYVSDVYEYLKQMEMETKRRPMMNYIEQVQKDVTSNMRGVLVDWLVEVSLEYKLLPETLYLAISYVDRYLSVNVLNRQKLQLLGVSSFLIASKYEEIKPKNVADFVDITDNTYSQQEVVKMEADLLKTLKFEMGSPTVKTFLGFIRAVQENPDVPKLKFEFLANYLAELSLLDYGCLEFVPSLIAASVTFLARFTIRPNVNPWSIALQKCSGYKSKDLKECVLLLHDLQMGRRGGSLSAVRDKYKKHKFKCVSTLSPAPEIPESIFNDV

SEQ ID NO: 980 - protein, 420 aa, Actinobacillus pleuropneumoniae serovar 1 str. 4074
MELIQQYGNLLVIITALFGFFMAFGIGANDVSNAMGTSVGSGTVTARQAIVIAMVFEFAGAYLAGGEVTETIKSGIIDVSLFADKPDILVLGMMSALFAAGFWLLVASKMGWPVSTTHAIIGAIIGFGCLTVGSEAVQWKQLGGIVGSWFITPVIAGFVAYWIFISTQKLIFDTDEPMKNAQKYGPFYMALTAFILSIVTMTKGLKHVGLHLTTTETVLISSAIAAVAVVTCYFYFRSEAFAKRAQGAAFGGVEKVFSILMLLTACSMAFAHGSNDVANAVGPLSAVVSIVHSGGVVEGKAALASWILPLGAAGIAAGMLIMGYKVMGTMGTGITDLTPSRGFSAEFACATTVVIASGTGLPISTTQTIVGAILGVGFARGIAALNLGIIRNIVASWVVTLPAGAIIAIVIYEILLMIFY

SEQ ID NO: 981 - protein, 363 aa, Triticum aestivum
MGLAENHLSLDLVREWMEEHAGPAMTPARGDEERDLTISGLATYQPYDGILALKMALAGFMRQIMHESVSFDPSQMVITSGATPAMEILSSCIADPGNAFLVPSPYYPGWDRDIKWRTGIELIPVPCRSTDNFNISITALEIAYNQAKKRGVRVRGVLISNPSNPTGSFVPKQTLRDLLDFATEKNIHLISDEVFAGSTFGSGEFVSVAEVVNELEDFDRGRVHIIYGLSKDLSLAGFRVGVIYSYNESIVEAAAKIARFSSVSTPTQRLLVAMLSDQKFISNYLKVNRERLRKAYNLLVDALKQVGIECFKSSGGFYCWADMSKFIRSYSEKGERRLWDRLLEEAKVNVTPGSSCHCIEPGW

SEQ ID NO: 982 - protein, 158 aa, Triticum aestivum
MGEERMTAKPEAVELPGFVMSADEAERAAAAAGVETVEDLLPLLIPSAMRRARPPISRFPVGAVGLGESGRVYAGVNLEFLGAPLSQVVHAEQFLIANAAAAGEPALRAIAVSHMPCGHCRQFLQEIRGAAGIRILVTSDAADGCAAEWRSLASPSCR

SEQ ID NO: 983 - protein, 244 aa, Silene latifolia
MGRGRVELKRIENKINRQVTFAKRRNGLLKKAYELSVLCDAEVALIIFSNRGKLYEFCSSPSMLKTLERYQKSNYGPPDNTAVSSREALEISSHQEYIRLKARYEALQRTHRNLMGEDLGPLSSKELESLERQLDMSLKHIRSTRTQYMLDQLADLQRKEHVLNEANITLKQRLIEADQVSSAQCYGHELDYGRQNPQAQADHVFFHPLECEPTLQIGYQPEQMNVTAAGPSINNFMTGWLPQN

SEQ ID NO: 984 - protein, 250 aa, Zea mays
MSRRYDSRTTIFSPEGRLYQVEYAMEAIGNAGSALGILAADGVVLVGEKKVTSKLLQTSRSAEKMYKIDSHLACAVAGIMSDANILINTARLHAQRYALSYQEPIPVEQLVQSLCDTKQGYTQFGGLRPFGVSFLFAGWDKHHGFQLYMSDPSGNYGGWKAAAVGANSQAAQSMLKQDYKDALTREEAVGLALKVLSKTMDSTSLTAEKLELAEVFLQPDTGEVQYQVCSPEALGKLLAKSGLTQPTPEA

SEQ ID NO: 985 - protein, 531 aa, Corynebacterium glutamicum ATCC 13032
MKVMAQIAMIMNLDKCIGCHTCSVTCKQAWTNRQGTEYIWFNNVETRPGVGYPRGWEDQDKWEGGWVRTNSGKLKPKAGGRLKKLATIFHNPKLPTIDDYYEPWTYEYDKLLSAPAGQKTQPTARPVSQLDGRPIDKIEWSSNWDDNLGGSTTTLDQDPVLEKMNLTVQKEIEDSFMFYLPRICEHCLNPTCVSSCPSGAMYKRAEDGIVLVDQDQCRGWRMCVSGCPYKKVYFNHKSGKAEKCTLCYPRLEVGQPTVCSETCVGRLRYLGVLLYDADRVAEVAATPDEKDLFEAQKTLFLDPHDPQVIADAQRNGIPHSWLEAAQNSPIYDLIFKYEVALPLHPEYRTLPMVWYIPPLSPIVDEVTASGNDGEDHKILLTALSTMRIPLEYLAGLFTAGDTRPVEKSLRRLAAMRSYMRDISLGREPQEEIAEAVGMTGKVVQEMYRILAIAKYDDRYVIPTASPETPRGISSLDPFGDVDPARATEQLNIGLGEGAPEACGTGAPSGKVSLTSWNVGERPAAMFPPRKD

SEQ ID NO: 986 - protein, 559 aa, Zymomonas mobilis
MSYTVGTYLAALVQIGLKHHFAVAGDYNLVLLDNLLLNKNMEQVYCCNELNCGFSAEGYARAKADAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFQKKTALHRYLMGEVSYPGVEKTMKEADAVIALAPVFNDYSTTGWTDIPDPKKLVLAEPRSVVVNGVRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAARQQP

SEQ ID NO: 987 - protein, 484 aa, Zea mays
  unsure (1)..(484): unsure at all Xaa locations
MRINVCGCRGSTVHLHHLSSSSSPPPLPFHLLPPGDSSSSLPRRSIGPPIDRARGRRFQSGVVSIRSGSLPVWVGAMAAMDASADKNAVFRKLRAKSDNKMCFDCNAKNPTWASVTYGVFLCIDCSAAHRSLGVHVSFVRSTNLDSWTPEQLKMMVYGGNNRAQAFFKQHGWTDGGKIEAKYTSRAADLYRQLLAKDVAKSSTEDGNNSWPSSPVAASQAPNQAAAFPDLKLTEVSKENVSEKKDSEIVRSPRAPTHSFKKPIXVLKKPGNKTGGLGARKLTSKPNESLYEQKPEEPAPVLPSSVIESTTTRSKSHTSRFDYVENAPALKNGNSSEGNHMSGHVAPPMSSNFFAEFGMDSGYQKKSTSSSSKVQIEESREARQKFSKAKSISSSQFFGDQASFEKDAQVSLQKFSGSSAISSADLFGHPANNSSVDLSASDLINRISFQATQDLSSLKNMAGETGKKLTSMASNIITDLQDRIL

SEQ ID NO: 988 - protein, 177 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPG

SEQ ID NO: 989 - protein, 268 aa, Glycine max
  unsure (1)..(268): unsure at all Xaa locations
MEGSVIERLDFGKMGYGCNHYRRRCEDGPSLHDEIYSCRHCHNEATSLLNNPFDSPRARPLAKMFNKLFVVCDTEQPVAQVCTNCXVKMGEYFCTICKFFDDDVGKKQFHCDDCGICRIGGRENFFHCNKCXSCYSNSLRDNHLCVENSMRHHCPICYEYLFDSLKDITVMKCGHTMHSECYLEMLKRDKYCCPICSKSVMDMSRAWKRIDEEIEATVMPRXYRYRKVWILCNDCNDTTEVYFHILGQKCGHCSSYNTRAIAPPVLSQ

SEQ ID NO: 990 - protein, 373 aa, Phaseolus vulgaris
SGVVKSTTEFPNKFFYCFWWGLRSLSSLGQDLKTSTYVPEIAFAIFISIFGLVLFSSLIGNMQEYLQSTTVRVEEMRVKRQDAEQWMSHRMLPENLKRRIRHYEQYQWQENRGVEEEALIRNLPKDLRRDIKRHLCLALVKKVPLFKEMDEQLLDAICTRLKPVLYTEKSHIFREGDPVDEMLFIMRGQVSTVTTNGGRTGFFNSSFLVAGQFCGEELLTWALDPNSSSNLPISTRTVETVSEVEAFALMADDFKIVASQFRRLSSKQLQHAFRFYSLQFRTWGACFIQAAWRRYWKRKIERSLHVKEDKLQDALTNDDGSTLSLGATIYASRFAANALRNLRENNRQNRTQQRLLPLLPPKPAEPDFTSLKH

SEQ ID NO: 991 - protein, 309 aa, Prochlorococcus marinus subsp. pastoris str. CCMP1378
MTATTFRNKNSNWTISDIPNLDGKTAFITGANSGLGYYTAKALAEKNAHVLLACRSLEKANSAIDKLKSLNPKGKFTPVELDLSDLNNVSEIGLKISSEFENLDLLINNAGIMHPPKTLSKQGFEIQFAVNHLAHMLLTLKFLPLIEKKENSRIVTVTSGAQFFGKVGWNNLKAENYYNKWESYATSKLANVMFALELNEKIKQKNILSLAAHPGIAKTNLFSAQKPKPSPIETFSLELFSPIFQSAEMGALPQLLAATSPMAKGGDHYGPKFNFRGHPKLSPTSPFALNKKERKNLWEKSLEILNSFL

SEQ ID NO: 992 - protein, 111 aa, Glycine max
  unsure (1)..(111): unsure at all Xaa locations
MASSMISSPTVTTANRPGAGLVVQLIGLNSLVXFPTLKTHHDITFIASNGGRVQCMPVWPPVGKKKFETLSYLPDLDDAQLAKEVEYLLMKGWIPCLEFELEHSFLYREHN

SEQ ID NO: 993 - protein, 586 aa, Eremothecium gossypii
MVSGLSKKKTTAKQLSKLTINTMSEITLGRYLFERLRQIEVQTIFGLPGDFNLSLLDKIYEVEGMRWAGNANELNAAYAADGYARLKGMSCLITTFGVGELSALNGIAGSYAEHVGVLHVVGVPSISAQAKQLLLHHTLGNGDFTVFHRMSANISGTTAMISDITSAPAEIDRCIRTCYITQRPVYLGLPANMVDLKVPASLLETPIDLNLKPNDPEAEAEVVETVLEMIAAAKNPVILSDACASRHDVKAETMKLIDVTQFPAFVTPMGKGSIYEQHPRFGGVYVGTLSSPEVKEAVESADLVLSVGALLSDFNTGSFSYSYKTKNVVEFHSDHIKIRNATFPGVQMKYVLRKLVDNVAEVIKSYVPVPVPSKPANNEEIDSATPLKQEWLWNQVGKFLREGDVVITETGTSAFGINQTHFPNNTYGISQVLWGSIGFTTGACLGAAFAAEELDPNRRVILFIGDGSLQLTVQEISTMVRWGLKPYLFVLNNDGYTIERLIHGETAQYNDIQPWQHLNLLPTFGAKDYEAVRVSTTGEWDALTQDKAFNENSKIRMIEVMLPVMDAPSNLVKQAELTAATNAKQE

SEQ ID NO: 994 - protein, 340 aa, Zea mays
  unsure (1)..(340): unsure at all Xaa locations
QVLAATQMPEEPAGWFXGYSHKSIDNIVILSGDQLYRMNYMELVQKHVEDDADITISCAPVDTSPFLENRLVKIDHTGRVLQFFEKPKGADLNSMRVETNFLSYAIDDAQKYPYLASMGIFLEDINAXDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 995 - protein, 728 aa, Ajellomyces capsulatus
MRSLKLILASASVVSATCPYMSGEMPNSQNGPLDRRHDTLSDPTDQFLSKFYIDDEQSVLTTDVGGPIEDQHSLKAGNRGPTLLEDFIFRQKIQHFDHERVPERAVHARGAGAHGVFTSYNNWSNITAASFLNAAGKQTPVFVRFSTVAGSRGSVDSARDIHGFATRLYTDEGNFDIVGNNVPVFFIQDAIQFPDLIHAVKPQPDSEIPQAATAHDTAWDFFSQQPSSLHALFWAMSGHGIPRSMRHVDGWGVHTFRLVTDEGNSTLVKFRWKTLQGRAGLVWEEAQALGGKNPDFHRQDLWDAIESGRYPEWELGFQLVNEADQSKFDFDLLDPTKIIPEELVPFTPIGKMVLNRNPKNYFAETEQIMFQPGHVVRGIDFTDDPLLQGRLYSYLDTQLNRHGGPNFEQLPINRPRIPFHNNNRDGAGQMFIPLNTAAYTPNSMSNGFPQQANRTHNRGFFTAPGRMVNGPLVRELSPSFNDVWSQPRLFYNSLTVFEKQFLVNAMRFENSHVRSETVRKNVIIQLNRVDNDLARRVALAIGVEPPSPDPTFYHNKTTVPIGTFGTNLLRLDGLKIALLTRDDGSFTIAEQLRAAFNSANNKVDIVLVGSSLDPQRGVNMTYSGADGSIFDAVIVVGGLLTSASTQYPRGRPLRIITDAYAYGKPVGAVGDGSNEALRDVLMAAGGDASNGLDQPGVYISNDVSEAYVRSVLDGLTAYRFLNRFPLDR

SEQ ID NO: 996 - protein, 352 aa, Bradyrhizobium japonicum USDA 110
MALMRRQSLVKFDAPLCETIVDTPKPKGAEVLVRIERCGLCHSDLHIQDGYADLGGGKKLDTTRGMTLPFTLGHEIAGVVDEVGPDVPGGLVGSKKAVFPWIGCGQCRDCANGDENLCVKQRFLGVSIDGGFATHVLVPDAKYLLDYDPLPVNQAATLMCSGVTAYGALKRLVDRPRQRNLLLIGLGGVGMMGLSFAQATFKQPITVADLSPAARDTALKNGAANAYDPAEPDVIKRILKETEGGFDEIVDFAGNEKSMAFAVAVAARGGKIVVSGLMGGQFTLPMVQWVYKRMTIEGFMVGTLAEAKELMALARAGKIKPTPMREEPMGDVQKWIDELRAGKVVGRIVLKN

SEQ ID NO: 997 - protein, 243 aa, Zea mays subsp. parviglumis
SIRNNPVQNKLMNSEDPINNNHAQTAGSLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDYLKRVIEMSSSVPTSMPISAPTPSSDAPVPPPPIRDSIVGYFSATAADDDASVGNGFLRLQAHQEPASMVVGGTLSATEMNRVAAATHCAGAMELIQTAMG

SEQ ID NO: 998 - protein, 367 aa, Zea mays
MGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTTPGLRGGILGLGGVGHMGVKVAKAMGHHVTVISSSSKKRAEAMDHLGADAYLVSSDAAAMGPAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 999 - protein, 191 aa, Desulfovibrio desulfuricans G20
MKPNYILLLDFAAVFSYLSFVTGSAAQSGAHTPQNTPAVSGKTWHGSTLPDKEELKAKLSPLQFAVTQHDETEPPFKNEYWDNKQPGIYVDIVSGEPLFSSTHKYDSGTGWPSFYQPLAAGHIVEKEDRGLFFTRTEVRGRLADSHLGHVFSDGPPPTGLRYCINSAALRFIPADALDKECYGELLYLFDQ

SEQ ID NO: 1000 - protein, 514 aa, Staphylococcus aureus subsp. aureus MW2
MVVEFKNEPGYDFSVQENVDMFKKALKDVEKELGQDIPLVINGEKIFKDDKIKSINPADTSQVIANASKATKQDVEDAFKAADEAYKSWKTWSANDRAELMLRVSAIIRRRKAEIAAIMVYEAGKPWDEAVGDAAEGIDFIEYYARSMMDLAQGKPVLDREGEHNKYFYKSIGTGVTIPPWNFPFAIMAGTTLAPVVAGNTVLLKPAEDTPYIAYKLMEILEEAGLPKGVVNFVPGDPKEIGDYLVDHKDTHFVTFTGSRATGTRIYERSAVVQEGQNFLKRVIAEMGGKDAIVVDENIDTDMAAEAIVTSAFGFSGQKCSACSRAIVHKDVYDEVLEKSIKLTKELTLGNTVDNTYMGPVINKKQFDKIKNYIEIGKEEGKLEQGGGTDDSKGYFVEPTIISGLKSKDRIMQEEIFGPVVGFVKVNDFDEAIEVANDTDYGLTGAVITNNREHWIKAVNEFDVGNLYLNRGCTSAVVGYHPFGGFKMSGTDAKTGSPDYLLHFLEQKVVSEMF

SEQ ID NO: 1001 - protein, 523 aa, Zea mays
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPANNNHKG

SEQ ID NO: 1002 - protein, 718 aa, Oryza sativa
MSDQERDDIPMLLRNVELPTFPPRSTSMCIPVRDDEYEEDTFVPHTGPLFVQPPTQTAAAGIPFTNTPDMPPRPPQGKQVNKPHAIMPEEIGGNRWSYSGNVPKNEHLMMSGPLGQCDDPDCVNCPPACKNKRHFHRGSSTLDSKFHNFLCEHGGGWKKEIERFLSRIPVMNPHAKVVQQWNQFFVISCLVAIFIDPLFFFLLSVQKDNKCIVLNWHFATALAVVRSVTDAIYFLHMLLQFRLAYVAPESRVVGAGDLVDEPKKIAVRYLRGYFLLDFFVVLPLPQVMILLVIPKYVGLSTANYAKNLLRITVLLQYVPRIIRFVPLLGGQSDSSANGFIFESAWANFVINLLMFVLAGHVVGSCWYLFGLQRVNQCLRNACSASKIPSCDGFIDCGRGINIGKQNQLSRQQWFNDSASTACFDTGDNGFHYGIYEQAVLLTTEDNAVKRYIYSLFWGFQQISTLAGNLVPSYFAWEVLFTMAIIGLGLLLFALLIGNMQNFLQALGRRRLEMQLRRRDVEQWMSHRRLPEDLRRRVRRAERFTWAATQGVNEEELLSNLPEDIQRDIRRHFFRFLNKVRLFTLMDWPILDAICDKLRQNLYISGSDILYQGGPVEKMVFIVRGKLESISADGSKAPLHEGDVCGEELLTWYLEHSSANRDGGRMRFHGMRLVAIRTVMHSVVSVAEYLSSMICMTMFTNAGALLLQLHPTGLGKLLR

SEQ ID NO: 1003 - protein, 483 aa, Pseudomonas syringae pv. tomato str. DC3000
MPITPKNGTVFETDLPARLDRLPWGRFHTLLVIALGITWLLDGLEVTLAGSVAGALKASPALNLTNSDIGLAGAAYIAGAVLGALLFGWLADRLGRRKLFFITLLLYVGATAATAFSFSVWSFMLFRFLTGMGIGGEYTAINSTIQEFTPARYRGWVDLTINGTFWLGAALGAVGSIVLLDPLWVGAELGWRLCFGIGAVLGLLVLLMRLWLPESPRWLLIHGQSAQATKIVEQIEADLQRRGHVLPAVTSKPLRLHVRDHTPLGEVARTLLVTFRQRSLVGLTLLTAQAFFYNAIFFTYALVLTDFYDVPAERVGWYVLPLALGNFCGPLLLGRLFDVVGRRTMISLTYGLSGVLLAISGYLFQQGLLDVTQQAIAWMVIFFFASAAASSAYLTVAETFPLEIRALAIAVFYAFGTGLGGMIGPTLFGELIDTGERSNVFIGYLIGAGLMLLAALVQSIWGAAAERKSLEEVARPLSQAGDV

SEQ ID NO: 1004 - protein, 527 aa, Hordeum vulgare
MSSMQFSSVLPLEGKACVSPVRREGSACERLKIGDSSSIRHERASRRMCNGGAGAPPPPVRSACSPPTPARPTPLFSGRPSGGITPIRTRSRPSVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 1005 - protein, 72 aa, Glycine max
  unsure (1)..(72): unsure at all Xaa locations
PWYETTVXGXXXXXPFXGLKSMAXXPTRKTNNDITSIASNGGKSXNAWQVWPPVGQEEIEILSYLPDLMMHG

SEQ ID NO: 1006 - protein, 165 aa, Triticum timopheevii subsp. armeniacum
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 1007 - protein, 369 aa, Oryza sativa
MDHAAEAQRTDLMTITRHVLNEQGRHPESRGDFTILLSHIVLGCKFVASAVNKAGLAKLIGLAGDTNVQASNPISDPLYSTLLFLHTNPCDGGWPPRGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 1008 - protein, 496 aa, Staphylococcus epidermidis ATCC 12228
MENKNNNVDRGNLKQNLSEKFVWAIAYGSCIGWGAFILPGDWIKQSGPIASSIGIVIGALLMILIAVSYGALVEKFPVSGGAFAFSFLSFGRYVSFFSSWFLTFGYVCVVALNATAFSLLIKFLLPNVLNNGKLYTVAGWDVYITEIVIATVLLIVFMLITIRGASVSGSLQYYFCVAMVLVVALMFIGSFFSSHFSLSHLEPLASVDKGWFQSIIMIVSIAPWAYVGFDNIPQTAEEFNFSPNKTFKLIVYSLLAASLTYVVMLLYTGWLSTQATSLNGNLWLTGAVTQDAFGFIGLAVLAVAIIMGIFTGLNGFLMSSSRLLFSMGRSGIMPTVFSKLHSKHKTPYVAIIFLVAVSLIAPWLGRTALTWIVDMSSTGVSIAYFITCLSATKLFSFNKQSNTYAPVYKIFGIIGSIVSFVFLCLLLIPGSPAALSIPSYIALGIWLVIGLIFFIIRLPKLKKMNNDELSRLILNHSEDEVLEMVHEPGQSNSTNK

SEQ ID NO: 1009 - protein, 360 aa, Desulfitobacterium hafniense
MVDKMNLEEWMRPSIRTLKAYESKSIPDCVRLDANENPLPWPPGMIEQLLGSAIAFNRYPDGGAQELKEALSRYTGVPAEGILTGNGSDELIQLLMTTFGGEKGAVVIHPPTFSMYEAAARVTGTEVLEVPLLLTETSRDFRLDVEGILKAAAQPQVHMIVLCNPNNPTGTLFPREEILRIVAESGKIVIVDEAYGEFSGESVVDQIPYCPNLLVMKTFSKLFAMAALRLGYLLGQPSIIGALNRARQPFNVNSFSQKAGVIALNYGEEYAEQGRILIAELARIAEALTAFASVKVFATRANFLLFQPEDPDRVYQELIGKGFLIRTMGNLPLVGKALRLSTGLPEENERLIKALGEILK

SEQ ID NO: 1010 - protein, 274 aa, Glycine max
MSATVTLTLNLCRSSIVASCPHYNHKPNPNFNALFSFSLSLSLSHHRRIAICKKPFSSRRTWLHGHMKRDRDYELENGLALFGSDEELATQIPTQAQSLVEGSGSIRVAEFKPVPDVDYLQELLAIQQQGPRAIGFFGTRNMGFMHQELIEILSYAMVITKNHIYTSGASGTNAAVIRGALRAEKPELLTVILPQSLSKQPPESQELLSKVKNVIEKPHNDHLPLIEASRLCNMDIISHVQQVICFAFHDSRLLMETCQEAKNLRKIVTLFYLD

SEQ ID NO: 1011 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWMKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLL

SEQ ID NO: 1012 - protein, 334 aa, Streptomyces viridochromogenes
MTTEEGKPAMSAEPRAVRLYRTMRLIREFEERCLAMSLSGEIVGGIHPYIGQEAVAAGVCAALTDDDVVTSTHRGHGHVLAKGADPKRMLAELCGTTAGLNRGRGGSMHAADVSLGVYGANGIVGAGAPIAAGAAWSFQRRGDGRVAVAFFGDGALSQGVVLEAFNLAALWRLPVVFVCENNGYATSLPLDRALAGDPVERAAGFGLTARAVDGMDADAVADAAAEAVERCRRGGGPTFLDCRTYRFNGHHSFEEQVGLNYRDDAEVGEWRARDPLRTQSTRVDGATAGAIDAETSTLIDEAVEFARAGRAPDPAEALHHLYADGTTPRPGVMI

SEQ ID NO: 1013 - protein, 296 aa, Magnetospirillum magnetotacticum
MSLPRSELPIAAASRKPVSVSFEFFPPKTEKMQVSLWECVQRLAPLAPQFVSVTYGAGGTTRERTHETVVRIARETNLKPAAHLTCVGHAKGEVDDIARRYWDEGIRHIVALRGDMPDGQAYAAHPQGYAYAADLVAGLKRIADFEISVAAYPEKHPDAPSADFDLDNLKRKIDAGANRAISQYFFDPAVFLSFRERAAKAGITVPILPGILPVTNFAQVQKFSAACGASIPGWMADLFEGLDDDPETRRLVAATMAAEQCRILAAEGVEQFHFYTLNRADLAYAISHILGVRPKG

SEQ ID NO: 1014 - protein, 412 aa, Lactobacillus gasseri
MAIQLLKFMLHFLMVLLQNLKFHQVHQLVRKRLLSCVMAVNAWMEKGVMNAVNNVNTEINEALKGRSPYNQAAIDNLMIKLDGTPNKARLGANAILGVSMAVARAAAKSKNEPLYRYLGGCDLELPQTFHNVINGGKHADNGIDIQEFMITPVNKTSFRDGFEKIVNTYHTLKKVIEDAGFETGLGDEGGFASNLKSSEEALRMLQEAIKKAGYEPGKDIAIAFDAAASSFYNKEDGKYHFEGHVWDGEEMLAYYDKLLTEFPEIISAEDPFDENDWDNFEKFTAKFGDKIQVVADDNVCTNPKLVRKAIKDKLCNAVLIKVNQIGTITETLETIRLARKNNMTTMVSHRSGETGDTFIADFTVATNAAELKSGAPARSERVEKYNRLLEIEQEIGVENERLAHFPNDVDMD

SEQ ID NO: 1015 - protein, 443 aa, Thermococcus kodakaraensis
MNEIKGIERAVQVEVPRPRFLLLAFTDINGSLKGMEIPMERYEEAVEDGVSFDGSSIPGFEGIEDSDLIFKADPSTYAEIPWEGIGRVYGYIYKGDEPYQADPRGILKRVLERLEKEGLKAHIGPEPEFYIFKKNGTWELHIPDSGGYFDLVGLDKAREIRREIALYMPYLGLKPEVLHHEVGKAQHEIDFRYDEALRTADNIVSFKHVVKAVAELHGYYATFMPKPIYGFPGNGMHLHISLWKDGENVFIGEDGLSDTALHFIGGILKHAKALAALTNPTVNSYKRLVPGYEAPVYISWGYRNRSALIRVPAFKGSGARIEYRCPDPSANPYLALAGILMVGLDGIKKKVEPDSYVETNVYEMDDAERERLGIDTLPGSLGEALEELKKDKTVREALGGANKNFIDYKEREWEEYIEYLSSRDIPIDTKKVTEWELERYFYV

SEQ ID NO: 1016 - protein, 121 aa, Triticum aestivum
MGRSPCCEKAHTNKGAWTKEEDQRLIAHIKAHGEGCWRSLPKAAGLLRCGKSCRLRWINYLRPDLKRGNFTDEEDELIIKLHEFLGNKWSLIAGRLPGRTDNEIKNYWNTHVKRKLLAAAS

SEQ ID NO: 1017 - protein, 465 aa, Zea mays
  unsure (1)..(465): unsure at all Xaa locations
MAQRAGKTRIHRSRPIGRPARARGATRRGGGVAEIKRLYPGRHRPLFLKVRSRGRRPDRLPFPASGAQGQANSFEVVMADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVYRKTLKSDGIAXGLYRGFNISCVGIIVYRGLYFGLYDSIKPVVLTGSLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 1018 - protein, 322 aa, Oryza sativa (japonica cultivar-group)
MTAKGGAAPSPGGAGGLPNGRFFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVMIASGGEPSFHLFGFIMCIGATAARALKTVLQGILLSSEGEKLNSMNLLLYMAPIAVILLLPATIFMEDNVVGITIELAKKDTTIVWLLLFNSCLAYFVNLTNFLVTKHTSALTLQVLGNAKGAVAVVVSILIFRNPVSVTGMLGYTLTVIGVILYSESKKRNKP

SEQ ID NO: 1019 - protein, 991 aa, Saccharomyces cerevisiae
MADSSSTSAFISTLIIYGLTAVVFVWLFLLLRPKNRRVYEPRSLKDIQTIPEEERTEPVPEGYFGWVEYLLSKPHSFLIQHTSVDGYFLLRYIGIVGSLSFVGCLLLLPILLPVNATNGNNLQGFELLSFSNVTNKNRFYAHVFLSWIFFGLFTYVIYKELYYYVVFRHAMQTTPLYDGLLSSRTVIVTELHKSIAQEGEMQMRFPKASNVAFAYDLSDLQELCKERAKNAAKYEAALNKVLNKCVKMTRNKTQKQLDKLYNNGTKPKDDLETYVPHKKRPKHRLGKLPLCLGGKKVNTLSYSSKRIGELNEEIHEKQADWASNDRQPACFIQFETQLEAQRCYQSVEAILGKKNFGKRLIGYSPEDVNWGSMRLSSKERHSRRAVANTIMVLLIIFWAFPVAVVGIISNVNFLTDKVPFLRFINNMPTFLMGVITGLLPTIALVVLMSLVPPFIVMLGKLSGCVTRQETDLYSQAWYYAFAVIQIFLVVTATSSASSTVDSIIDRPRSAMTLLANNLPKASNFYIMYFILKGLTGPTWTILQAVNLLLSKVLGRVLDSTPRQKWNRYNTLATPRMGIVYPGIEILVCIYICYSIIAPILLFFSTVMLTLLYVAYLYNLNYVFGFSFDLKGRNYPRALFQIFVGIYLSEVCLLGLFIMAKTWGPLVLEVFWIVVTALAHIYMKRKFIPLFDAVPLSAIRHARGEPGYSYPTSDLGLQEIKDIADEMKGKYEQDNTHGILTPVTKDDLKKANLIPDNDGSSENGTPSNPFESGSERASLSGSNAESDSIKKLNDTVIKKSSTLSSSTKDNNESTFVPEGEKFRKFHYSDVEALRNKRPYDEDDHSKHGPEGAVPVNADAGVIYSDPAAVMKEPQAFPPDVLETNTWTRRILQFFNPRRSYPFDSVRMRFPLVFNTSIEYDEEYLSSAYTDPCVREKDPIVWCCKDPLGVSKQQIQEARSNGLDVRDDFTRYDEKGKVIFTYNPPDYEPEAKK

SEQ ID NO: 1020 - protein, 344 aa, Schizosaccharomyces pombe
MQNLWKNALDTLSPYISNLFDNDVVCINNERYRIQKLLGEGGFAFVYLVQNVSNEKLYALKKIKCSFGNKGIKKAMKEADYHRKFKSNYLLKSYTHQLVKEADGSEFVYILFPYFAKGSVAQVIRNCDIEGSYISEKRILVWCSCLCKALQYLHENVAGDSPKQPEVNDLIMFDEPQVPQNTSNNNLVSYIHGDIKPDNLLLHENSREIVLTDFGSICLVPIFASNNSEAIAIQDKASENCTMPFRAPELFHVKAGSTITEKADIWSFGCTLYTIMFHASPFEREVSQGGSLALAVCNAQYSFPRKHPYSTLLCEIVEACLQREPNKRPSARELLSKIDLQINQ

SEQ ID NO: 1021 - protein, 473 aa, Prochlorococcus marinus str. MIT 9313
MGKSPQDVLRQIKDEGIELIDLKFTDLHGKWQHLTVCSDLIDEEAFANGLAFDGSSIRGWKAINESDMDMVPDASTAWIDPFYRHKTLSLICSIREPRSGEPYARCPRALAQKALGYLAGTGLADTAFFGPEPEFFIFDDVRYNSGEGGCFYSVDTIEAPWNSGRIEEGGNLAYKIQLKEGYFPVPPNDTAQDIRSEMLLLMGQLGIPMEKHHHEVAGAGQHELGMKFAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSQGNRSAAVRIPLTGPNPKAKRLEFRPGDALANPYLAFSAMMMAGVDGIKNQIDPGDGFDEDLFELPEERLASIPTVPASLNGALEALNADKNYLMEGGVFTEDFIDNWIDIKYEEVQQLRQRPHPHEFTMYYDA

SEQ ID NO: 1022 - protein, 391 aa, ASPERGILLUS NIDULANS FGSC A4
MGANAKAQSWLHKLEEQGMLCAFHEEGTGSLTNQTMPVNVDVDAMDPDFIKSLPITPHDMTSNQIHVHGQISEPKNRQLLLDVAREYKDRSWVDVYTRVAVLLCKKNINLISGRVLLQILPSYAYDRDKVLSHARLYAKEFESVEITKDRFCIKIPSTGPALSVCSTLEAEGIRTLGTAVFSLPQAIAASQAGCLYISPYFNEIRANFNLSLWPNVEDPATQHTMSARLMQMLEMYRKLYKETGKTQPLIKNANFISPKEALAQGEFGVDSATVSAEVLSQLANIPYDVSVRPSGIVDIPKPQYPEHQNSVSSTPKRLQHLATTDPLAAADWDGSIASTDVDYLKHNGAELEKAIKADPIASARISDALDVFLKVEGESRELIEGVMKELA

SEQ ID NO: 1023 - protein, 246 aa, Larix gmelinii
YTYTLRNKGPEDVIVRVIYCGICHSDLVQMRNEMGMSHYPMVPGHEVVGIVTEVGSEVKKFKVGEHVGVGCIVGSCRSCGNCNQSMEQYCSKRIWTYNDVNHDGTPTQGGFASTMVVDQMFVVRIPENLPLEQAAPLLCAGVTVFSPMKHFGMTEPGKKCGILGLGGVGHMGVKIAKAFGLHVTVISSSDRKKEEALEVLHADAYLVSKDAEKMMEAAESLDYILDTIPVSHPLEPYLALLKTNGK

SEQ ID NO: 1024 - protein, 552 aa, ASPERGILLUS NIDULANS FGSC A4
MGVEETKKGLDVEATSAAPPPYVQDGHILSYEEEDFWTRNGLNFKSFQRRPAHVVELNRSMKTRHMHMIAIGGSIGLSLEYSSCWCADRSVYALGELAVMYPISGGFYTYSTRFIDPSWGFAMGWNYVFQWAIIVPLELTVAGLTIDYWQVDVSVAVWITVFLIAIIIVNIFGALGYAEEEFLSSCLKLGAIIVFMIIALVLVCGGGPSDGMYNEYWGARLWYDPGAFRNGFKGFCSVFVTAAFSFSGTELVGLAAAESKTPTKSLPGAIKQVFWRITLFYIVGLFFVGLLVRSDNERLLGSGLIDTKASPFVILAYDAGLKGYDHFMNVIILISVLSIGVSGVYGSSRTLTALAEQGYAPKFFAYVDRSGRPLWSVLITILFGVLGYVNVSSSGEEVFAWLQALSGLAALFTWGSICLAHIRFRRAWAYNGRSLDEIPFKAVGGIYGSYLGLFLIFIVLVAQFFVAVAPPGGGPDGGTYNDAKGFFKSYLALPVVLFFWICGYLWKRQGWLRTSQIDIDSGRREVDWDSINAERARVAAMPAWKRLLNIII

SEQ ID NO: 1025 - protein, 314 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGISKKGTELDQTHLGTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 1026 - protein, 721 aa, Schizosaccharomyces pombe
MEACRVRPELSKTVEQIDKSLWRLNIDSAGGETWEYVTKEEAEKRPLTIAEKYFLGFDLDLPKRPPAKTPLESAEYGYEFFRRLQLPDGHWASPYEGPMFLICGAVFAFYISQTPFPKGWAPEIIQYLINHTNDDGGWGIHTEGVSTVFGTSMNYVVLRILGMDAGHPVATRARNRLHELGGAIGCPHWGKFWLATLNCYDWDGVNPIPPELWLLPDWIPFHPGKWWCHVRLVYLPMGYMYGERLKCPKDSLIMQLRKELYVENYDSINFADHRNTISDVDLYFPHTQILDRLNWILEKYFTYLRPSWLKKLGTRRAYELIKIEDQNTDYSCIGPVNAAMNTVCVYFHEGPSSKAFQKHIQRLHDFMWVQPEGMLMRGTNGLQVWETSFTLQALVESGLYEKEAFKPDIAKALEFLDRQQIRTQYEGSGYRYNSLGAWPFSNITQGYTVSDTTSEALRAVLLVQSLPDFEKLVDIPRLRLSVDVILGMQNENLGFASYEPARTGEWMELLNPAEVFGNIMVEYSYPECTTSVILALRAFTKYDPGYRRDEIENTIENALEYVVKMQRPDGSWYGSWAICFTYAAMFATGSLASAGRYYENCPVQKKACEFLLSKQRPDGGWSESYMACVTGVYTETESSLVTQTGWALDALINAKYPDRKPIEKGIKFLMASQKSDGSWQQKSMEGIFNKNVAIAYPNYKLYFSIYTLGKFAKQYGNYLTI

SEQ ID NO: 1027 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKIQVEKALENVLK

SEQ ID NO: 1028 - protein, 299 aa, Enterococcus faecalis V583
MDIGFIGLGKMGLNMALNVHEQGWPIIGFDVTKEARATAREQGLSVVDSLSELLKALNKRKVIFLSTPAGQITNQLVAELVEQLAPEDIIVDSGNSNFHDSVANAQLAKEKGIYFIDCGTSGGIKGAREGACLMVGGAPEAVKVLTPFFEDLACEQGYLYAGKSGAGHYLKMVHNGIEYVMMQAMGEGFNLLEAAEYDFALEKVADVWNHGSIIEARLMGLAKEVFAENPTLANLEGKVAANGEAKWMIEEALRLEMPVPTTALSLFTRNESMLANHFSNKVVASLRQGFGGHEVVKSQ

SEQ ID NO: 1029 - protein, 335 aa, Borrelia burgdorferi
MKLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAPKAVGLVLPELKGKLNGTSMRVPVPTGSIVDLTVQLKKKDVTKEEINSVLRKASETPELKGILGYTEDPIVSSDIKGNSHPSIVDGLETMVLENGFAKILSWYDNEFGYSTRVVDLAQKLVK

SEQ ID NO: 1030 - protein, 387 aa, Gaeumannomyces graminis var. tritici
MLRSSAFALLAWASLSEAQFGIKHTQYGTSEPVYPSPEISGSGGWEAGLAKAKDFVAQLTPEEKANMVTGTPGPCVGNIAPVPRLNFTGLCLQDGPATLRQATYVTVFPGGVSAASSWDKDLIYKHGVLMAREFRDKGSHIILGPVIGPLGRSPYAGRNWEGFSPDSYLAGVLAEQTVKGMQSVGVQTCTKHYIGNEQEEQRNPTTVDGKGVEAISSNIDDRTMHETYLWPFYNAVRAGTTSIMCSYQRINGSYGCQNSKTLNGLLKTELGFQGFVVSDWAATHSGVASIEAGLDMNMPGPLNFFAPTLESYFGKNITTAVNNGTLSSRRVDDMIERIMTPYFALGQDKDYPPVDGSTVPIGYLQPDAWNHEFPLGPTVDVRRNHHE

SEQ ID NO: 1031 - protein, 685 aa, Zea mays
VAVTRPAERKGRTCCRRCGKSKWESKESCIVCDARYCGHCLLRAMGSMPEGRKCVTCIGQPIDEAKRSRLGKGSRILSRLLSPLEVRQILKVEKECQANQLRPEQLLVNGFPLDDEEMTDLLSCQRPPGNLKPGRYWYDKESGLWGKEGEKPDSIISTNLNFNGKLQPDASNGTAQVFINGREITKIELRILKIAKVQCPRDTHFWVYHDGGYEEEGQNNIKGKIWESPLTRFACALVSLPVPPTNFDATKDEAPYSSKTVPDYLDHKRIQKLLILGSPGAGTSTIFKQAKLLYGNRFTDEELENIKLMIQSNMFKYLGILLEGRERFEEEALAVPNHPSSVGDDPQQDESKSSSSNSCIYSINAKLKKFSDWLLDIIATGDLDTFFPAATREYAPVVDELWKDPAIQATYKRKDELHFLPDAAEYFLSRAVEVSSNEYEPSEKDVIYAEGVTQGNGLAFIDFTLDDRSPMSESFGDNHDAYPQQPVNKYQLIRVSAKGMNEGCKWVEMFEDVSMVIFSVALSDYDQLGAPASGSSRTLVNKMIQSRDLFEATIRQPCFRDTPFLLLLNKYDAFEEKIGRSPLSSCEWFGDFCPLRTHHNSQSLAQQAFYYVAIKFKDLYAASTGRKLFVWQTRARDRPTVDEAFRYVREVLRWEDERGVAGYCPDESFYSTTELSSSRLIAAAQ

SEQ ID NO: 1032 - protein, 353 aa, Escherichia coli O157:H7 EDL933
MLYTSQTTPEKDQKMSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALSGQFDLIINTVNVSLDWQPYFEALTYGGNFHTVGAVLTPLPVPAFTLIAGDRSVSGSATGTPYELRKLMRFAARSKVAPTTELFPMSKINDAIKHVRDGKARYRVVLKADF

SEQ ID NO: 1033 - protein, 284 aa, Shewanella oneidensis MR-1
MPFVIALLAPVFWGTTYALVSLYLQDMSPYWVAVWRALPAGVLLLMLRPRLPTLAWSKLSLLAFCNIGAFFTLLFIGAYRLPGAVAGTLGATLPLIFLILAWLIDKKRPGMKWLLLGLMGLGGVILLLNPSADLDPIGVLCMLSATTLIAFSSRWMQRWDVGDFLVLTAWQLLLGGLMLIPLAWLMAGPPQIPSMDVVPSLIWLATANTAVAYWAWLWSMRNLGPEIMGMVALVNPVVAVSLGVLIVGETLDMRQWAGILVILLSLLLMKLPQKLRWNPLKARG

SEQ ID NO: 1034 - protein, 390 aa, Magnetospirillum magnetotacticum
MSAPESALRPQPRPGVLAIEAYVPGKSAAPGVAKIHKLSSNETPLGPSPRAVEALQAEAATLALYPDGSATRLRTAIASRYGLDPARIVCGAGSDELLTLLALAFVGPGDEGIFCAHGFLVYRIAILTAGGTPVVAPETNLTADVDAILAAVTPRTRIVYLANPNNPTGTYLPFEEVRRLHAGLPGNVLLVLDGAYAEYVRANDYTAGLELALDAPNVVMTRTFSKIHGLAAQRIGWMVGPEAVVDALNRIRGPFNVSAGAIAAGAAAIADEAHVAAAVAHNDQWLAWLTREVEALGLSVTPSVGNFLLVHFSDAPGRTAAEADAYLTQAGVIVRRVSSYGLPHALRGDPRGEEGTGPSSGAGGFSPAHTWRRPPPCIVAPLMVPCPGPA

SEQ ID NO: 1035 - protein, 780 aa, Panax ginseng
MWKLILSQGDPGLKSVNNHIGRQFWEFDPNLGTPEERAHIDKLRQQFHNNRFRVKHSSDLLMRYQFEREKSRKLGDDDEVKSGSEGEITTSSSGVEGVKMALRRALKFYSTIQADDGHWPGDYGGPLFLLPGLVIGLYVMGVMDTILAKEHQREMCRYIYNHQNVDGGWGLHIEGCSTMLCTALNYITLRLLIRGDEEEEIRDEAANGGSLEKARRWIIDHGGATYIPSWGKFWLSILGVYEWSGNNPLPPEMWLLPYFLPLHPGRMWNHCRMVYLPMSYLYGRRFVGPINSTVLSLRRELYTHPYHQINWDLARNQCAQEDLYYPHPLIQDMLWSCLHKGVERLIMQWPLSKIRQRALTTAMQHIHYEDENTSYICLGPVNKVLNMVCCWVEDPNSMANILHLSRIKDYLWVAEDGMKMKGYNGSQLWDVGFAVQAILSTGLVDEYGSMLKKAHDFIKISQVREDSPGNLSSWNRHISKGGWPFSTPDNGWPVSDCTAEGLKAALLLSNMPFDIVGEAISPVHLYDAVNWILSLQNCTGGFASYELTRSYAWLELLNPAETFGDIVIDYQYVECTSAAIQGLKSFMRLYPGYRRKEIEACIAKATNFIESIQLPDGSWYGSWGICYTYGTWFGIKGLVAAGRTNRNCYSIRRACDFLLSKQLGSGGWGESYLSCQNKVYTSIEGNISHVANTGWAMLALIEAGQAQRDPSPLHRAAKVLMNSQMKNGVFPQQEIVGVFNKNCMISYSAYRNIFPIWALGEYLNRVLQPSRNILKTLNVV

SEQ ID NO: 1036 - protein, 520 aa, Glycine max
KWAKRKSRRRKTASWLRECVLQLGPTFIKLGQLSSTRSDLFPREFVDELAKLQDMVPAFSPKKARKFIESELGAPINILFEEFEDRPIAAASLGQVHRAILHNGEKVVIKVQRPGLKKLFDIDLKNLKLIAEYFQRSETFGGPLRDWIGIYEECTTILYQEIDYINEGKNADRFRRDFRNIKWVRVPLVYWDYTASKVLTMEYAPGIKINYVDTLASRGYDRLRISSHTMEAYLIQILRTGFFHADPHPGNLAVDVDEAIIYYDFGMMGEIKSFTRERLLELFYAVYEKDAKKVMQCLIDLGALQPTGDLSSVRRSIQFFLDNLLSQTPDQQQTLSAIGEDLFAIAQDQPFRFPSTFAFVIRAFSTLEGLGYILNPDFSFVKIAAPYAQELLDIRQKRPTGPQLVEEIRKQADDARTNSISMPYRVQRIEEFVKQLEAGDLKLRVRVLESERAARKATILQMATMYSVLGGTLLNLGVTLSSQGNQAFANGSFIGAGILGALFLRSMQRVKKLDKFENMI

SEQ ID NO: 1037 - protein, 471 aa, Burkholderia fungorum
MNANPKHVADPTRLRNQNLIGGQWKAALSGQSIAVENPANEEIIAQVPRGQQEDIDEAVKVARATFESAAWRKIRPIDRGRILENIARKVEEHAEELSWLESLDTGKAISFARVIDLPSTVDVFRYMGGWCSKLGGTTPPISFDGKEYHAYTRREPVGVVGAITPWNYPLALGSWKIASALAAGCTMVLKPTELTPLSTLRLAELCLEAGLPEGALNVVNGYGHEAGEALARHPDIDKITFTGSTVVGKKIVEYALGNMKRVTLELGGKSPSIVFDDADLDQVGLGAALAVFFNSGQICFAASRLFVQASVYDRVVEAVAAVASQFKVGNGQDTDTMLGPLVSRKQQERVLGYVQSGIEQGASLIYGGQKIGDKGYFLQPTVFADADQSMKIAQEEIFGPVVSIIRFKDEVEAIRLANDTTYGLAANIWTRDIKKAHRVAHRLQAGSVWINCHGVIDPAAPFGGSNSRAGT

SEQ ID NO: 1038 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGRKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 1039 - protein, 292 aa, Streptomyces avermitilis MA-4680
MQLGLIGLGKMGGNMRERIRRAGHTVVGYDRNPEVSDVSSLTELVSALEGPRVVWVMVPAGAPTQSVVDELGDLLSPGDTVVDGGNSRWTDDEKHAEELAAKGIGFVDAGVSGGVWGLQNGYALMVGGDAEHIARVQPIFDALKPEGDFGFVHAGKVGAGHFSKMVHNGIEYAMMQAYAEGWELLEKVDSVTDVRAVFRSWQEGTVIRSWLLDLAVNALDEDEHLEKLRGYAEDSGEGRWTVEAAIHNAVPLPAITASLFARFASRQDDSPQMKMVAALRNQFGGHAVESAE

SEQ ID NO: 1040 - protein, 561 aa, Ustilago maydis
MVASSSSATASLLDQLFALTPLADSSAWIKTITVLVLLPLLAVVLNVASQLLLATPKNHPPVVFHFVPVIGSAIYYGIDPYKFFFECREKYGDVFTFVLLGRKITVALGPKGSNLVFNAKHQQVTAEDAYTHLTTPVFGKEVVYDVPNAVFMEQKKFVKVGLSIENFRVYVPQIVDEVREYIKSDARFSALKTRKTITVDIFQAMSELIILTASRTLQGKEVRQGLDKSFAQLYHDLDSGFTPINFVIPNLPLPSNFKRDRAQKKMSQFYQDIVAKRRAAGASTSADDASGENDMIAALIEQKYKNGRALSGVEIAHMMIALLMAGQHTSSATSSWAFLRLASRPEIIEELYEEQLNVYSDGHGGLRELDYETQKTSVPLLDAVVKETLRLHPPLHSIMRYVKSDLAVPPTLSSPTSTKSEPDAHYVIPKGHYIMAAPGVSQVDPQIWKSSDQFDPHRWLDATTAAAMQDSGEDKQDFGFGMISTGANSPYLPFGAGRHRCIGEQFAYLQIGVILATFVRIFKWHLDSKFPDPDYQSMVVLPSKNGCAIVLTPRAESLHLD

SEQ ID NO: 1041 - protein, 647 aa, Rhizobium sp. NGR234
MNKHSGNRTAIDPAALEMSIASATEALLAYRHADGHWAFELEADSTIPSEYILLRHYLAEPIDVVLEAKIGNYLRRTQGAHGGWPLVHDGPFDMSASVKSYFALKMIGDSVDAAHMVKAREAIRARGGAANSNVLTRFLLALYGVVSWRAVPVLPIEIVLLPIWSPFHLYKISYWARTTIVPLMVLAVLKPRAKNPKGVGIEELFLQDTKSVGMNPKAPHQSWGWFLLFRGIDGILRVIEPHLPKKLRERAIASALAFTEERLNGEDGMGAIYPSMANIVMMYDALGKDDHFPPRAIARRAIDKLLVIGEEEAYCQPCLSPVWDTALTCHALQEVGGANAVAKAKQGLDWLKPRQVLDVKGDWAVKAPNIRPGGWPFQYNNAHYPDLDDTAVVVMAMDRAQRHAGSKEYATAIARGREWIEGMQSRDGGWAAFDVNNLEYYLNNLPFADHGALLDPPTEDVTARCVSMLAQVGEFTQRSKAVAEGIAYLRRTQHAEGSWYGRWGLNYIYGTWSVLCALNAAGIDHQDPMIRKAVEWLVSIQSWDGGWGEDAISYRLDYSGYEQAPSTSSQTAWALLGLMAAGEVEHPAVARGVNYLKNAQTENGLWDEQRYTATGFPRVFYLRYHGYSKFFPLWALARYRNLRSTNV

SEQ ID NO: 1042 - protein, 316 aa, Pseudomonas aeruginosa UCBPP-PA14
MADFEILCFGETMAMFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDREHRKSA

SEQ ID NO: 1043 - protein, 621 aa, Klebsiella aerogenes
MDSHTLIQALIYLGAAALIVPIASVLGLGSVLGYLIAGCIIGPWALRLVNDAEAILHFAEIGVVLMLVAMGLELDPQRLWKLRASVFDGGALQMVACGVLIGLFCMLLGLRWQVAELIGMTLALSSTAIAMQAMNERNLTVSQMGRSAFAVLLFQDIAAIPLVAMIPLLAASGGATSLMAFALSALKVAAALALVVVLGRYLTRPLLRFVARSGLREVFSAVACSWSSALGLLLEEVGLSMAMGAFLAGVLLASSEYRHALENDIEPVKGLLLGLFFIGVGMSIDFAPWSPNPLRIVILLVGFPAIKMLMLWLIAQPLGVPRAQHRWFAVLLGQGSEFAFVVFGPARMADVLDGEWPKALTLAVALSMATTPILLVLLTRLEKSSSGQARDADEIDEEQPRVIVAGFGRFGQIAGRLLLSSGVKMVILDHDPDHVDTLRKFDMKVFYGDATRVDLLESAGAEKAEVLINAIDDPHVSLELVARVKEHFPHLQIISRARDVDHYIQLRQAGVEAPERETFEAALKSGRMTLEALGLGAYEARERPDLFRRFNLQMVEEMVAMAENDPRRGVAVFKRTSDMLTGIINEDRHHLSLVQRHGWQGTEEGRHTGDIADEPENKPSA

SEQ ID NO: 1044 - protein, 236 aa, Glycine max
  unsure (1)..(236): unsure at all Xaa locations
SSRFGSSFAPNIQENKEGLELLKTAIAKAGYTGEVVIGMDVAAFXNSTRRDKTYDLNFKEDNNDGSQKISGDALKDLYKSFVTEDPXIVSIEDPFDQDDWEHYAKLTAEVGTNVQIVGDDLLVTNPKRVQKAIDTKACNALLLKVNQIGSVTESIEAVRMSKKAGWGVMASHKSGETEDTFIADLSVGLATGQIKTGAPCRFERLAKYNQLLRIEEELGAEAVYAGANFGTPVEPY

SEQ ID NO: 1045 - protein, 380 aa, Oryza sativa
  unsure (1)..(380): unsure at all Xaa locations
MWRLKVAEGGGALLRSTNGFLGRAVWELDPDHGTPEDRADVERVRREFTDDRLRRRESADLLMRMQFAKQKKLQRRRDSIPPAVKLGEKEQVTEEIAMASLRRALDEFSSLQADDGHWPGDFSGVMFIMPGLVITLYVTGSLDTTISPEHRQEICRYIYNHQNEDGGXGTFLSSSTMFGTCSNYITLRLLGEVLTNEQLARGRIWIISHGGATLVPQWGKIWLSMLGVYEWAGNNPIFPELWLAPQFLPFHPGKFWCLTRMVYLPMAYLYGKKFVGPTTPTILALREEIYPVHYLTIDWAQARSACAKEDLVCPRTRLQNAVWSWLYKWVEPVMSSWAMNKLRGRALDALMEHIHYEDENTQYLCICSVNKALNMVCCWA

SEQ ID NO: 1046 - protein, 493 aa, Saccharomyces cerevisiae
MSNDEGETFATEQTTQQVFQKLGSNMENRVCFDCGNKNPTWTSVPFGVMLCIQCSAVHRNMGVHITFVKSSTLDKWTINNLRRFKLGGNHKARDFFLKNNGKQLLNTANVDAKTKYTSPVAKKYKIHLDKKVQKDMELYPSELVLNGQDSSDSPLDTDSDASRSTSKENSVDDFFSNWQKPSSNSSSKLNVNTGSLAPKNNTTGSTPKTTVTKTRSSILTASRKKPVLNSQDKKKHSILSSSRKPTRLTAKKVDKSQAEDLFDQFKKEAQQEKEDEFTNSSSSTKIRQNDYDSQFMNNSKGNNNNSIDDINTQPDEFNDFLNDTSNSFDTTRKEQQDTLTPKFAKLGFGMTMNDANDLAKQQKESQKIAQGPRYTGRIAERYGTQKAISSDQLFGRGSFDEAANREAHDKLKTFDNATSISSSSYFGEDKEVDEFGNPINSSGSGAGNFDGRNSNNGFIDFNASADDELQMLRDVVEQGAEKLGSYLRDYLRK

SEQ ID NO: 1047 - protein, 437 aa, Zea mays
MEVHADVDGSGVPLAVLLKRELCNQKVERPDILFGEANKSKKGEDFTLLLPRCHRTTGEGGGSGGGENAGDDDDDTISVFAIFDGHNGSLAAIYTRENLINNVLAAIPPNLTSEEWKAALPRALVAGFVKTDKNFQIKAARSGTTVTFVIIDGWVVTVASVGDSRCILESAEGSVYLLSADHRLDANEEEVERVTASGGEVGRINIAGGAGIGPLRCWPGGLCLSRSIGDIDVGEFIVPVPHVKQVKLSNAGGRLVIASDGVWDALCFQEALNYIRGLPAEAAANRIVKEAVTSKGLRDDTTCIVVDILPPEKLSPPLKRPGKGVIKTLFRRRPSDEMSEDQMDRGCLEPDVVEEIYEEGSAMLARRLNINYPSGNMFKLHDCAVCQLEMKPGEGTSVHGNMPKHSRVDPWGGPFLCSSCQLKKEAMEGKLHSRTAE

SEQ ID NO: 1048 - protein, 439 aa, Burkholderia fungorum
MGVLLLHRPRRPSRRSGGCGRARRTRREGCVPEDSGLVSARPLMIFKRRHAVPGAPAAHPITHSRSEILMTASFGPSYVRAIAPYVAGKPISEVAREFDLDEKTIVKLASNENPLGMPESAQRAMAQAASELGRYPDANAFELKAALSKRYGVPADWITLGNGSNDILEIAAHAFVEKDQSIVYAQYSFAVYALATQGLGARAIVVPAVGYGHDLGAMLAAITDDTRLIFVANPNNPTGTFIEGAKLEAFLDKVPRNVVVVLDEAYTEYLPQEKRYDSIAWVRRYPNLLVSRTFSKAFGLAGLRVGFAIAQPELTDLLNRLRQPFNVNTLAQAAAIAALNDRAFLEKSAVLNAQGYRRLTEAFDKLGLEYVPSDGNFVLVRVGNDDAAGNRVNLALLKQGVIVRPVGNYGLPQWLRVTIGLPEENEAFVAALEKALATV

SEQ ID NO: 1049 - protein, 417 aa, Oryza sativa
MKAPTNTPIETTRPDLIPTSRAPAPSEEEESSSHAACPSRANAIVKHRREPDDELQAAAMGCSFSGLNALYDTVGGGGGDIWVNDYRFRVVRRLGDAGPAGSFVFLVKEVVAAATASDGTGGAVPGASGLAKKKGIDPSHISADGTYALKKVLIQNEQHLEQVRQEIRVSSQFSHPNLLPLLENAIIAVKGVQDGSQNHEAYLLFPVHLDGTLQDINKNMLEKKEYFPTISILQIFRQLCAGLKHMHSFDPPYSHNGVKPDNVLITQRKDQPHLAILMDFESARPARIAIRSQADAMQLQEWASEHCSAHYRAPELWECPTHADIDERTDIWSLGCCLYAMMYGKSPFDYELDEAAGESLQSVTKSAQIKWPTEAGPSYPDSLRQFVTWMLQPHPAVRPHIDDIIIHVDKLIAKYSI

SEQ ID NO: 1050 - protein, 128 aa, Yersinia enterocolitica
EDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGMVVEA

SEQ ID NO: 1051 - protein, 539 aa, Triticum aestivum
  unsure (1)..(539): unsure at all Xaa locations
NLSTRLRRKEDAAVGRVLLGACDVLRNALGGWRKSRWHAPSLPSLPLVGHLHLLGWLPHRSLRELRARFGTEGGLLLLHLGRXGTLVLATATAAADLYKNHDLAFASRVPRRAGXKLTYGSINVXFSSAPYGDAWRRSKKMAVVHLLSPRRADSFAPVRAAEAAALVAGVRRAAEAGEIVELRELLSAYSNAVVTRATTGAAGATAEKLKKLLGNSAAIMSGLQAGDVLPDAAAKVVRWATGLEKRLDAELEQWDKFLSEIIAEHLEKKPDNGAGEESFLDVLLRLREEGAAGLELTNDRIKSLIKDMIAGGTDTASVTLEWAMAELVGNPRAIAKLQDEIDRVTEGKPTIEEDDLSRMEYLRAVLKEVLRLHPAAPLLIPHQSTTAAVVQGYEIPAETALFVNAWAIGRDPAAWGATAEEFWPERFLGGGSAQGVDLRGNDYQLLPFGAGRRLCPGISFAMPVLEIALCSLVRHFDWGNPRRGTSRHERGAGTDHAAAGSAAPCPQVQEAAVAVPPGEVHVQAQKGLLINKTLRFAFV

SEQ ID NO: 1052 - protein, 500 aa, Trifolium repens
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPKVLQKAREEAYSVVGKDRLVDEVDTQNLPYIRAIVKETFRMHPPLPVVKRKCTEECGINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 1053 - protein, 399 aa, Agrobacterium tumefaciens str. C58
MDNRARLASGIFAPIVSRVFKHSYRNFQPMSAFSRLTPLAVSLPSTVPFVGPEAIERSRGLKVEARIGANESGFGPAPSVLLAMRDAAAETWMYSDPENFELKEALAIHHGVARGNIAIGSGVDGLLGEIARLIVEPGTPVVTSFGGYPTFNYHVNGFGGKLVTTPYVDDHENLDGLLDLVIRENAPLVYFANPDNPMGSWWEASEVVAFARALPETCLLILDEAYCETGPISAVPAIDALIGQPNILRMRTFSKAYGLAGARVGYAIGTLGNVEAFDKIRNHFGMARISVAGALAALKDQAYLHEVVGKISDARDRISAIARNNGLSPLPSATNFVTIDCHRDGAYARAIVDGLMDHGVFIRMPGVAPLNRCIRVSAGTADKLDLFEQALPKVLKAIG

SEQ ID NO: 1054 - protein, 486 aa, Streptomyces avermitilis MA-4680
MSSYFTDLAQQYIGGEWRPGTGSWDIIDFNPYDGEKLASITIATVDEVDEAYRAAAAAQKEWAATNAYARRAVFQRALRLIEDREAEITEAIIAELGGTHLKAGFELHLAKQFLLESINLALRPEGRIIPSPVDGKENRLYRVPVGVVGVISPFNFPFLLSLKSVAPALALGNGVVLKPHQNTPIVGGSLIAKIFEDAGLPGGLLNVVITDIAEIGDAFLEHPVPKVISFTGSDKVGRHVATVCAAQFKRSVLELGGNSALVVLEDADIDYAVDAAVFSRYVHQGQVCMAANRVLVDRSIEAEFTEKFVAKVKTLKSGDPRDPQTIIGPVINSSQADAISGAVDQAIADGAIALVHGTTTDNLVEPSVLTGLAADAPILQEEIFGPVALLIPFEGEEEAVRIVNDTPYGLSGAVHTADVERGVAFAKQIDTGMFHVNDGTVHDEPLVAFGGEKSSGIGRLNGEATVESFTTQKWISVQHGRSFFPF

SEQ ID NO: 1055 - protein, 510 aa, Candida maltosa
MIDALYILIVALVIYKTAQFVHRKSLEKKHHCQPVKQIPLVSILSGLGFDMFFKDTAEMTKNGGLHKKLQQMLESLQTTTFRSRMLTGSQIVTMEPENERTMCSSAHMKDWTIGYRPFALKPLLGDGIFSSEGESWKHSRIMLRPIFAKEHIKQITAMEPYMLLLIEIIKSSSANEGPVDLQPLFHAFTIDYASDFLFGESCDVLKENLGGKSTSGMDAQVKRDFASVFNDVQNYLTKRMMLGPLAFLVSSKDFHDGIKKQHEFVSYFVQKAISMSDEELNDESKNYVFLYQLAKQTKDAKVLQDELLSILLAGRNTTASLLSFLFFELSHHENVWTTLKEVVDQSFPDVESITFETIQNCDYLRWCLFESLRVNPSVPFNSRTANKDTILPRGGGEDCSHPILVKKGDQVLFPLYASNRQEKYFGRKPEEFIPERWRDLPKTGGPAFMPFSTGPRMCLGQQFALIEASYVTIRLVQTFSKLKSHSLEYAPKRLVAATIRLIDGCFVSFE

SEQ ID NO: 1056 - protein, 472 aa, Neisseria meningitidis MC58
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 1057 - protein, 196 aa, Triticum aestivum
  unsure (1)..(196): unsure at all Xaa locations
MDLSAVHAALSAKSYSAIATLCDDLFLQVASRGVATDDWPYAVHLLGHLYLNDLNSARFLWKTVPQEVKDAHPELGAIWKIGQCLWNRDYAGVYTSAQGFEWGPEIADFVTAFLESYRKRIFELLTSAYTTISIADVAHFMGMSEEDATNYAVQNGWSLDVAXKMLTVRKQKPQTNQKLDPNKLQRLTECVFHLEH

SEQ ID NO: 1058 - protein, 185 aa, Corynebacterium glutamicum ATCC 13032
MSEQALSTFDRAREALDKKTRYVQDFPEKGVLFEDLTPVLGDAESFVAVVDAMAEAAEKLNAEIIGGLDARGFLLGSAVAYKLGLGVLAIRKKGKLPPPVVTQEYELEYGTAALELPSEGIDIAGKNIVLIDDVLATGGTLGAARKLIESCDGHVSGYVLAIEVPGLGGRDNLGDRPVIVVRDPQ

SEQ ID NO: 1059 - protein, 251 aa, Xanthomonas axonopodis pv. citri str. 306
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHQESSELVARKFAAALHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 1060 - protein, 471 aa, Gelidium pulchellum
  unsure (1)..(471): unsure at all Xaa locations
SGVIPYAKMGYWDPDYAVXETDVLAXXRVTPQPGVDPVEASRAVAGESSTATWTVVWTDLLTACDLYRAKAYKVEEVPNSSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLXTVIVMIDLVIGYTAIQTMAIWARKNDMILHLHRAGNSTYSRQKNHGMNFRVICKWMRMAGVDHIHAGTVVGKLEGDPLMIKGFYNTLLESHLDQNLPQGIFFVARWASLRKVTPVASGGIHCGQMHQLLDYLGVDVVLQFGGGTIGHPDGIQAGATANRVALEAMVIARNEGRSFVEEXPQILRDAAKTCGPLQTALDLWKDISFNYTSTDTADFVETPTANV

SEQ ID NO: 1061 - protein, 453 aa, Patulophycus eclipes
KETDILALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAASGEVKGHYMNVTAATMENMYERAEFAKALGTVIIMIDLVIGYSAIQSMAIWARKNDMILHLHRAGNSTYSRQKIHGMNFRVICKWMRMAGVDHIHAGTVVGKLEGDPLMIRGFYNTLLLPHLDINLPQGIFFTQEWAALRKVTPVASGGIHCGQMHQLLDYLGDDVVLQFGGGTIGHPDGIQAGATANRVALESMVIARNEGRDYVAEGPQILRDAAKTCGPLQTALDLWKDITFNYTSTDTADFVETPTASV

SEQ ID NO: 1062 - protein, 167 aa, Zea mays
MQNRIQSHPAGASSSASSGGDGSGSGFCLSDIMEIDAGSGGDHKAPGSPRSKHSATEQRRRCKINERFQILRDLVPQSDQKRDKATFLLEVIEYVKFLQEKVQKHEACAGGDWSQENTKLAPWSSNRVPVDLMPGVAPTTKIGSAGNFLDNSIPTMPEMLQNAETVV

SEQ ID NO: 1063 - protein, 479 aa, Thermoanaerobacter tengcongensis
MVESSGAKGVLRKKLPEHAMELAQEEKYRLKRELGWFELMLFVLGATIGAGIFVLPGVAAAKFAGPAIMISYALGGIVTIAVALAYTEFASMVPVAGSAYTYSYVALGEIFAWIVGWDLIFEFTMIASTVAVGWGGYFNSFLETVFGITLPQAISHDITHGGIVNLPAILGLLIVAWIALTGIRASGIANALFTTAKVFAILFVLTVGVFHIKLENWTTPFAPYGLAGIMTGAALTFFAYTGFDGITSLLEEVKRPERDIPIALIGGISLCALFYVAMSAVITGMVHWTKLDVPNPAAFVLMQVGIPWGGALISISVLFGLIATMLGNSLSASRILFAMGRDGLLPEWFAFVHPTRRVPRNAAYVIYTAAIIFAGFLSISELAELANIGGLTAFTLVTISVMVMRYTDPERKRIFKVPAIWVIGPIGIIGSLALIASLPVVTFIRFTVWLIIGLIIYFSYGYKHSKEGTGYYIGKENQK

SEQ ID NO: 1064 - protein, 425 aa, Xylella fastidiosa Ann-1
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVADKVVPLKSRSAAA

SEQ ID NO: 1065 - protein, 467 aa, Pterocladiella caerulescens
  unsure (1)..(467): unsure at all Xaa locations
PYAKMGYWDPDYTVRDTDVLALXRVTXQPXVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIASTGEIKGHYMNVTAATMEDMYERAEFAKQLGTVIIMIDLVIGYTAIQTMAIWARKNDMILHLHRAGNSTYSRQKSHGMNFRVICKWMRMAGVDHIHAGTVVGKLEGDPLMIRGFYNTLLLPYLDVNLPQGIFFEQDWASLRKVTPVASGGIHCGQMHQLLDYLGEDVVLQFGGGTIGHPDGIQAGATANRVAXEAMVIARNEGHDYVAEGPQILRDAAKTCGPLQTALDLWKDITFNYTSTDTADFVETPTANV

SEQ ID NO: 1066 - protein, 580 aa, Caulobacter crescentus CB15
MTTAAAAAPDPYLQRKPQDEVIYFVLPDRFENGDATNDHGGPALGALADGFDPARAGFYHGGDLKGVTRRLDYIQGLGATAVWLAPIFVNRAVQGPPGQESAAHHGYWITDFTDVDPHLGTKADFKALVDAAHARGMKVYMDIVLNHTADVIQYKECPDNRCAYRGVSDYPYVRRGGVDGAPINDGFDGKDFSKLKRPDWAYTPYVPPGQERAKTPAWLNDPIYYHNRGDSTFAGESSLLGDFATLDGVFTEHPRVVEGFIEVYGRWIDDFGIDGYRIDTARHVNPEFWQAFVPAMLARAKAKGIENFHIFGEVFDADVATLARHVKVDKLPTVLDFAFQAAVTDVALGRAGPDRLASVFAGDVVYEGGEATARQLPTFLGNHDMGRIGHFVLKAHPKIGDDALLARITLANAIMLTARGVPTIYYGDEQGFTGDGDYADSREDMFPSQVASYNDNRLVGSSAKGPRTAFQTDSVLYRRIAALAKLRGMTPALREGRQVTRIAEGKPGLLAFSRLMAGTEVLAVFNTSDKPIKARVPVEMGSAAWKSLHGACISSAVAPGSYAVELAPFDYMICVSEGRS

SEQ ID NO: 1067 - protein, 504 aa, Agrobacterium tumefaciens str. C58 (U. Washington)
MDSSSSGVSYKKADASYFEKRGLSRYAGVWSLWALGVGAVISGHFSGWNFGFSTGGWGGMLVAGIIIAIMYLGLTFSIAEMSPALPHTGAAYSFARTAMGPWGGFVTGLCENVEYVLTPAVVVTFITAYVNSILGLDPAYSPFVWIVFYAIFLALNVFGLELSFKVTLVITLISLAVLVFFWISAIPNIDFSRFALNIGVGPDGKAVELPEGGGSFFPFGFSGVLATLPFAVWLFLAIEQLPLAAEESVDPKRDMPKGIILGMVTLMVSAFMIVLLNPSLPGVGAFHLSSSLEPLLDGFKAIYGDGGVVLLGLVALTGLIASFHTILYAQGRQIYSLSRAGYFPTVLSITHSKYRTPYVANITGAIVGLAVMLVIWFSLGAEQGGSIIGSVLLNMAVFGAMFSYIMQAISFILLRKNLPNIERPFRSPFGIPGALLTIIIAIVTLLYQIQDPNFTKGVLWVAVWFAVAIAYFAFVGRHRLILSPEEEFALEHKQAAVAAAAAKA

SEQ ID NO: 1068 - protein, 251 aa, Glycine max
MDGGVNYNPRTVEEVFRDFKGRRAGMIKALTTDVEEFFQQCDPEKDNLCLYGFPNEQWEVNLPAEEVPPELPEPALGINFARDGMQDKDWLSLVAVHSDAWLLAVAFYFGARFGFDNADRKRLFSMINDLPTIFEIVTGSAKKQTKEKSSISNHSSNKSKSGSKGRGSESGKYSKETKDEEEEVLDEEDDEEHEETLCGACGEHYASDEFWICCDICEKWFHGKCVKITPARAEHIKQYKCPSCSNKRARP

SEQ ID NO: 1069 - protein, 303 aa, Klebsiella pneumoniae
INGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 1070 - protein, 335 aa, Oceanobacillus iheyensis HTE831
MAVKIGINGFGRIGRNVFRQSLKNNEVEVVAINDLTDANMLAHLLKYDSVHGKLQEEVTVNGSNLVIDGKEIKVLSERDPAELGWGDLGVDIVIESTGRFTNKEDAEKHIQAGAKKVIISAPAKGEDLTIVMGVNDDQYDPSEHNVISNASCTTNCLAPFAKVLNDNFGIKRGLMTTIHSYTNDQQILDLPHKDYRRARAAAENIIPTSTGAAKAVGLVLPELNGKLNGNAVRVPTPDGSLTDLVAELDKNVTIEDVNNAMKEAAEGPLKGILEYSEEPLVSSDIVGNNHSSIFDALSTIVMEDNMVKVVSWYDNEMGYSARCIDLAIFMNNKGL

SEQ ID NO: 1071 - protein, 256 aa, Brassica oleracea
MGRGRVQLKRIENKINRQVTFSKRRAGLFKKAHEISVLCDAEVALVVFSHKGKLFEYSTDPCMEKILERYERYSYAERQLIAPESDVNTNWSMEYNRLKAKIELLERNQRHYLGEDLQAMSPKELQNLEQQLDTALKHIRSRKNQLMYESINELQRKEKAIQEQNSMLSKQIKERENVLRAQQEQWDEQNHGHNMPPPPPPQQHQIQHPYMLSHQPSPFLNMGGLYQEEDQMAMRRNDLDLSLEPVYNCNLGSFAA

SEQ ID NO: 1072 - protein, 489 aa, Halobacterium sp. NRC-1
MSDLDFGDVDWNVQYIDGEYVPPGDRGTLEVDDPSTRELFTEIPAGTTDDVDAAYEAAADAQTEWADTPPQERARIVAAASEILASHRDEVVDLLATESGTTYTKGAAEFEASVGITDEAASFPTRMNGDHKQSVVEGKENIVVREPQGVVGIISPWNFPLNLSIRAVAPAVAAGNSVVLKPASNTPVTGGLLIAKVFEAAGLPEGVFNVVTGKGSEIGDRIAGHPHADVISFTGSTAIGRQVAATAGENLALPAMELGGNNVHIVTEDADLDDAVDSGVFGSFLHSGQICISINRHVVHEDVYDEYVERLTERAAALPTGTAHDADTVVGPIIDESQRDQILDYIERTVDAGATLETGGDHDGLVVEPTVLSDATNDMAAACNEHFGPVAPVIPFSDDDEAVEIANSTEYGLSGSVHAGDTGRARDIADRIDTGMIHINDQPVNQEPHLPFGGYKNSGLGRYNGEYVLNEFTQEKWVSIQRETRDYPF

SEQ ID NO: 1073 - protein, 300 aa, Neurospora crassa
MSSASPSRERRRLVGVSTKMYFSHARTTNFITSFLDLMQHHTSTKTEQSNDNRNNLAAALASKIDIFIIPDHLSLQSAINRTANHPSQSGPTDPKILFGAQNCHWEDSGPFTGEVSPAVLAEVGCSIVELNHAERRRHFAETDAITCLKAQAVIRNGMIPLICVGEGSPGQIPALSEVAIMKAAAEVVDQVELCLEGVDPTKEVWLAYEPVWAIGAKEPAGVEHVRGVVRTIRKSEVVRGREERGGVTRILYGGSAGPGLFGQLKEVDGVDGLFLGRFAHEEGQFWKTICEVAEVEWEGR

SEQ ID NO: 1074 - protein, 300 aa, Triticum aestivum
  unsure (1)..(300): unsure at all Xaa locations
MARLLLVVLALHLTAARAFAASSVGGRNGDFDPSRVVQLSWHPRAFLHKGFLSDAECDHMIELAKDKLEKSMVADNESGKSVQSEVRTSSGMFLEKRQDEVVARIEERIAAWTFLPSENGESIQILHYKNGEKYEPHYDYFHDKNNQALGGHRIATVLMYLSNIEKGGETIFPNAEGKLTQHKDETASECAKNGYAVKPVKGDAXLLFFSLHPDATTDPDSLHGSCPVIEGQKWSATKWIHVRSFENSGKQGGSGDGCEDENVLCSQWAAVGECAKNPNYMVGTKEAPGFCRKSCNVCAQ

SEQ ID NO: 1075 - protein, 363 aa, Zea mays
MSVAAAAALGRADELRALDDTLAGVRGLVASGAKQVPRIFRVPYPEELLHHEQPPAAATVPMIDLSGDRAAVIDAVRGAAAGWGFFQVTGHAVPEQVMSAAVAAMRAFHEADGGEGSDKARLYSRGPGRAVKYHCNFDLYQSPVANWRDTVYLRMAPDPPAADDLPEICRDALFEYAKQVKDLGQRLFGLLSESLGLKPSYLTDIECDQGQIILGHYYPPCPQPELAIGTSRHSDSGFLTILLQDKVGGLQILHDGQWVDVAPTPGAFIVNIGDLLQLVSNDKFSSVEHRVVAKNAEPRVSIACFFSTHFHPASTRTYAPIKELLSEENPPLYRETLVREYVARYYSVGLDGKQKTALADFRL

SEQ ID NO: 1076 - protein, 571 aa, Halobacterium sp. NRC-1
MDGYAVRAADTFGASEADPARLSVAGTVHAGEEPAVEVTAGRAVVVSTGAVMPPGADAVVKVEATTEADGGDAVDVRTSVAPGTAVMLAGADIAAGSRAIGPGTKLTAREIGVLSALGVGSVRVRGAPTVGIISTGDELVRPGDPLDSAAGQIHDVNSHTIAAAVEAAGGEPVVYPHAGDDYAEMERLLVESAADCDLVLSSGSTSASAVDVIYRVAEERGDLLLHGVAVKPGKPMLVGEIEGTAYVGLPGYPVSALTIFRVFVAPVVREAAGRGQPEPTVVTGEMARQERSAEGRRRLLPVGLVEDGAGDRLVYPVDKGSGATTSLVDADGTVTVPADTAYVAAGDSVDVALFAPDARAPRVLAVGEDDPLFSRVLDDVARPRFLPVGTREGLRRLREGVPDVVVVAGPATPDGDAVSLGGWTREWGIVVPAGNPAGVDSVADLVDRDLGLVNRARGSGLRRCFDDAIAALAAERPASRRALTDAIDGYELTTTAHESPARKVAAGDADAGLGLAATAASLDLGFVPLGTQSVTVVAAPDRVDKPGVRDLAAALDDCGGLAAPLEGIDPQ

SEQ ID NO: 1077 - protein, 340 aa, Prochlorococcus marinus subsp. pastoris str. CCMP1378
MTLRVAINGFGRIGRNFMRCWLSRGAYTNIEVVGINVTSDPKTNAHLLKYDSVLGKLDGVDIQYTDDTFVINNKTIKCFSDRNPMNLPWKDWGVDLVIESTGVFNTDIGASKHLEVGAKKVILTAPGKGSGVGTYVVGVNADQYKHSDYDILSNASCTTNCLAPVVKVLDQTFGINKGLMTTIHSYTGDQRILDNSHRDLRRARAAATNIVPTSTGAAKAVALVYPEMTGKLTGIAMRVPTPNVSAVDFVFESSKSVTSQEVNNALKESSLGSMKGIIKYGDEPLVSSDYAGTNESSIVDSDLTMSIGDNLVKVLAWYDNEWGYSQRVVDLAEIVAQKWE

SEQ ID NO: 1078 - protein, 439 aa, ASPERGILLUS NIDULANS FGSC A4
MAEIPKVQTVALVREIGGPVEFPNDYPVPTPGNNEVLAKVLYTGDAVAPGPDGIPITKFKLPHIGGHEGVGRIVALGPGCGPDLKLGTLVGIRFASRVCRRCEYCLAGTEQYCLKGTNHLHHEDGSFQEYIALDADYLTILPDDVDPKTIAPVLCAGITAYKAVLGANIRAGHWLVVVGAGGGLGHMAVQYAKVLGAQVIGIDAPDKRDFVLSVGATEFVDFVNTDPVQRVHEITGLGAHSAVVTAGSGKAFAHPRELAAQESSPSTIFNSFTSNTAFKLGLALRTRILSLPSSQRKPALISISLGGSNGPTGAPHVVFQCATEPGTVPDNEVWVRRKRNTVERWGVSSWLMRRKIFAGLEGASADGIGAEEAFVRKYALVSSSGGKIADDYAIHGGGFPIRVKGVDGIVGVVVVSGLKQEDDHQVIVEVVQELIAQGN

SEQ ID NO: 1079 - protein, 710 aa, Thermoanaerobacterium thermosulfurigenes
MKKTFKLILVLMLSLTLVFGLTAPIQAASDTAVSNVVNYSTDVIYQIVTDRFVDGNTSNNPTGDLYDPTHTSLKKYFGGDWQGIINKINDGYLTGMGVTAIWISQPVENIYAVLPDSTFGGSTSYHGYWARDFKRTNPYFGSFTDFQNLINTAHAHNIKVIIDFAPNHTSPASETDPTYAENGRLYDNGTLLGGYTNDTNGYFHHYGGTDFSSYEDGIYRNLFDLADLNQQNSTIDSYLKSAIKVWLDMGIDGIRLDAVKHMPFGWQKNFMDSILSYRPVFTFGEWFLGTNEIDVNNTYFANESGMSLLDFRFSQKVRQVFRDNTDTMYGLDSMIQSTASDYNFINDMVTFIDNHDMDRFYNGGSTRPVEQALAFTLTSRGVPAIYYGTEQYMTGNGDPYNRAMMTSFNTSTTAYNVIKKLAPLRKSNPAIAYGTTQQRWINNDVYIYERKFGNNVALVAINRNLSTSYNITGLYTALPAGTYTDVLGGLLNGNSISVASDGSVTPFTLSAGEVAVWQYVSSSNSPLIGHVGPTMTKAGQTITIDGRGFGTTSGQVLFGSTAGTIVSWDDTEVKVKVPSVTPGKYNISLKTSSGATSNTYNNINILTGNQICVRFVVNNASTVYGENVYLTGNVAELGNWDTSKAIGPMFNQVVYQYPTWYYDVSVPAGTTIQFKFIKKNGNTITWEGGSNHTYTVPSSSTGTVIVNWQQ

SEQ ID NO: 1080 - protein, 426 aa, Batrachospermum macrosporum
IEASAAVAGESSTATWTVVWTDLLTACDLYRAKAYKVDAVPNTADQYFAYIAYDIDLFEEGSIANLTASIIGNVFGFKAVKALRLEDMRLPVAYLKTFQGPATGLIVERERMDKFGRPFLGATVKPKLGLSGKNYGRVVYEGLKGGLDFLKDDENINSQPFMRWRERYLFSIEGVNRAQAATGEVKGHYLNVTAGTMEDMYERAEFAKELGSVICMIDLVIGYTAIQTMAVWARKADMILHLHRAGNSTYSRQKIHGMNFRVICKWMRMAGVDHIHAGTVVGKLEGDPLMIKGFYNTLLLNHLSVNLPQGIFFEQDWASLRKVTPVASGGIHCGQMHQLLDYLGNDVVLQFGGGTIGHPDGIQAGATANRVALESMIIARNEGRDYVNEGPQILRDAAKTCGPLQTALDLWKDISFNYTSTDTADF

SEQ ID NO: 1081 - protein, 389 aa, Daucus carota
MVATTLESPRVETLAGSGIQLIPKEYVRPKDELISITNIFEEEKSDEGPQVPTVDIADILSDDKAVREKCYERIKDAAVDWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNMVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPTEQQKTEESNPQKI

SEQ ID NO: 1082 - protein, 553 aa, Saccharomyces castellii
MFPRSDKDVDQLVGNLNQLGLNKPNARFVSVTPTRANKENRSSLSPSPSPNKTKRFTADETELKNSPKKLPHDFYKKALSNDTKRIVNVCQMYFLDYYCDMFDYVISRRQRTKSVLNYLERNQNSLSTEELNNEWTAYLQQEHDVLRKRRLKPKNKDFEMITQVGQGGYGQVYLARKRDTKEVCALKILNKKLLFKLNETNHVLTERDILTTTRSDWLVKLLYAFQDTESLYLAMEFVPGGDFRTLLINTRFLRNTHARFYISEMFCAVNALHELGYTHRDLKPENFLIDSEGHIKLTDFGLAAGTISTERIQSMKIRLEEVKNLEFPAFTEKSIEDRRKMYTHLRQTEVNYANSMVGSPDYMALEVLEGKKYDFTVDYWSLGCMLFESLVGYTPFSGSSTNETYENLRHWKKTLRRPVLDNGRPAFSDRTWDIITRLIADPINRLRSFEHIKRMPYFAEVNFNTLRQSAPPFTPQLDSETDAGYFDDFTNEADMAKYADVFKRQNKLSSMVDDSAVDSKLVGFTFRHRNGQKGLSGILYNGSEHSDPFATFY

SEQ ID NO: 1083 - protein, 100 aa, Triticum aestivum
PRVRASFPVPPRPFVGKREKPRFKKENPFFQPGERFPTWGPPPQDRFLGRFSDALAPPKVSPELRVFWVDFLSQFSKFFGIKVATRFPVKPSLLWMAPFV

SEQ ID NO: 1084 - protein, 223 aa, Clostridium thermocellum ATCC 27405
MCLMLIKIAPSILSADFSKLGEEVLRIEKAGADLVHIDVMDGHFVPNITIGPPVVKSLKKVSKLPFDVHLMIENPDMYIESFADAGADIISVHAEACRHLHRTIQKIKQLGIKAAVALNPATPLCAVEWVMEDVDMILLMTVNPGFGGQKYINGVTRKIEELERIVESRGLNIDIEVDGGIDTETVQYVTKAGANVIVSGSTIFAAEDTAKIIQELRMNSYRK

SEQ ID NO: 1085 - protein, 468 aa, Streptomyces coelicolor A3(2)
MARFRMGEGVLRRKPIEHIEETESGGGLVRSLGLWQLTAIGVGGIIGAGIFTLAGTVANGTAGPAVLISFLIAGVASAAAALSYAEFAGLIPKAGSAYTYGYAVLGELVGWFIGWDLLLEYTAIVAVVAIGISGYFSFLVGEMGADLPNWMLGAPGTGDGHKVDLFAAALCLLIAYLLTLGIRNAARFEMVVVVLKVLVVLLVIGVGVFHINSSNYHPFFPFGVGGAFTGAATVFFAVFGYDAMSTAAEESKDAQRHMPKAIIYSLIISMVLYVAACLVLTGMQNYKDIDPESGFSTAFKSVGLSSLADIIAVGAIIGILTVMFTFMLGVTRVWFSMSRDGLLPKWFAKTHPTRHVPTRVTWIVGVASAVIAGFLPIGEAAELTNIGILLAFVVVCAAVIVLRYRQPDLPRTFRTPWMPFVPALGIVFSIWLITFLQWQTWVRFAVWFVIGLVIYFAYSYRKSELARR

SEQ ID NO: 1086 - protein, 472 aa, Prochlorococcus marinus subsp. marinus str. CCMP1375
MSKAHFGLVGLGVMGENLVLNAERNGFSSVVYNRTYSKTEAFLNGKGLGKKISGASDLQDFVNKLERPRRILMMVKAGAATDAVIEQISPYLQEDDLLIDGGNALFSDTERRVLELESKSFGYIGMGVSGGAKGALEGPSMMPGGTKASYKAIENLLNKMAAQVDDGPCVTYIGPRGSGHFVKTVHNGIEYGIEQILSEGYDLMKRVCKMNCDEISDVFGIWNKTEELSSYLVEITEICLRTKDPTDGADLVEKIMDKAGQKGTGLWTVVSALQLGASVPTIYASLNGRVMSSMKSERVKAEKVFGKLSIERTDLGSPSNGMSPIMDAVVLSTIASYAQGMEILRLASEEYKYDLHMPSIAQIWKGGCIIRSTLLQRIQDAFNNEPQLTNLLMDPWFAEQIKNRLPGLTKTVAVAAQTGVPVPCFSSTLDYINSYRTARLPQNLVQAMRDCFGSHTYERIDKEGSFHTEWIN

SEQ ID NO: 1087 - protein, 142 aa, Streptococcus thermophilus
MLNKIQHRNLNTYSVTPFDFFEEFSRNLFNDFKPNFIKTDIHETDNEYLVEAELPGIPKENIQVTYENGVLTISGQRQIDAVNEDKKGKLIRSERSLTSVQRQYLLENVKEDEIKASYSDGVLKVTLPKDSNKEIKKSISIE

SEQ ID NO: 1088 - protein, 433 aa, Pinus sylvestris
MAMAASTMMRSSVTAGSFRENHRPSVAVDAQIRSKITSTDGTVRLPFGSFGSNFFGSTAEFGQGSALQCQSARTLQPVRATATEAPPRVQRSSGKERTKIGINGFGRIGRLVLRVALSKEDIEVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADAPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVASRK

SEQ ID NO: 1089 - protein, 169 aa, Glycine max
  unsure (1)..(169): unsure at all Xaa locations
PPQERATQRFDSGRREWRRRRPSPPPTSPASPLPHRPRSTTTRTTSSASAAPAAXAQRLVAMAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDE

SEQ ID NO: 1090 - protein, 329 aa, Arabidopsis thaliana
METPSSTRRVTRSQTRCAINNLLSSKKADDWSDKCQSKSVQRNGAKDRSALFDITNDSPIVGLAMQTPSSGVVGKRNMSRINNTPGSGEALLRGQVKTLLQKVEEEADLTKISLESRPFIHLVTSPMGLLAPTPANTPQVLGFSDEVQVVITSPVVAGQFRAPSQVVESNMFDEKEESLELEKSPSITRSLLLDFSDKSELWESSDCSSVVTQNPEDDNSSVWSMQANASAKDEEYDDEEEEAYSYGEEYDEEYYDEEEEEEEGGIVDGLCEGIRKMSVETDFAGKHTRFVYDSEDEEIVEAKDQSPGVLRLKGFPTPTGKHVRFAGDE

SEQ ID NO: 1091 - protein, 364 aa, Zea mays
MELSPNNSTDQSLLDAQLELWHTTFAFMKSMALKSAIHLRIADAIHLHGGAASLSQILSKVHLHPSRVSSLRRLMRVLTTTNVFGTQQPAGGSDDDSEPVYTLTPVSRLLIASQSSQLAQTPLAAMVLDPTIVSPFFELAAWFQHELPDPCIFKHTHGRGIWELTKDDATFDALVNDGLASDSQLIVDVAIKQSAEVFQGISSLVDVGGGIGAAAQAISKAFPHVKCSVLDLAHVVAKAPTHTDVQFIAGDMFESIPPADAVLLKSVLHDWDHDDCVKILKNCKKAIPPREAGGKVIIINMVVGAGPSDMKHKEMQAIFDVYIMFINGMERDEQEWSKIFSEAGYSDYRIIPVLGVRSIIEVYP

SEQ ID NO: 1092 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPSSEEGTKRLVRAAIEYAIANDPDSVALVHKGNIMKLTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 1093 - protein, 405 aa, Actinobacillus pleuropneumoniae serovar 1 str. 4074
MERFPKSDKLANVRYDIRGAIHKEALRLEEEGNKILKLNIGNPAPFGFEAPDEIVVDVIRNLPKSQGYCDSKGLYSARKAIVQYYQSKGIRNVDVNDVYIGNGVSELITMSMQALLNDGDEMLIPMPDYPLWTAAATLAGGKAVHYLCDENNEWMPDIEDIKAKITPRTKGILVINPNNPTGAVYSRSMLLEIAEIARQHNLMIFADEIYEKIIYDGAVHHHIAALAPDLLCVTYNGLSKAYRVAGFRQGWMVLSGPKNQARGFIEGLDMLASMRLCATTPMQHAIQTALGGYQSINEFVLPGGRLLEQRNKMYELLVQIPGISCVKAKGALYMFPKIDTEMYGIKDDAKFIYDLLQAERVLLVQGSGFNWHKPDHFRVVTLPYAHQIEEALGRLANFLKTYKQS

SEQ ID NO: 1094 - protein, 142 aa, Triticum aestivum
  unsure (1)..(142): unsure at all Xaa locations
MAPAVMASSATTVAPFQGLKSTAGLPVGRRSSGSLSSVSNGGRIRCMQVWPIEGIKNSETLSYLPPLSTGGLPGNRSDYLDSAQKWXPCLRXNKFGFLFPLXNXPPGYYDGXRYWDMLXLPXFRXTGPTQVLNXVEESKKXT

SEQ ID NO: 1095 - protein, 148 aa, Glycine max
MCQLRLGVKANNVVKWQTVPAACGEYIADYVLGDQTKHCTWLRIEYSMAQSSCKTLVQWLVAALLIALLGGAQAVAICNIDSSQLNLCRAAVTGQNPPPPDEKCCAVVRQANLRCLCSYKSTLPSFGINPKNALALPGKCGLQWPPNC

SEQ ID NO: 1096 - protein, 488 aa, Adenocystis utricularis
MPEDVQNRTRIKSERYESGVIPYAKMGYWDADYNVKQTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAASGEVKGSYLNITAATMEEMYQRAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRKAASSCGPLKAALDLWKDITFDYTSTDTPDFVETATESR

SEQ ID NO: 1097 - protein, 477 aa, Laurencia complanata
KNERYESGVIPYAKMGYWDPNYVVKDTDILALFRVSPQPGVDPVEASAAVAGESSTATWTVVWTDLLTACDLYRAKAYKVDAVPNTSDQYFAYIAYDTDLFEEGSIANLSASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEAVNRSIAGTGEVKGHYMNVTAATMEDMYERAEFAKELGTVIIMIDLVIGYTAIQTMAIWARKNDMILHLHRAGNSTYSRQKIHGMNFRVICKWMRMAGVDHIHAGTVVGKLEGDPLMIRGFYNTLLEPSLAVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 1098 - protein, 246 aa, Triticum aestivum
VIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 1099 - protein, 615 aa, Microbulbifer degradans 2-40
MIPTRADEPEYAKLKDPVTAETSRYGTPIKLTPVGDNGVSLRVNGDCGIGDNPNRTKQHAFHFTADNCIGCHACEAACSEKNDLPPHLSFRSVGYVEGGSYPNFTRMNISMACNHCEEPVCLKGCPTRAYTKHPEYGAVIQDPDICFGCGYCTWVCPYNAPQLDPVAGQVEKCNMCVDRLEVGLKPACVSACVGNALNFGVVENTPENREQIETQIPGFPDPSITRPNIRFQQVKTMPREVTRTDSMPVKYHKSNVDGKYKPIVDQKNGVEKSWNVGRLSSRENPLVIFTLVTQAAIGLFGVNFLGSLFGIEAFTNIANSVMYVPLVIVALGLAALGLFMSTTHLGKPLRFYRGFNNWRHSPVSREGLGVVVFMTFAGLHMLAKMPENAIVQSIIGELAIPGLATFAKVTGVLGVVGSLGGLYYMYRCYRIKARPYWNHWQTGTSFVGMALTLGSLVAAVLTVPYFAITGGDYVAVLQALAPALVAGLVLEGIGLIGHAKGMTDAEHEGTVSHYIQCTTFGKSYILRNCLIPLNALAAVALAVSGLDGWLGLMLWSGLALSLVVSALIGRALFYVLVVPTTMPGAFFWKNKGFEDHAREIGLAANPAVGVAMHTH

SEQ ID NO: 1100 - protein, 282 aa, Zea mays
MACSHIVAAAGVSSPAAAAARSPAHSPASAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEQETFPHDALEATAWTEDGLIMAARHKKYKHIQGVQFHPESIITPEGKKIILNFVRFIEELEKQRS

SEQ ID NO: 1101 - protein, 234 aa, Streptomyces carzinostaticus subsp. neocarzinostaticus
MILAGGKGTRLRPYTSRLPKPLVPIGDEFSILEIVLSQLSQRGFDTVTLAIGYLGHLIRSFVGDGSRWNMHITYASEDTPRGTIGPVLGILDQLPEHFLVMNGDILTDLDYADVLAHHTRGEAPLTVATCTREVRIDFGVLTTTSNRVVHFVEKPTVDYRVSMGVYGLSRTTLETYPSHMPFGFDDLVLDLLARGVQPAEYPFDGYWLDIGRPDDYDRANAEFDSIKGTLLKGA

SEQ ID NO: 1102 - protein, 409 aa, Ferroplasma acidarmanus
MAKHTMKGFDSLLPYNTALSTFKGEKWTYPDSIQLPLDSASGKISSGEIITTVNIPDKNKSAMDGYALKSTDTLNATPANPVKLVLKGTIAAGDTPEEIVKDGTCIEIYTGSIMPEGSDAVARAENCEVIGNYIYVYSSVNSGENVAPAGEDLNIGDTILGKNSLIYPQNLAALKSSGISEVNVYGNISIGIINTGKELINKQIENSTGMLLRTFYTSSFTETIDGGIVDDDKPSIAVAVRSMIEKCHILIVTGGSSLGRRDMTTDALSGEGKMLFSGVSIKPGRTIGLFNIKNRPVLSVSGLPVAALLSSMIFVDSYIKNIYGVNYIHRASSILDKSIHNRAGFTTFQIARSYAIDGELHSIPLNTKVSGNLTAIIKGNSIIKIDENLEGIPEGSRVNIYVIGDIKWD

SEQ ID NO: 1103 - protein, 765 aa, Shigella flexneri 2a str. 301
MKWLCSVGIAVSLVLQPALADDLFGNHPLTPEARDAFVTDLLKKMTVDEKIGQLRLISVGPDNPKEAIREMIKDGQVGAIFNTVTRQDIRAMQDQVMELSRLKIPLFFAYDVLHGQRTVFPISLGLASSFNLDAVKTVGRVSAYEAADDGLNMTWAPMVDVSRDPRWGRASEGFGEDTYLTSIMGKTMVEAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTAADPEDAVRVALKSGINMSMSDEYYSKYLPGLIKSGKVTMAELDDAARHVLNVKYDMGLFNDPYSHLGPKESDPVDTNAESRLHRKEAREVARESLVLLKNRLETLPLKKSATIAVVGPLADSKRDVMGSWSAAGVADQSVTVLTGIKNSVGENGKVLYAKGANVTSDKGIIDFLNQYEEAVKVDPRSPQEMIDEAVQTAKQSDVVVAVVGEAQGMAHEASSRTDITIPQGQRDLIAALKATGKPLVLVLMNGRPLALVKEDQQADAILETWFAGTEGGNAIADVLFGDYNPSGKLPISFPRSVGQIPVYYSHLNTGRPYNADKPNKYTSRYFDEANGALYPFGYGLSYTTFTVSDVKLSAPTMKRDGKVTASVQVTNTGKREGATVVQMYLQDVTASMSRPVKQLKGFEKITLKPGETQTVSFPIDIEALKFWNQQMKYDAEPGKFNVFIGTDSARVKKGEFELL

SEQ ID NO: 1104 - protein, 464 aa, Pterocladiella capillacea
KMGYWDPDYAVKETDVLALFRVTPQPGVDPVEASAAVAGESSTATWTVVWTDLLTACDLYRAKAYKVDDVPNTNDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAASGEVKGHYMNVTAATMEDMYERAEFAKQLGTVIVMIDLVIGYTAIQTMAIWARRNDMILHLHRAGNSTYSRQKSHGMNFRVICKWMRMAGVDHIHAGTVVGKLEGDPLMIKGFYNTLLLTHLDTNLPQGIFFEQDWASLRKVTPVASGGIHCGQMHQLLDYLGVDVVLQFGGGTIGHPDGIQAGATANRVALEAMVLARNEGRDYVAEGPQILRDAAKTCGPLQTALDLWKDISFNYTSTDTADFVETPTANV

SEQ ID NO: 1105 - protein, 340 aa, Glycine max
  unsure (1)..(340): unsure at all Xaa locations
MGKVKIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISAPSKDAPMFVVGVNEHEYKPELDIISNAXSCTTNCLAPLAKVINDKXFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDNRSSIFDAKAGIALNKNFVKLVSWYDNEWGYSSRVIDLLVIVAKKSF

SEQ ID NO: 1106 - protein, 213 aa, Zea mays
MGFPVGYSELVLPKQLLHLLLLLGYIRRFLLWAFDAVGLGDLLDLGDDHQALLQDHQQQQHGAAAQGRDLPQQAAMLQHRRPEFRAVPAMVIEEVLPVVRFDELELEPEPGDCAVCLSGIGGRDEVRRLSNCRHVFHRACLDRWMEHDQRTCPLCRAPLIPDEMAGALWAAAAGVPDASDFDFSYLGAPLAPVPSPTLLRPHELLLTGLGGYQ

SEQ ID NO: 1107 - protein, 319 aa, Citrus sinensis
MENFPVISLENINGAERAAILEKINEACEKWGFFELVNHGIEPEFMDTVERLTKAHYRKCMEQRFKELVASRALEGIQTEVNDMDWESTFYVRHLPQSTINEVPDLDEEYRKVMKEFALKLEKLAEELLDLLCENLGIEKGYLKKVFHGANGPTFGTKVSNYPPCPKPDLIKGLRAHTDAGGIILLFQDDKVSGLQLLKDGQWIDVPPLRHSIVVNLGDQIEVITNGKYKSVEHRVVSQTDGEGRMSLASFYNPGSDAVIYPAPALLEKEAEKKQVYPKFVFEDYMKLYVPLKFQAKEPRFEAMKAVETNVNLGPIATA

SEQ ID NO: 1108 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQFEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 1109 - protein, 365 aa, Zea mays
  unsure (1)..(365): unsure at all Xaa locations
MEPQCNVGMFTRAELLEASVELRHHALGYVKSTALRCAVKLGVANAIQRRGGRASVEDLLTELSLDASRLRCLHSVMRALAALGVFKEGSDGEYGLTAVSSLLVDDDSSVRGSLRPITLLYLEPAFMAPVLNLADWALAGVDGSDDDNNCSARGTAFKMTHGEDVWDVLARDAFLGDFFTXALASETRFLMDIAIRGSPQVFEGIASLVDAGGGTGAAAQAVAAAFPDTRCTVLELPQVVDAAPIDGPVRFVGGDMTKFIPPADAVLLKNVLHDWSDKDCVIILKRCKEAIAASGKVIVIDIVLGSSSLAICNETQLWLDLFMSTVTTGKERREEEWYRLFKEAGFSAYKICPVLGLLSVIEVFL

SEQ ID NO: 1110 - protein, 499 aa, Vitis vinifera
MELLSCLLCFLAAWTSIYIMFSARRGRKHAAHKLPPGPVPLPIIGSLLNLGNRPHESLANLAKTYGPIMTLKLGYVTTIVISSAPMAKEVLQKQDLSFCNRSIPDAIRAAKHNQLSMAWIPVSTTWRALRRTCNSHLFTSQKLDSNTHLRHQKVQELLANVEQSCQAGGPVDIGQEAFRTSLNLLSNTIFSVDLVDPISETAQEFKELVRGVMEEAGKPNLVYYFPVLRQIDPQGIRRRLTIYFGRMIEIFDRMIKQRLQLRKIQGSIASSDVLDVLLNISEDNSNEIERSHMEHLLLDLFAAGTDTTSSTLEWAMAELLHNPETLLKARMELLQTIGQDKQVKESDISRLPYLQAVVKETFRLHPAVPFLLPRRVEGDADIDGFAVPKNAQVLVNAWAIGRDPNTWENPNSFVPERFLGLDMDVKGQNFELIPFGAGRRICPGLPLAIRMVHLMLASLIHSYDWKLEDGVTPENMNMEERYGISLQKAQPLQALPVRV

SEQ ID NO: 1111 - protein, 134 aa, Glycine max
  unsure (1)..(134): unsure at all Xaa locations
GVVTVYGNFFITETXXSGXVLKVGVAHMLRGGXVLITVYFXYNRIAEEAGACAVMALERVPADIRAQGGVARMSDPQLIKDIKRAVTIPVMAKARIGHFVEAQILEAIGIDYVDESEVLTLADDANHINKHNFR

SEQ ID NO: 1112 - protein, 229 aa, Oryza sativa
MSTTSPRAEEDAKETVKPIFITLKVMDQEDRRIRHTIRMADKLQVVMDMYYAKAPDVTYGTGTFLFDGIRLKGDMTPMGLEMVDGDTVDFFPIAKTPEAMYGWSGIPAAVKVEKENEWKTPATWEWKAPATRVAGEYVTLKVQGTDGRAVYRTMLRTEELQGLMDFYYDRSHGRVQRGTGRFLFDGRRLRGWQTPAELQMEDGDEVNFFEELIGGAAGSGWDPPSSILA

SEQ ID NO: 1113 - protein, 383 aa, Pyrus pyrifolia
MSSSNAVGATSHELLGAQAQLWNHIFQFINSMSLKCAVQLGIADVIHNHGQPISLSELIAGLNVHPSKAHFVSRLMLILVHSNFFAQHHHVHHDRADVEEEEAVVLYSLTPSSRLLLKDGPFSTTPFLLATLDPVVTTPFHLMGAWLKINGGDDPGATCTPFEMENGMPFWELGAQEPRFGNLFNEAMEADSKLIGRVVVEECGGVFEGLKSLMDVGGGSGTMAKAIANAFPNINCTVFDQPHVVAGLQGTTHNLGFMGGDMFEEIPPANAILLKWIMHDWNDEESVTILKKCREAISLSKNEGGNKKIIIIDIVVGYVDNKKKMMDKKSIETQLMFDMLMMSILPGKERSKLEWEKIFFSAGFTHYNITHTLGLRSLIEVYP

SEQ ID NO: 1114 - protein, 248 aa, Kluyveromyces marxianus
MARTFFIGGNFKMNGTKASIKEIVERLNSASIPSNVEVVIAPPAAYLDHAVSLNKKAQVSVAAQNAYLKASGAFTGENSVEQIKDVGAEWVILGHSERRTYFHETDEFIADKTKFALDSGVKVILCIGETLEEKQKGITLEVVQRQLQAVLDKVQDWTNVVVAYEPVWAIGTGLAATSDDAQAIHHSIREFLAKKLSKDTAEKIRILYGGSANGKNAVTFKDKADVDGFLVGGASLKPEFVDIINSRV

SEQ ID NO: 1115 - protein, 321 aa, Thraustotheca clavata
SKVGINGFGRIGRLVCRAAFANPNATVVAINDPFMDLDYMVYLFKYDSTHGGYKGTVVAEDGNLVIDGHVVRVFSERNPNEIPWGEAGADYVCESTGVFTTTEKAGLHLGGGCKKVVISAPPKGSTPMYVMGVNHDKYDGSAHVVSNASCTTNCLAPLAKVIHDNFGIVEGLMTTVHAVTANQLTVDGPSRGGKDWRAGRGAGANVIPASTGAAKAVGKVLPELNGKLTGMAFRVPVPDVSVVDLTVRLEKGASLATIKAAVKEASEGSMAGILGYTEDEVVSQDFVSDKRSSIFDANVCIALNDSFVKLVSWYDNEWGYS

SEQ ID NO: 1116 - protein, 492 aa, Arabidopsis thaliana
MDPYKYRPASSYNSPFFTTNSGAPVWNNNSSMTVGPRGLILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDIVHALKPNPKSHIQENWRILDFFSHHPESLNMFTFLFDDIGIPQDYRHMDGSGVNTYMLINKAGKAHYVKFHWKPTCGVKSLLEEDAIRLGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCIIEKENNFKEPGERYRTFTPERQERFIQRWIDALSDPRITHEIRSIWISYWSQADKSLGQKLASRLNVRPSI

SEQ ID NO: 1117 - protein, 303 aa, Nostoc punctiforme
MARITTPFGRHSTASEVAQGIDLSGKRAIVTGAASGIGVETARALAHAGAEVTLAVHNVDAGAKTAADITAITGNQNIHVAKLDLTDRGAIAKFIAAWNEPLHILVNNAGVMALPEQHTPEGWEMQFATNHLGHFALTLGLHDALAADGAARIVSVSSSAHMLSPIVFDDIHFAFRPYDPWLAYGQSKTANVLFAVAGTGRWFRDGITANALMPGAIATNLQRHVGGIQTPAELQKTPEQGAATSILLATSPLVEGIGGRYFEDCNEATIVTQQTKDYSGVAPYALNTNNADRLWEESLRLLA

SEQ ID NO: 1118 - protein, 79 aa, Glycine max
  unsure (1)..(79): unsure at all Xaa locations
LKSMAGFCTMQNMNDIISIASNGGRVQCLXVWPPVGKKKFETLSYLLDLDDAQFANXVEYLLRNGWILVRYHWSTFVYV

SEQ ID NO: 1119 - protein, 98 aa, Zea mays
  unsure (1)..(98): unsure at all Xaa locations
MAKHHPDLIMCRKQPGIAIGRLCEKCDGKCVVCDSYVRPCTLVRVCDECNYGSFQGRCVICGGVGISDAYYCKECTQQEKDRDGCPXIVNLGSARRIW

SEQ ID NO: 1120 - protein, 457 aa, Zea mays
MTSPIQLAAAPLLLLVVVVAGTRSSRIFSVADYGAAGDGFRYDTAAIQAAVDACAAAGGGRVLLPAPGNYLTATVQLRSRVVLEVPPGARLLGGTRQADYPPESRRWYVVLAENTTGAGITGGGEINGQGGAFVVRPSEVKNVMVSWNATGDCLGDECRPRLVGFIDSKDVRIHDITLNQPAYWCLHLVRCDNTVIHNVSIFGDFKTPNNDGIDIEDSNNTVITDCHIDTGDDAISPKSTTGPVYNLTATNCWMRTKSCAIKFGSASFFDFKRLVFDNITIVDSHRGLGMQIRDGGNVNDVVFSNIKMRTRYYHPLWWGRAEPIYITTCPRHPDSKEGAISDIRFINISSVSENGVFLAGSKHGLLRNLKFKNIDLTYKRWTNYTGGLYDYRPGCQEMVKHKTGGMMLEHISGLEIDNVRMRWARGSLKGWNVNPILFRPSTIDNLSFHDWQSVDVQ

SEQ ID NO: 1121 - protein, 173 aa, Thermoanaerobacter tengcongensis
MTLDDIKEMIREIPDFPKKGIRFKDITPVLKDAKAFNYSIEMLAKALEGRKFDLIAAPEARGFLFGAPLAFRLGVGFVPVRKPGKLPAETLSYEYELEYGLDSLEIHKDAVVKGQRVVIVDDLLATGGTVYASAKLVESLGGVVDSILFLTELTFLDGRKKLDGYDIISLIKF

SEQ ID NO: 1122 - protein, 337 aa, Pyrus communis
MQIKSHTTNRAALLSFFLITPQSVSLSLPLLLCAGEKMASCKQWTVFLSLLCLVSATMAAPLKKPVAVPFGRNYMPTWAFDHIKYFNGGKEIQLHLDKYTGTGFQSKGNYLFGHFHMQIKMVPGDSAGTVTAYYLSSQNNEHDEIDFEFLGNRTGQPYILQTNVFTGGKGDREQRIFLWFDPTAAYHSYAVLWNLYQIVFLVDDIPIRVFKNSKDLGVKFPFNQPMKLYSSLWNADDWATRGGLEKTDWSKAPFIASYRGFHIDGCEASVEAKFCATQGKRWWDQKEFQDLDAQQWRRLRWVRRKFTIYNYCMTESDTLLCHRSARGTETYNTKSKL

SEQ ID NO: 1123 - protein, 241 aa, Ralstonia eutropha
MHATELNTGHGSQRAIRLAPSILSADFARLGEEVCAIEAGGADLVHFDVMDNHYVPNLTIGPLVCEAIRPLVSIPIDVHLMVEPVDALIPLFAKAGANIISFHPEASRHVDRTIGLIRDHGCKAGLVLNPATPLGWLDHTLDQLDLVLLMSVNPGFGGQAFIPGVLDKVRQARARIDRQVDAGGRPVWLEIDGGVKADNIAAIARAGADTFVAGSAVFGAPDADGGYSSILYRLREAATVT

SEQ ID NO: 1124 - protein, 149 aa, Triticum aestivum
YDYVMKTDDDTYLRVAALVGELRRRRRDDVYLGYGYNMSGDPAHVYLGYGYNMSGDLASWVSTAEEILARNDTLGPEDLMLGKWLNLAGKGRNRYDLKPRMYDLSWDMDNLRPDSVAVHMLKDNRRWATTLRYFNVTAGIKPSELYHLP

SEQ ID NO: 1125 - protein, 521 aa, Fragaria x ananassa
MASSSMAANGVPTLRLSTSNIATNQTQKTNRGLSFSGSHLSGTKIPTPATCLRTCSPSPSTRRAPLVVSPKAVSDSKNSETCLDPDASRSVLGIILGGDGRTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQCLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPYIASMGIYVVSKNVMLDLLREKFPGANDFGSEVIPGATSIGLRVQAYLYDGYWEDIGTIEAFYNANLGITKKPIPDFSFYDSSSPIYTQPRYLPPSKMLDADITDSVIGEGCVIKNCKIHHSVIGLRSCISEGAVIEDTLLMGADYYETDVDRRLMAKKGSVPIGIGKNSHIKRAIIDKNARIGDNVKIIKSDNVQETARETDGYFIKSGIVTVIKDAWIPSGTVI

SEQ ID NO: 1126 - protein, 513 aa, Aspergillus parasiticus
MVAGGGIVSSSGMDAYRALPNNTNSNWFKDKGLRRLNFGLMLMFASAAANGYDGALMNGLLTLPMCEFPLSSCPHLWRMFTFIPASYFADYFGRKMSVALGSAIMIVASVIQAATVGRWAFFGTRIAMGIGLGFAQTAAPPLTTEIAHPRHRGVVTAIFQATWYWGAILAAAVCLATLYVEGSTWSWRIPCLVQCFFPAVQLLGLLIVPESPRWLVSKDRRDEALQILARYHGNCDTSDPLVQFEFSEICSAIELENSVAHKSGWSAFIATKGARHRLAICLLVGVMIQWAGNGVISYYLAPILRSVGITNPTQQSAINLGLQAWNAVCAAGGAVAAEKYGRRPLWMLSTVLMLLFFTLATVLSAVFDESAIKAAGSAVVAFLYLFYGAYDIAYTPLSIAYPVEIMPFYLRTKGLSLSLTAQFGAGFFNQFVNPIALGAIKWKFYFVYLGLLVIFLGIVYFVFPETKGHTLEEIAVIFDGPGAETEVQRDLAAIIAVEREVKAPMKEELEHAP

SEQ ID NO: 1127 - protein, 214 aa, Geobacter metallireducens
MKFFIDTADVNEIREAHELGLVDGVTTNPSLIAKSGRKFEEVIKEITGIVDGPISAEVVSLDHDGMIREAEELAAIHKNIVIKLPMTPEGLKACTTLTKKGIKTNVTLIFTAMQALLAAKAGATYVSPFVGRLDDISQDGMGIIDDIKTIFDNYGYTAEIIVASVRNPIHVLNAALIGADIATIPYSVMLQLAKHPLTDAGIERFLKDWEKVPK

SEQ ID NO: 1128 - protein, 550 aa, Zea mays
MAATVRRAASSVLSRFLLTKPSPSPASAAGNNSALLGSGAAALHRFSTAPASAAAAAEEPIQPAVEVKHTQLLINGNFVDAASGKTFPTLDPRTGEVIARVAEGDSEDIDRAVAAARRAFDEGPWPRMTAYDRCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALSSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 1129 - protein, 244 aa, Ipomoea nil
MEFPNQALEEEESSHRKSGRGKIEIKRIENTTNRQVTFCKRRNGLLKKAYELSVLCDAEVALIVFSTRGRLYEYANNSVRATIDRYKKHHSDSTNTGSVSEANTQFYQQESAKLRRQIREIQTSNKQILGESLGVLNHKELKNLEGKVEKAIGRVRSKKNELLFSEIELMQKREIELQNANMYLRAKISEFERAQQQMNLMPGSEYQETMTTSQTYDAHNFLPLTLLEPNQHYSRHDQTALQLV

SEQ ID NO: 1130 - protein, 472 aa, Gelidium pusillum
ESGVIPYAKMGYWDPDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFLEQDWASLRKVTPVASGGIHCGQMHQLLDYLGIDVVLQFGGGTIGHPDGIQAGATANRVALEAMVIARNEGRDYVAEGPQILRDAAKTCGPLQTALDLWKDITFNYASTDTADFVETPTANV

SEQ ID NO: 1131 - protein, 170 aa, Bacillus subtilis subsp. subtilis str. 168
MSVQEHKQEAPDIVRCKVITVSDTRTDETDKSGKLMISFLEEAGHHIAAYEIVKDEKDALQRSVLAGCMDEQTDAVLLNGGTGIADRDVTIEAITPLFSKELPGFGEIFRMLSYTEDIGSAAIMSRATAGVIQHTAVFSTPGSSGAVKLAMNKLIIPELAHVVREIRKDK

SEQ ID NO: 1132 - protein, 404 aa, Zea mays
MASSMLSATTVPLQQGGGLSEFSGLRSSASLPMRRNATSDDFMSAVSFRTHAVGTSGGSRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPHLRRRASMPDQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 1133 - protein, 473 aa, Oryza sativa
MVRIELVSDGLLLAELADGCVGGSPHGFTPSHDLSGPVPVSSQIREPGLGAPRSSFAWQPRPAMETVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQNCYEKYEMPTLMGSFMMQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 1134 - protein, 746 aa, Oryza sativa
MPSRQPPPPPPPPPPRPDVARRRSVAVAAAAGAAGAGAVAVLVVVALLWWLRRRRGKGKGEADEVVAAAGRLQRLSYRKLRRATGGFAAGSKLGQGGFGPVFRGALPPTTTAAGAIRGDGAGRPVAVKVMDAAGSLQGEREFHNEIAVASHLLASSSAPGSPPVPDAAAKPGGKGRDSILLPFAYSMSSAARGEGRPRRMMLVYDLMPNGSLQDALLGRRCPELVAEWPRRLAVARDVAAALHYLHSVVKPPVVHGDVKPSNVLLDTDLRARLADFGLSRINSDADADGKPESGAIAEGCDVDGGCDDDASVIAESTVTTTVNGEGNPKSPEDDDGFTSASPAEAASTSGFDRTSVESGMNSRSCNGGGSRTGGTMGSGTGSDWWWKQDNGGGSNGVKDYVMEWIRSEIKKERPKNDWIAGAAITNPAADRKKPKRRAREWWREEYADELAKKQKRRALAKSKSEQAGLQWWERDIDDDLDAKGRSKWSMMKSWSRRSNGSTGNGNGNGNGSINWWVNGARSTRDWASGEFVPKSSGAVSSTPSMRGTVCYVAPEYGGGGPLSERCDIYSYGVLLLVLISGRRPLQVTASPMSEFEKASLISWAKHLARVSRLIDLVDPALQDVNRDEVLLCITVALLCIQRSPARRPSSEEVLRMLSGEGEPPHLPLEFSPSPPGGFPFKSRKKVRIAIADLKYEGQPGHYVFWKGFIEAKSFILRLVWMQRSIAECPNPFGLWFQVEENLLSSK

SEQ ID NO: 1135 - protein, 548 aa, Candidatus Blochmannia floridanus
MEIFFTILILTLAVSISGIIRQILPFQIPLPLMQIMLGAVLAWPKFGLHIDFNPELFLLLFIPPLLFSDGWKTPMREFIRHGGEIIILALVLVVITVIGIGYLIYWMIPEIPLVASLALAAVLSPTDAVALSGIVGEGRMPKKIMDILQGEALMNDASGLVSLKFAISVAMGTMIFSISGVSIEFLKVSIGGLLAGISITWGYSKSLRLIMCLSGEDPATQTMLLLLLPFAVYLIAEHIGVSGILSSVASGMTIGQSGIIRNAPLAMRLRGNSVWTMLEFVFNGMVFIMLGLQLPDILYTSIIQAQLDPTIKIWVLFVYVMVIYIALIALRFAWLWLMKYISVHYMHRRPMVFSKYTIREILIASFAGVRGAITLAGVLSIPLFLRDGMAFPCRYQLVFIATGVILLSLLCGVIVLPWLLQGITVSDKLLRREEERMARTIAAEVAIDSLYKLEERLVHDPGENIDSQLINEVSARVISNLRYRIDGSNDVRRSILIEDLERRMRLNALRAERGEYYHLRAQQKISNETLTKLLRDLDFLEALLIEHE

SEQ ID NO: 1136 - protein, 231 aa, Glycine max
  unsure (1)..(231): unsure at all Xaa locations
MPLTGDRDGCFATNEVWSYDAVVRQWSPRAAMLVSRSMFACCVMIGIILVAGGFSTGRKSISQAEMYDXDXXVWIPMPDLHRTHNSACSGVVIGGKVHVLHKDLSTVQVLDNAGPGWTVEECVWLQGQMAVVGDALYVMSHGLIFKQDKEVRKVVGSASEFRKRIGFAMTGLGDDLYVIGGFIGPDRWNWDIKPLSEVDVLTLGSERPTWRQAAPMTRCHGPILGCTLLRI

SEQ ID NO: 1137 - protein, 312 aa, Triticum aestivum
LFDDAKSKDIEGVLILSGDHLYRMDYMDFVQSHRQRDAGISICCLPIDGSRASDFGLMKIDDTGRVISFSEKPRGADLKEMEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDMERGDQLAEGKVPIGIGENTSIQNCIIDKNARIGKNVTIANAEGVQEADRASEGFHIRSGITVVLKNSVIADGLVI

SEQ ID NO: 1138 - protein, 422 aa, Azotobacter vinelandii
MSDLKTAALEYHAQPRPGKLSVELTKPTQTARDLSLAYSPGVAEPVREIARDPELAYRYTGKSNLVAVISDGTAILGLGNLGPLASKPVMEGKGVLFKRFAGVDVFDIEVDAESPQAFIDTVKRISVTFGGINLEDIKAPECFEIERALIEQCNIPVFHDDQHGTAIVTAAGMLNALEIAGKSLPTARIACLGAGAAAISCMRLLVSLGARVENIHMIDRQGVIHAGRDDLNQYKAVFAHETDKRTLADALDGADVFVGLSGANLLSAENLLRMAPNPIVFACSNPDPEISPELAHATRGDVIMATGRSDYPNQVNNVLGFPFIFRGALDVRATRINEEMKIAAAHALRELAKLPVPKAVCEAYGVSGLEFGREYIIPKPMDPRLITVVSDAVARAAIESGVASLPYPRHYPLQSVEEVFNS

SEQ ID NO: 1139 - protein, 841 aa, Arabidopsis thaliana
MANANGKAATSLPEKISAKANPEADDATEIAGNIVYHAKYSPHFSPLKFGPEQALYATAESLRDRLIQLWNETYVHFNKVDPKQTYYLSMEYLQGRALTNAIGNLNLQGPYADALRTLGYELEEIAEQEKDAALGNGGLGRLASCFLDSMATLNLPAWGYGLRYRHGLFKQIITKKGQEEIPEDWLEKFSPWEIVRHDVVFPVRFFGKVQVNPDGSRKWVDGDVVQALAYDVPIPGYGTKNTISLRLWEAKARAEDLDLFQFNEGEYELAAQLHSRAQQICTVLYPGDATENGKLLRLKQQFFLCSASLQDIISRFHERSTTEGSRKWSEFPSKVAVQMNDTHPTLAIPELMRLLMDDNGLGWDEAWDVTSKTVAYTNHTVLPEALEKWSQSLMWKLLPRHMEIIEEIDKRFVQTIRDTRVDLEDKISSLSILDNNPQKPVVRMANLCVVSSHTVNGVAQLHSDILKAELFADYVSIWPNKFQNKTNGITPRRWLRFCSPELSDIITKWLKTDKWITDLDLLTGLRQFADNEELQSEWASAKTANKKRLAQYIERVTGVSIDPTSLFDIQVKRIHEYKRQLMNILGVVYRFKKLKEMKPEERKKTVPRTVMIGGKAFATYTNAKRIVKLVNDVGDVVNSDPEVNEYLKVVFVPNYNVTVAEMLIPGSELSQHISTAGMEASGTSNMKFALNGCLIIGTLDGANVEIREEVGEENFFLFGATADQVPRLRKEREDGLFKPDPRFEEAKQFVKSGVFGSYDYGPLLDSLEGNTGFGRGDYFLVGYDFPSYMDAQAKVDEAYKDRKGWLKMSILSTAGSGKFSSDRTIAQYAKEIWNIEACPVP

SEQ ID NO: 1140 - protein, 253 aa, Pantoea cedenensis
  unsure (1)..(253): unsure at all Xaa locations
GAAGGIGQALALLLKTQLPAGSDLSLYDIAPVTPGVXXDLSHIPTAVNIKGFCGEDGTPALKGADVVLISAGVARKPGMDRSDLFNVNAGIVRNLIEQVANTCPKALIGVITNPVNTTVAIAAEVLKKAGVYDKNRLFGVTTLDIIRSNTFVAELKGKNPAELNVPVVGGHSGVTILPLLSQVPGVTFSQQEVVDLTKRIQNAGTEVVEAKAGGGSATLSMGQAAAKFGLSLVRAINGESNVVECAYVEGDGQ

SEQ ID NO: 1141 - protein, 506 aa, Lithospermum erythrorhizon
MALPAIPLAIIIFLIISYKLYQKLRLKLPPGPRPLPIIGNIYQVKPVKFRCFYNWSKTYGPIFSIYYGSQMNVIVSTTELAKEVLKENDQHLADRFRTRSSASMSRGGKDLIWADYGPHYVKVRKLCNVELFSPKRLEAIRPMREDEYTALVESIYKDCTKPELKGKSLLVREYLSSVAFNNITRLAFGKRFMDSNGVVNEQGQEFKKITHDGIKITAKLSIAEYIPWIRWMFKVEQDALDKFAADRDHLTRVIMEEHIKSGNTKQHFVDALLTLQKQYDISEDTIIGLLWDMIAAGMDTATISTEWAMAELVRNPRVQRKAQEELDRVVGPDRIMTEADVPKLPYLQCIVKESLRLHPPTPLMLPHRASANVKIGGYDIPKGSIVHVNVWAIARDPAYWKNPEEFRPERFMEEDIDMKGTDYRLLPFGAGRRICPGAQLAINLITSSLGHLLHQFTWSPQPGVKPEEIDLSENPGTVTYMRNPVKAVVSPRLSAVHLYKRVESDM

SEQ ID NO: 1142 - protein, 497 aa, Staphylococcus epidermidis ATCC 12228
MTNINVRNYIDESYGLFINNEFQASDSGETLTVSNPANGEDLAKVARAGKKDVDKAVQAAHDAFDSWSKISKEERADYLLEISRRIHEKTEHLATVESLQNGKPYRETSTIDVPQAANQFKYFASVLTTDEGSVNEIDQNTMSLVVNEPVGVVGAVVAWNFPILLASWKLGPALAAGNTVVIQPSSSTPLSLIELAKIFQEVLPKGVVNVLTGKGSESGDAIFHHEGVDKLSFTGSTDVGYGVAQAGAERIVPTTLELGGKSANIIFDDANLEQVIEGVQLGILFNQGEVCSAGSRLLVQSSIYDELLPKLKEAFENIKVGDPFDEDTKMSAQTGPEQLDKIESYIKIAEEDDKANILTGGHRITDNGLDKGYFFEPTIIEINDNKHQLAQEEIFGPVVVVEKFDDEQEAIEIANDSEYGLAGGIFTTDIHRALNVAKAMRTGRIWINTYNQIPAGAPFGGYKKSGIGREVYKDAIKNYQQVKNIFIDTSNQTKGLY

SEQ ID NO: 1143 - protein, 165 aa, Glycine max
  unsure (1)..(165): unsure at all Xaa locations
MDSAATENMISPSHVVAITNGDASSSLDSGHARLLELGYKQQLKRDLSAISNFSLSSSLVFPVLSVLTGITTLYNTGLNYGGPVSMQYGWFIASGFTMLVALSMAEICSSYPTSGGLYYWSAKLAGPTWAPLASWITGWVNIIGXWAGSTSVNFSLAHLIQGYHS

SEQ ID NO: 1144 - protein, 668 aa, Oryza sativa
MRLHVWHRNGIFVLDVRPPDTRIMTQADQAVISLRPGGGGGIGGPRAGRLFPFGASTGSLDFLRPRGGASSGFAAKIIDIPENILKLKQDIDIELHGEDEPWINNDSSVQTQSYNRYAETDNRDWRSRIEQPVQTPAIGGEEKSWDKFREAKESYISSGKQDQFNNQDKLSSQFSAKAQRGNLSNKERVLKTVKGILNKLTPEKFDLLKGQLIEAGITTADILKDVISLIFEKAVLEPTFCPMYAQLCFDLNEKLPSFPSEEPGGKEITFKRVLLNNCQEAFEGADNLRSEVNKLTGLDQEMERRDKERLVKLRTLGNIRLVGELLKQKMVPEKIVHHIVQELLGSESNRCPAEENVEAICQFFNTIGKQLDENPKSRRFNDVYFNRLKDLTTNSQLASRLRFMARDVLDLRSNQWVPRREEMKAKKISEIHREAENNLGLRPGSTASIRTGRTGTGGGGPLSPGAFSMNQPGIVGMLPAPSVDPIVEQPAAAPKPSSTELQKKTISLLKEYFHILLLHEAQQCIEELKSPDYYPEVVKEAINLALDKGTNSIDPLLRLLEHLYNKNVFKATDLETGCLLYSSLLDELAIDLPKAPVHFGEVIGRLVLSHCLSIEVVEDTLKKIEDSFFRAAVFEAMMKIMKANPSGQAILGSHVAKIDACSKLLSSE

SEQ ID NO: 1145 - protein, 347 aa, Zea mays
  unsure (1)..(347): unsure at all Xaa locations
MAAASFTAAKFLAPAAARSGGDRAPFPAPSAFSMRSLRHRPARRLSSVLAVSSDVLKAAPAAAAYPAVTREEALELYEDMILGRNFEDMCAQMYYRGKMFGFVHLYNGQEAVSTGFIKQLNQPDCVVSTYRDHVHALSKGVPARAVMAELFGKATGCCRGQGGSMHMFSEPHNLLGGFAFIGEGIPVATGAAFAAKYRHEVLKQSGPDGLDVTLAFFGDGTCNNGQFFECLNMAQLWKLPIVFVVENNLWAIGMSHIRATSDPEIWKKGPAFGMPGVHVDGMDVLKVREVAKEAIDRAXRGEGPSLFKCETYRFRGLSLADPYELRKPDEITHXXXRXSITXLXXYI

SEQ ID NO: 1146 - protein, 434 aa, Fusobacterium nucleatum subsp. vincentii ATCC 49256
MTGIVDVIGREILDSRGNPTVEVDVILECGVKGRAAVPSGASTGSHEAVELRDEDKTRYLGKGVLKAVNNVNTEIREALLGMDALNQVEIDRVMLELDGTANKGRLGANAILGVSLAVSKAAAEALGLPLYKYLGGVNAKELPLPMMNILNGGAHADSAVDLQEFMIQPVGAKSFREAMQMGAEVFHHLGKILKANGDSTNVGNEGGYAPSKIQGTEGALSLISEAVKAAGYELGKDITFALDAASSEFCEKVNGEYQYHFKREGGIIRNTDAMIKWYEELINKYPIVSIEDGLGEDDWDGWVKLTKAIGDRVQIVGDDLFVTNTERLKKGIELGAGNSILIKLNQIGSLTETLDAIEMAKRAGYTAVVSHRSGETEDATIADVAVATNAGQIKTGSTSRTDRMAKYNQLLRIEEELGSVAQYKGRDVFYNIKK

SEQ ID NO: 1147 - protein, 976 aa, Pisum sativum
MEHLKKSPSSSSSSSMRPSFPRDPRGSLEVFNPTSNSSSPVRSPSNLKNWTEIEEPRNELSEQHNEFSDEVTNTSWMAIKEGETGAAVQRAAEWGLMLTTDAETGKPQGVAVRNSGGDEPSVKLETKRNSNNTVRTSGESSDGDDPRGFPRVSEDLKDALSAFQQTFVVSDATKPDYPILYASAGFFKMTGYTSKEVIGRNCRFLQGADTDPDDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRALSESGQRPFIRKSGGGGGSEEDEEAVENKSRRKSDSVASFRPKPQGKIRHSMERISELPENKQKNSRRGSFMGFMRKSDSIDESIDNEVIVDVSSGSEDDERDDSFEFDDKEKLREKRKGLDLATTLERIEKNFVITDPRLPDNPIIFASDSFLELTEYSREEILGKNCRFLQGPETDPATVRKIREAIDNQTEVTVQLINYTKSGKKFWNLFHLQPMRDHKGEVQYFIGVQLDGSQHVEPLHNCIAEDTAKEGELLVKETAENVGEAVKELPDANQKPDDLWMNHSKVVRPKPHRKDDDAWRAIQKVLENGEQVGLKHFRPIKPLGSGDTGSVHLVELEGTGQYFAMKAMDKGVMLNRNKVHRACTEREILDMLDHPFLPALYASFQTKTHVCLITDYYSGGELFLLLDQQPTKVLKEDSVRFYAAEVVIALEYLHCLGIIYRDLKPENVLIQSNGHVSLTDFDLSCLTSCKPQLILPAIEEKKKRKKKKNKGQQKNQQVPMFMAEPMRASNSFVGTEEYIAPEIITGSGHTSAVDWWALGILLYEMLYGYTPFRGKTRQKTFANILHKDLKFPKSKPVSPHGKQLIYWLLHRDPKNRLGSLEGANEIKNHPFFKNINWALVRCTKPPELDGPILLDNDEKKEAKEIDPGLDDLQKNIF

SEQ ID NO: 1148 - protein, 159 aa, Clostridium histolyticum
MNHKKEKEYKKLDTEKLKENLTELQYNVTQRNATEKPFLNKYDKHFEDGIYVDIVSGEPLFLSIDKFNSGCGWPAFSKPISRKYIKERADFSHGMSRIEVRSKNADSHLGHVFNDGPIENGGMRYCINSASLKFIAKDKLKEEGYEEFLPLFEKDKQEL

SEQ ID NO: 1149 - protein, 77 aa, Glycine max
ISSPAVATVNRAGACMVAPFTGLKSMDGFPTINTNDDVASIAIYGVTVQCIQVWTPVGRRKFDTLSYLPDLDDAAIG

SEQ ID NO: 1150 - protein, 485 aa, Kluyveromyces lactis
MVRLGPKKPPARKGSMADVPANLMEQIHGLETLFTVSSEKMRSIVKHFISELDKGLSKKGGNIPMIPGWVVEYPTGKETGDFLALDLGGTNLRVVLVKLGGNHDFDTTQNKYRLPDHLRTGTSEQLWSFIAKCLKEFVDEWYPDGVSEPLPLGFTFSYPASQKKINSGVLQRWTKGFDIEGVEGHDVVPMLQEQIEKLNIPINVVRLINDTTGTLVASLYTDPQTKMGIIIGTGVNGAYYDVVSGIEKLEGLLPEDIGPDSPMAINCEYGSFDNEHLVLPRTKYDVIIDEESPRPGQQAFEKMTSGYYLGEIMRLVLLDLYDSGFIFKDQDISKLKEAYVMDTSYPSKIEDDPFENLEDTDDLFKTNLNIETTVVERKLIRKLAELVGTRAARLTVCGVSAICDKRGYKTAHIAADGSVFNRYPGYKEKAAQALKDIYNWDVEKMEDHPIQLVAAEDGSGVGAAIIACLTQKRLAAGKSVGIKGE

SEQ ID NO: 1151 - protein, 89 aa, Bacillus anthracis str. A2012
  unsure (1)..(89): unsure at all Xaa locations
MIKIAPSILSADFSKLGEEIKDVEKGGADYIHVDVMDGHFVPNITIGPLIVEAIRXITSLPLDVHLMMKIQITIFQLSQKRERILLLFM

SEQ ID NO: 1152 - protein, 298 aa, Saccharomyces cerevisiae
MSEFKVKTGLAQMLKGGVIMDVVTPEQAIIAERAGACAVMALERIPADMRKSGQVCRMSDPRMIKEIMEAVSIPVMAKVRIGHFVEAQILEELQVDYIDESEVLTPADWTHHIEKHNFKVPFVCGAKDLGEALRRINEGAAMIRTKGEAGTGDVSEAVKHITKIKAEIQQYKENLKTESDFAAKATELRVPVDLLKTTLSEGKLPVVNFAAGGVATPADAALLMQLGCEGVFVGSGIFKSSDPEKLACAIVEATTHYDNPAKLLQVSSDLGDLMGGISIQSINEAGGKNGARLSEIGW

SEQ ID NO: 1153 - protein, 330 aa, Synechocystis sp. PCC 6803
MQIESKTNTNIRSGLTLIAPFFLWGTAMVAMKGVLADTTPFFVATVRLIPAGILVLLWAMGQKRPQPQNWQGWGWIILFALVDGTLFQGFLAQGLERTGAGLGSVIIDSQPIAVALLSSWLFKEVIGGIGWLGLLLGVGGISLIGLPDEWFYQLWHLQGLSINWSGSALGSSGELWMLLASLSMAVGTVLIPFVSRRVDPVVATGWHMIIGGLPLLAIALVQDSEPWQNIDLWGWGNLAYATVFGSAIAYGIFFYLASKGNLTSLSSLTFLTPIFALSFSNLILEEQLSSLQWLGVAFTLVSIYLINQREQLKIQLRDIWSLVRKPVIND

SEQ ID NO: 1154 - protein, 343 aa, Oryza sativa
MASPCSPPPPCHSRGGGLSDFSGLRSSSSLPLRRDATSDNFMNPVSFRTHAVGTNGGARRAPTEAKLKVAINGFGRFGRNFLRCWHGRGDDSPLNIIPINDTGGVKQASHRLKYNSTLGIFDADVKPVGENPLSVEGEVIKVVSDRNPSNLPWGELGIELLIEGTGLFFNANGAGKHIQAGAKKVLITAPGKGDIPTYVVGVNADQYSPDEPIISNASCTTNCLAPFVKILDQKFGIIKGTMTTTHSYTGDQRVFDGSHRDLRRARAAALNIVPTSTGAAKAVALVLPNLKGKLNGIALRVPTPNVSVVDLVVQVSKKTLAEEVNQAFRDSAANELKASSRER

SEQ ID NO: 1155 - protein, 215 aa, Desulfovibrio desulfuricans G20
MHVVAARHVLFIPPRQGFGQAGSLHLDRALKNNMLRILLSDNDDSFTMNLAHLLHAATGSTPQVVNHTALAARAPAAEQDLVVISPGPGHPDEYPCYGPVLQSGRPVLGICLGMQIINCHFGGTVKALAGCVHGKSDTVVMTDADKTLTVGRYHSLHCATTGAGLQVTGRTPQGLVMALRHNSLPLYGYQFHPESFLTAEGVWCIRHALRSLHIL

SEQ ID NO: 1156 - protein, 488 aa, Saccharomyces cerevisiae
DVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAE

SEQ ID NO: 1157 - protein, 575 aa, Spinacia oleracea
MTSSCLLSSTRNTTATTTAAAASYLPKHHYHHHLPLFKLQLPPLKSSHPILRLRNNSRFTYPLASLSSFADADGQEHEEDVINADDHRDDEGGAKSGMAQAFNISSKTAVAISVCIACAALTFPFFMKSIGQGMPFKTRVLSYVTLLFGFYMAWNIGANDVANAMGTSVGSGALTIRQAVLTAAVLEFSGALLMGTHVTSTMQKGILVANVFQGKDSLLFAGLLSSLAAAGTWLQVASYYGWPVSTTHCIVGSMVGFGLVYGGVNAVFWSSLAKVASSWIFSPVLGAAMSFLVYKGIRRFVYSAENPGQAAAAAAPVAVFMGVTAISFAAFPLSKTLPLAIVQALACGAIGAVIVYRVINIQLGHLLAKSKTQHKDEPNPDNPEQKNIGLLSDIAGPKGTQLEIVYGVFGYMQVLSACFMSFAHGGNDVSNAIGPLAAALSLLQVGAGSGAAIQIPIDVLAWGGFGIVAGLMMWGYRVISTIGKKITELTPTRGFAAEFAAASVVLFASKLGLPISATHTLVGAVMGVGFARGLNSVRAETVREIVTSWAVTIPVGGVLAVLYTAILTKGLSYVL

SEQ ID NO: 1158 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNVMILVYDYIENGNLRSHLYGPDLPTMSWEQGLEICIGAARGLHYLHTSAVIHRDVKSINILLDENFVAKITDFGISKKGTELDQTHLSTLVQGTIGYLDPEYFLRGQLTEKSDVYSFGVVLFEVLFARPAIVQSLPREMVSLAEWAVDSHNKGQLEQIVDPDLAAKIRPESLRKFGETAVKCLALSSEDRPSMGDVL

SEQ ID NO: 1159 - protein, 622 aa, Salmonella typhimurium LT2
MSTDNKQSLPAITLAAIGVVYGDIGTSPLYTLRECLSGQFGFGVERDAVFGFLSLIFWLLIFVVSIKYLTFVMRADNAGEGGILTLMSLAGRNTSARTTSMLVIMGLIGGSFFYGEVVITPAISVMSAIEGLEIVAPQLDTWIVPLSIIVLTLLFMIQKHGTGMVGKLFAPIMLTWFLILAVLGLRSIIANPEVLHALNPVWAVRFFLEYKTVSFIALGAVVLSITGVEALYADMGHFGKFPIRLAWFTVVLPSLVLNYFGQGALLLKHPEAIKNPFFLLAPDWALIPLLILAALATVIASQAVISGVFSLTRQAVRLGYLSPMRIIHTSEMESGQIYIPFVNWLLYFAVVVVIVSFEHSSNLAAAYGIAVTGTMVLTSILSTTVARKNWHWNKYFVALILIAFLCVDIPLFSANLDKLLSGGWLPLSLGLIMFTIMTTWKSERFRLLRRMHEHGNSLEAMIASLEKSPPVRVPGTAVYMSRALSVIPFALLHNLKHNKVLHERVILLTLRTEDAPYVHNVRRVQIEQLSPTFWRVVASYGWRETPNVEEVFHRCGLEGLSCRMMETSFFMSHESLIVGKRPWYLRLRGKLYLLLQRNALRAPDQFEIPPNRVIELGTQVEI

SEQ ID NO: 1160 - protein, 606 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFTGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGEGKCWTSKVKSEEELTAAIETALGEKKDCLCFIEVIAHKDDTSKELLEWGSRVSAANSRPPNPQ

SEQ ID NO: 1161 - protein, 190 aa, Zea mays
  unsure (1)..(190): unsure at all Xaa locations
MSEVFEGYERQYCEASASLSRKCTAASALDGEKKKQKLSEIQSGVEEAESLIRKMDLEARNLQPSIKAGLLAKLREYKSDFNNVKSELKRISAPNARQATREELLESGMADTLAVSTDQRGRLMMTTERLNQSTDRIXESRRTMLETVXLGLSILQALPQQRQSLLHAHTTGHIGDLGAFFRLSFWPSFS

SEQ ID NO: 1162 - protein, 333 aa, Xanthomonas campestris pv. campestris str. ATCC 33913
MAIKVGINGFGRIGRNVLRSAVQNFANDIEIVAINDLLEPDYLAYMLQYDSVHGRFKAEVSVDGNTLIVNGKKIRLTQERDPANLKWDAVGAEVVIESTGLFLTKETAQKHIDAGAKKVILSAPSKDDTPMFVYGVNDKTYKGEAIVSNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGILGYTEDKVVATDFRGETCTSVFDADAGIALDSTFVKLVSWYDNEWGYSNKCLEMVRVVAK

SEQ ID NO: 1163 - protein, 233 aa, Sinapis alba
DREGAGKHIQAGAKKVLITAPGKGDIPTYVVGVNAELYSHEDTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDAAEKELKGILDVCDEPLVSVDFRCSDVSSTIDSSLTMVMGDDMVKVIAWYDNEWGYSQRVVDLADIVANNWK

SEQ ID NO: 1164 - protein, 196 aa, Mitthyridium sp. Mishler 7/23/98
GGAKKVVISAPSKDAPMFVMGVNEEKYTNEDIVSNASCTTNCLAPLAKVINDKFGILEGLMTTVHATTATQKTVDGPSNKDWRGGRSAGSNIIPSATGAAKAVGKVLPELNGKLTGMAFRVPTTDVSVVDLTVRLEKPASYDAIKAAVKEASQGKMKGILGYTEDDVVSSDFITDSQSSIFDAKAGIALSDTFVKL

SEQ ID NO: 1165 - protein, 483 aa, Pseudomonas aeruginosa PAO1
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVAKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 1166 - protein, 498 aa, ASPERGILLUS NIDULANS FGSC A4
MACSTGSVTIESYLDTAVSSATPSEETALLRDRKRRHSFHTARKLSCDYDADAIFLRVELFLAELERRLHWIEQYRKSHMVQIDTSLRRAYATLEAVRDSCSHASGELMGSGKKRAKILVETLESRYNDALATKETLEQKAQAGVRLMESFLTELESRADAVRDRGVYGALDDGWKAVDSTLVQAREVMDEGIERARQVKDALRENIDHAIMLAKEKRLISYSDLPAPWRINPHILSGYRFHSSKVECLTSVFTFSNELVNIWSHLIGLIIVLSIAFYFYPLNPNFHLSTNSDTLVAAVFFFAACKCLVCSTLWHTMNSIADQPLMERFACVDYTGISLLVAASIVTTEYTAFYCEPTSRWVYILLTMSLGIGGVILPWHPTFNRADWAWVRVAFYVTLALTGFAPLAQLTYARGFSWCLYFYAPVMKSILVYFVGACVYASQIPERWKPGLFDYIGGSHNIWHLAVLGGILFHYLAMQDLFANAFQRAKGECPNLTS

SEQ ID NO: 1167 - protein, 304 aa, Gigaspora rosea
LVLRAAIEKDTVDVVAINDPFLDLSYMAYLFKHDSTHGRFHGTVDVSSGKLVVSYHGKSTHTITVFTEMKAENIKWGEAGAEYIVESTGVFTTLDKAKAHHMGGAKKVIISAPSADAPMFVMGVNHTSYDPSKHNIVSNASCTTNCLAPVAKVINDNFGIGEGLMTTAHSVTATTQKTGDGPSGKLWRDGRGAFQNIIPASTGAAKADGKVIPALNGKLTGMAFRVPTPDVSVVDLTCRIEKPATYDAIKECVKKASESPEYKGILGYTEEQVVSSDYIGCTISSIFDAGAGISLNPNFVKLIS

SEQ ID NO: 1168 - protein, 414 aa, Glycine max
  unsure (1)..(414): unsure at all Xaa locations
RAASWWRSALLWRTFFTTAVVAIVLRVAIQFCATGKCGLFGEGGLIMYDVSSANITYSASGIFAVLLLGAIAGILGSIYNYLVDKVVRTYSIINGKGAFSKISLVVTIALLTSCCYYFLPWIAKCIRCPSNSTVICPSVDESGDYKSFQCPPGYYNDLASLFLNTNDDAIRNLFSPRIIKEFHITSLFIYFATIYCLGIITYGIAIPSGLFIPVILAGAAYGRLFGRLFETITELDRGLXALXGAASFLGGTMRMTVSICVILLELTNDLLLLPLVMLVLLVSKTVADSFNKGVYDQILKIKGLPYLEAHAEPYMRNLVTRDVVSGPLITFSGIEKVGNILHALHTTGHNGFPVIDEPPFSDAPELCGLVLRSHLLVLLKEKIFSRDRGFANPVIFQRISTLDFXKAGSGKEIN

SEQ ID NO: 1169 - protein, 304 aa, Zea mays
MAAASSAHLFGLGDGQMQMQPQQQQQAPPPPLVNNPAAAAPPPKKKRNQPGNPNPDAEVIALSPKTLMATNRFVCEVCNKGFQREQNLQLHRRGHNLPWKLKQKDPSQAQRRRVYLCPEPTCAHHDPSRALGDLTGIKKHFCRKHGEKKWKCDKCSKRYAVQSDWKAHSKVCGTREYRCDCGTLFSRRDSFITHRAFCDALAQESALLPPTSSLSNLTSHLYGASTNAGNMALSLSQVGSHLTSTLQDGHHHRPSPELLRLGATAGGGGGSSIAARLDHLLSPNGASAFRPAQPPSFFHNAGAS

SEQ ID NO: 1170 - protein, 333 aa, Synechococcus sp. PCC 7942
MSKPDRVVLIGVAGDSGCGKSTFLNRLADLFGTELMTVICLDDYHSLDRKGRKEAGVTALDPRANNFDLMYEQVKALKNGETIMKPIYNHETGLIDPPEKIEPNRIIVIEGLHPLYDERVRELLDFSVYLDIDDEVKIAWKIQRDMAERGHSYEDVLASIEARRPDFKAYIEPQRGHADIVIRVMPTQLIPNDTERKVLRVQLIQREGRDGFEPAYLFDEGSTIQWTPCGRKLTCSYPGIRLAYGPGTYYGHGVSVLEVDGQFENLEEMIYVEGHLSKTDTQYYGELTHLLPQHKDYPGSNNGTGLFQVLTGLKMRAAYERLTSQAAPVAASV

SEQ ID NO: 1171 - protein, 123 aa, Triticum aestivum
MARAPVLLLLALLAAALAAATPAAALGGRGARVGGWGPIPDVRDAHIQELGGWAVEQHARLASDGLRFRRVTRGEQQVVSGMNYRLFVDAADGSGNSAPYVAEVYEQSWTNTRQLTSFKPAAN

SEQ ID NO: 1172 - protein, 388 aa, Saccharomyces cerevisiae
MNCTLTDNTRAINVASNLGAPQQRTIFAKERISIPGYYEIIQFLGKGAYGTVCSVKFKGRSPAARIAVKKISNIFNKEILLKRAIRELKFMNFFKGHKNIVNLIDLEIVTSSPYDGLYCYQELIDYDLAKVIHSSVQLSEFHIKYFLYQILCGLKYIHSADVIHRDLKPGNILCTLNGCLKICDFGLARGIHAGFFKCHSTVQPHITNYVATRWYRAPELLLSNQPYSKSVDIWAVGCILAEFYARKPVFMGRDSMHQIFEIIKVLGTPDKDILIKFGTIKAWNLGKNSNNPVYKKIPWSNIFPFASHEAINLIESLLHWDSTHRLNVEQAISHPFLNEVRKPDDEPVCLQGPFDFTYESELNSMSKLRDYLVEEVKNFKTDLSSSSL

SEQ ID NO: 1173 - protein, 499 aa, Brucella melitensis biovar Abortus
MTDRPIMTTSAGAPIPDNQNSLTAGERGPILMQDYQLIEKLSHQNRERIPERAVHAKGWGAYGTLTITGDISRYTKAKVLQPGAQTPMLARFSTVAGELGAADAERDVRGFALKFYTQEGNWDLVGNNTPVFFVRDPLKFPDFIHTQKRHPRTHLRSATAMWDFWSLSPESLHQVTILMSDRGLPTDVRHINGYGSHTYSFWNDAGERYWVKFHFKTMQGHKHWTNAEAEQVIGRTRESTQEDLFSAIENGEFPKWKVQVQIMPELDADKTPYNPFDLTKVWPHADYPPIDIGVMELNRNPENYFTEVENAAFSPSNIVPGIGFSPDKMLQARIFSYADAHRHRLGTHYESIPVNQPKCPVHHYHRDGQMNVYGGIKTGNPDAYYEPNSFNGPVEQPSAKEPPLCISGNADRYNHRIGNDDYSQPRALFNLFDAAQKQRLFSNIAAAMKGVPGFIVERQLGHFKLIHPEYEAGVRKALKDAHGYDANTIALNEKITAAE

SEQ ID NO: 1174 - protein, 293 aa, Burkholderia fungorum
MLKVTKAVFPVAGLGTRFLPATKASPKEMLPIVDKPLIQYAVEEAMAAGITEMIFVTGRSKRAIEDHFDKSYEIEAELQARGKDKLLELVRSIKPSHVDCFYVRQPEALGLGHAVLCAEKLVGDNPFAVILADDLLYGTPPVMAQMIEVFDHYHSSVIGVEEIPAQETKSYGIVDGKEWEDSIIKMSGIVEKPEPNVAPSNLGVVGRYVLKPRIFEHLRALKPGAGGELQLTDAIQSLLADEQVLAYKYHGTRFDCGSKLGYLKATVEFALRHPEVAADFEEYLRTRSPVLEG

SEQ ID NO: 1175 - protein, 268 aa, Oryza sativa
  unsure (1)..(268): unsure at all Xaa locations
MGRGKVQLKRIENSMNRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIRSRKSHLMLESISELQKKERSLQEENKALQKELVERQKNVRGQQQVGQWDQTQVQAQAQAQPQAQTSFFFFFMLRDQQALLSPQNICYPPVMMGQRNDAAAXAAVAAQGQVQLXRIGGFPPWMLSTFKA

SEQ ID NO: 1176 - protein, 398 aa, Arabidopsis thaliana
MESELKDLNSNSNPPSSKEDRPLLKSESDLAAAIEELDKKFAPYARTDLYGTMGLGPFPMTENIKLAVALVTLVPLRFLLSMSILLLYYLICRVFTLFSAPYRGPEEEEDEGGVVFQEDYAHMEGWKRTVIVRSGRFLSRVLLFVFGFYWIHESCPDRDSDMDSNPKTTSTEINQKGEAATEEPERPGAIVSNHVSYLDILYHMSASFPSFVAKRSVGKLPLVGLISKCLGCVYVQREAKSPDFKGVSGTVNERVREAHSNKSAPTIMLFPEGTTTNGDYLLTFKTGAFLAGTPVLPVILKYPYERFSVAWDTISGARHILFLLCQFVNHLEVIRLPVYYPSQEEKDDPKLYASNVRKLMATEGNLILSELGLSDKRIYHATLNGNLSQTRDFHQKEE

SEQ ID NO: 1177 - protein, 99 aa, Citrus x paradisi
YVFIVDMPGLKSGDIKVQVEDDNVLLISGERKREEEKDGAKYVRMERRVGKFMRKFVLPENANVEAISAVCQDGVLTVTVDKLPPPEPKKPKTIEVKIA

SEQ ID NO: 1178 - protein, 339 aa, Corynebacterium glutamicum ATCC 13032
MPKYIAMQVSESGAPLAANLVQPAPLKSREVRVEIAASGVCHADIGTAAASGKHTVFPVTPGHEIAGTIAEIGENVSRWTVGDRVAIGWFGGNCGDCAFCRAGDPVHCRERKIPGVSYAGGWAQNIVVPAEALAAIPDGMDFYEAAPMGCAGVTTFNALRNLKLDPGAAVAVFGIGGLVRLAIQFAAKMGYRTITIARGLEREELARQLGANHYIDSNDLHPGQALFELGGADLILSTASTTEPLSELSTGLSIGGQLTIIGVDGGDITVSAAQLMMNRQIITGHLTGSANDTEQTMKFAHLHGVKPLIERMPLDQANEAIARISAGKPRFRIVLEPNS

SEQ ID NO: 1179 - protein, 479 aa, Nitophyllum adhaerens
RIKNDRYESGVIPYAKMGYWDPGYVIKETDVLALFRVTPQPGVDPVEASAAVAGESSTATWTVVWTDLLTACDLYRAKAYKVDAVPNTSDQYFAYVSYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSIEAVNRSIAATGEMKGHYMNVTAATMENMYERAEFAKQLGTVIIMIDLVIGYSAIQTMAIWARKNDMILHLHRAGNSTYSRQKIHGMNFRVICKWMRMAGVDHIHAGTVVGKLEGDPLMIRGFYNTLLEPHLDINLPQGIFFKQDWASLRKVTPVASGGIHCGQMHQLLDYLGNDVVLQFGGGTIGHPDGIQAGATANRVALEAMVIARNEGRDYVAEGPQILMDAAKTCGPLQTALDLWKDITFNYTSTDTADFVETPTANV

SEQ ID NO: 1180 - protein, 474 aa, Pseudomonas putida KT2440
MQTQMLINGQLVAGQGPAWTVLNPALGTALAQINEATEAQVDSAVRAADQAFDSWSQTSPKERSQALLALADAIEAHGDELARLESQNCGKPLSAALNDEIPAIADVFRFFAGAARCLGGSAAGEYLPGHTSMIRRDPLGVVASIAPWNYPLMMLAWKIAPALAAGNTVVIKPSELTPLTALRLGELAQDLLPPGVLNILFGRGQTVGNPLITHPKVRMVSLTGSIPTGAHIISATADSVKRMHMELGGKAPVLVFDDADIDAAIDGIRTFGFYNAGQDCTAACRLYVQDGIYERFVERLGKAVASLKPGLQESEETELGPLISAQHRDKVAGLVQRAIAQPHIRLVTGGKPIAGDGFFFEPTVLADALQDDEIVRNEVFGPVVSVTRFTDEAQALEWANDSNYGLASSVWTRDTGRAHRLAARLQYGCTWVNTHFMLVSEMPHGGQKHSGYGKDMSMYGLEDYTCVRHVMIKH

SEQ ID NO: 1181 - protein, 639 aa, Pyrobaculum aerophilum str. IM2
MAKRVIFHELVSLDQASEILLKFARPLGEEEVDIAQAYGRMLARDITAPIDVPPFDRSTVDGYAVVAEATYGASELTPVEFKLVGRVEAGDWPAGEVKPGEAFEVATGAPLPRGANAVVMVEFTQTRGDLVKIFRAVAPGENVMSAGSDISAGEVVLRHCTKLTAREIGVLAALGLRKVPVMKRPIVGIISTGNELAAPGERLGPGMLYDVNSYSLAAAVQEAGGLPVIYGIVRDEESSYKSALLKALSESDVVLISGGTSAGVADLTYRVLGELGDVLFHGVMVRPGKPTLAAVINGKIVVGLPGYPSSALMIFHTVVRPFLLKLQCVEPSPPAVYKAKLAYGVEGAKGRRALYPVVLIARKDGYKAYPLYAESGAISVLARADGYIVIPENVEFMTEGEEVDVYLFEKFKPAELYFIGSHDPHLDTILARHNVKTVYVGSMGGLMSIKRGEADFAGTHILDLETGVYNVPVVQRLGIKGAAVIGLYRREQGLIIQRGNPKGIKGVEDLLRDDVVYVNRPRGTGTRALLDIHLSKLAQRLGTPFEELIRKIRGYTYEVKTHTAVAAAVAQGRADVGMGVRYAAELYGLDFIPLGWEEYDLVVRVDVLDKVFEIVREALENLPRGYEKYEMSGRVKWEG

SEQ ID NO: 1182 - protein, 367 aa, Thermus thermophilus
MVKETHRFETFTEEPIRLIGEEGEWLGDFPLDLEGEKLRRLYRDMLAARMLDERYTILIRTGKTSFIAPAAGHEAAQVAIAHAIRPGFDWVFPYYRDHGLALALGIPLKELLGQMLATKADPNKGRQMPEHPGSKALNFFTVASPIASHVPPAAGAAISMKLLRTGQVAVCTFGDGATSEGDWYAGINFAAVQGAPAVFIAENNFYAISVDYRHQTHSPTIADKAHAFGIPGYLVDGMDVLASYYVVKEAVERARRGEGPSLVELRVYRYGPHSSADDDSRYRPKEEVAFWRKKDPIPRFRRFLEARGLWNEEWEEDVREEIRAELERGLKEAEEAGPVPPEWMFEDVFAEKPWHLLRQEALLKEEL

SEQ ID NO: 1183 - protein, 394 aa, Zea mays subsp. mays
  unsure (1)..(394): unsure at all Xaa locations
LGAERRARLPPGEMGWPLVGGMWDFLRAXKSGKPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVNMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAXTFL

SEQ ID NO: 1184 - protein, 437 aa, Saccharomyces cerevisiae [sequence omitted]

SEQ ID NO: 1185 - protein, 169 aa, Chloroflexus aurantiacus
MSHQEHRRLAETQTTAIPCAVLTISDSRSEATDDSGRYICTALTQAGHNVVQYAVVRDEPAQIVEMVRRFAAEGCKVIITNGGTGISRRDSTFEAIDALLEKRLPGFGELFRMLSFAEIGPAAMLSRATAGVFGGTLIFCLPGSPNAVQLGIDRLILPELAHLVWETVR

SEQ ID NO: 1186 - protein, 347 aa, Zea mays
  unsure (1)..(347): unsure at all Xaa locations
LGTSRPAGRLRLPLARIIPPRERGRLLVPRLPRPRTLASALPTAAATLEWPRRRHPSRPPTSPQSRRCPLPPSHISFASAAPAAXAQRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFDVCFRQMKAFADSISNWADVVIAYEPVWAIGTGKVATPEQAQEVHAAVRNWLKTNISPDVASSTRIIYGGSVNAANCAELAKKEDIDGFLVGGASLKGPDFATIINSVTAKKVAA

SEQ ID NO: 1187 - protein, 61 aa, Glycine max
EDLVYVGKLVAGSFAGGAAIKYGSALFPEITTPNLVVALLLILTPVLVAVFLLIKESRTNP

SEQ ID NO: 1188 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFQPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 1189 - protein, 281 aa, Glycine max
  unsure (1)..(281): unsure at all Xaa locations
MAATSSLCSSTLQSQINGFFLHKTSLSHTPSLTFSRRKISTTVKATSRVDKFSKSDIIVSPSILSANFSKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAKAGVVLNPGTPLSAIEYILDVVDLVLIMSVNPGFGGQSFIESQVKKISDLRRLCAEKGVNXPWIEVDGGVGPANAYKVIEAGANALVAGSAVFGAKDYAEAIRGIKTSKRPEVVAV

SEQ ID NO: 1190 - protein, 184 aa, Lilium hybrid division I
MDRKVGTNEDVEVRKGPWTMEEDLILINYIANHGDGVWNTLARSAGLKRTGKSCRLRWLNYLRPDVRRGNITPEEQLLIMELHDRWGNRWSKIAKELPGRTDNEIKNFWRTRVQKKSKNGESSEGQISMLSDETSAMQMEDVDVGVSQTSYDQGQTSNNLDAFEIPFEPGDNLLSVEELWAMQY

SEQ ID NO: 1191 - protein, 381 aa, Saccharomyces cerevisiae
NSARVTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLMATTAGLGVSTPDRALLYVICCLWVLITKLDLRRSDWKPLIMPQELAQEAVGDKKLGANVRPRASCQQLQAASRGYQENLWLFGPNNNITEVGTMNAFFVFKDSKTGKKELVTAPLDGTILEGVTRDSILNLAKERLEPSEWTISERYFTIGEVTERSKNGELLEAKGSGTAAIVSPIKEIGWKGEQINIPLLPGEQTGPLAKEVAQWINGIQYGETEHGNWSRVVTDLN

SEQ ID NO: 1192 - protein, 262 aa, Picea abies
RLAEPYKGIGDCFGRTIKDEGFIALWRGNTANVIRYFPTQALNFAFKDYFKRLFNFKKDRDGYWKWFAGNLASGGAAGASSLLFVYSLDYARTRLANDSKAAKKGGERQFNGLVDVYKKTLKSDGIAGLYRGFNISCVGIIVYRGLYFGMYDSLKPVVLTGDLQNNFLASFLLGWGITIGAGLASYPIDTVRRRMMMTSGEAVKYKSSLDAFNQIVKNEGTKSLFKGAGANILRAIAGAGVLAGYDQLQLILLGKKYGSGGG

SEQ ID NO: 1193 - protein, 440 aa, Oryza sativa (japonica cultivar-group)
MWPAAAASLHVLVLPPLPPPGCRTRRAAPVLARRGRGVRHAARRDTPPNPVDAVDCVGTGADVECYVDDRPGAEVGPIRREATPPPSPQDAVDCVGTGTDVECFVDGPGAGAGVGAEPLLARVSEEEEDGVSASAAALVGREWWEWASLVSPFFFWGTAMVAMKGVIPKTGPFFVAALRLLPAGALLVAFAAARGRRQPSGWAAWVAVAAFGLVDAACFQGFLAEGLQKTSAGLGSVIIDSQPLTVAVLAALLFGESIGAIGVGGLVLGVVGLLLLEVPALSVEGNDTAIWGSGEWWMFLSAQSMAVGTIMVRWVSKYSDPIMATGWHMIIGGLPLLVISVLNHDPALNGHLQELTLNDVLALLYTSIFGSAISYGVYFYNATRGSLTTLSSLTFLTPMFASIFGFLYLGETFSPVQLGGALLTLVAIYMVNYKSIVGEK

SEQ ID NO: 1194 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 1195 - protein, 423 aa, Batrachospermum helminthosum
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERYLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGRDFVNEGPQILRDAAKTCGPLQTALDLWKDISFNYTSTDT

SEQ ID NO: 1196 - protein, 488 aa, Phaeostroma pustulosum
  unsure (1)..(488): unsure at all Xaa locations
MPEDVQXRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLXITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 1197 - protein, 298 aa, Cyanidioschyzon merolae
MFVTLGVPSRAVSSKAESYAQRLRIVRTARTRLFMSAQSARKFFVGGNWKCNGSKQSVQELCEAFNAGKNIDFNRVEVVVAPPSVYAMLTRSILRPDFGVALQNCWVGKPGAFTGEVAVEMIRDIGLSHVILGHSERRHLPEIRESDDVIGRKTKYAIDKGVHVILCIGELLEEREAGRTREVNERQLSAVRAHLSADDWAKVVIAYEPVWAIGTGKVATAAQAQEAHSEIRSWIRRQVSEACASQMRILYGGSVTPENCLELAAQPDVDGFLVGGASLKPTFLDIVRAYQAKETVSV

SEQ ID NO: 1198 - protein, 469 aa, Porphyra cuneiformis
VIRYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKNDMILHLHRAGNSTYSRQKNHGMNFRVICKWMRMAGVDHIHAGTVVGKLEGDPLMIKGFYNTLLESDTEINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 1199 - protein, 479 aa, Novosphingobium aromaticivorans
MTQIEHWIGGTAVAATGGAYFDDLNPVDDSVYSRVPAGTAEDVNRAVENAHQAYLQHRDLPAAVREGWIAKAAEIMERDTAKFADVLVDEIGSPIAKAGFETRFAVSFLRAAIGVPRRIRGETIPSDTPGRFSMSLRQPVGVVAGITPFNVPLIKGIKQSAMALATGNAFVLLPSEAAPMIADLLAKLWKEAGVPDGLFNVVYGNGAEIGDVLTGHPKVASITFTGSSRVGKHIAEIAARNLKKYTLELGGKSPLVICADADLDKAVNAALFSIFMYQGQVCMGASRIYVERSIFDQFTKAFAAATGRANSGDLRDPTTMLGPIISERQRDRVRRHIDDARSKGAAVLAGGEWSGNSCAATILSGVTAEMTVFEEETFGPVTSLFPFDTLEEALELANNTEYGLSASIFTRDLDKALAFAQRAEAGMVHINAPTLHDEPHVPFGGTKASGFGREGTEADLEIMTEWKWVTIQSATEGGH

SEQ ID NO: 1200 - protein, 631 aa, Alicyclobacillus acidocaldarius [sequence omitted]

SEQ ID NO: 1201 - protein, 173 aa, Triticum aestivum
MAPAVMASSATTVAPFQGLKSTAGLPVSRRSSEPRPRHNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVNGFDNLRQVQCVSFIAFRPPGCEESGKA

SEQ ID NO: 1202 - protein, 228 aa, Haemophilus somnus 129PT
MTPYLIAPSILSANLARLGEDVENVLKSGADVIHFDVMDNHYVPNLTFGPAICKALRDYGIKAPIDVHLMVKPVDRIIPDFAKAGADYITFHPEASEHIDRSLQLIRDCGCKAGLVFNPATPLSYLDYVLDKIDVILLMSVNPGFGGQAFIPSTLEKLKQARKIIDESGLDIRLEVDGGVKVNNIAEIAQAGADMFVAGSAIFDQPDYKKVIDEMRQQLSTIREKETK

SEQ ID NO: 1203 - protein, 207 aa, Oryza sativa
MSRRYDSRMTIFSPEGRLYQVQYAMEAIGNAGSALCVLAADGVVLVGEKKVTSKLLQTSCSAEKMYKIDSHLACAVAGIMSDANILFNTGRLHAQRYILSYQEPIPVEQLIQSLCHTKQGYTQFGGLRPFGVSFLFGSGWKAAAVGANSQATKSMLKQLLPLPSPRHPSPAADALLPPAKSEKGERDEEGRKEGKGKRERELADVAA

SEQ ID NO: 1204 - protein, 641 aa, Ricinus communis
MISLKNSFLSGSCSSPVPGKQRAGLVVPTAPSSLKVVALNPNRERNGSIMMESTLQEMRDGASVLDLDPKSTVAGGVRDVYGEDTATEDQFVTPWSLSVASGYSLLRDPHHNKGLAFNDKERDAHYLRGLLPPAIVSQELQVKKMMHIIRQYQLPLQKYMAMMDLQERNERLFYKLLIQNVEEMLPIVYTPTVGEACQKYGSIFGRPQGLYISLKEKGRILEVLRNWPEKNIQVIVVTDGERILGLGDLGCQGMGIPVGKLSLYTALGGVRPSSCLPVTIDVGTNNEKLLNDEFYIGLRQRRATGQEYAELLHEFMTAVKQNYGERVLVQFEDFANHNAFDLLAKYGTTHLVFNDDIQGTASVVLAGLVAALKLVGGSLADHRFLFLGAGEAGTGIAELIALEMSKQTNMPVEETRKKIWLVDSKGLIVSSRMDSLQHFKRPWAHEHEPIKTLLDAVNDIKPTVLIGTSGVGRTFTKEVVEAMASFNEKPIILALSNPTSQSECTAEEAYTWSQGRAIFASGSPFAPVEYEGKVYVPGQANNAYIFPGFGLGLIMSGTIRVHDDMLLAASEALAAQVTQENFDKGLIYPPFTNIRKISANIAANVAAKAYELGLASRLPQPKDLVKYAESCMYSPAYRSYR

SEQ ID NO: 1205 - protein, 322 aa, Streptococcus pneumoniae TIGR4
MSTLDKNLLLEMFRKMEEIRRMDLKIAQLVKKGKVPGMTHFSVGEEAANVGAMLALNPDDLITSNHRGHGQAIAKGIDLNGMMAEILGKYTGTCKGKGGSMHIADLDAGNLGANGIVGGGMGIAVGAALSQQMQNTGKIVVCFFGDGATNEGVFHEAVNMASIWNLPVIFYCINNGYGISADIKKMTNIEHIHQRSAAYGIPGMFIEDGNNVIDVYEGFQKAVDHVRSGNGPVLIESVTYRWLGHSSSDPGKYRTREEVELWKQKDPIENLRNYLIENNIASAEELEEIQAQVKEAVEASVKFAEESPFPPLESAFEDIYAD

SEQ ID NO: 1206 - protein, 205 aa, Juglans regia
KRRNGLLKKAYELSVLCDAEVALIVFSSRGRLYEYANNSVKSTIDRYKKARADSSNTGSVSEANTQFYQREAATLRQQINSVQESNRKMLGESLSGMAFRDLKSLESKLESGIRRIRSKKNELLFAEIEYMQKREVDLHNNNQLLRAKIAENERNQQNLNVMPGGGNLELMHSQPFDSRNYFQVDALQPNHDQYPRQDQMALQLV

SEQ ID NO: 1207 - protein, 226 aa, Nitrosomonas europaea ATCC 19718
MYRIAPSILSANFARLGEEITQVLDSGADIIHFDVMDNHYVPNLTIGPLVCEAIRPLTQAMIDVHLMVEPVDRIIPDFAKAGANIISFHPEASRHIDRTIGLIKEQGCKAGLVFNPATPLSYLDHVLDKLDLILIMSVNPGFGGQTFIPEALNKLRLTRERITASSRDILLEIDGGVKVDNIAEIARAGADTFVAGSAIYGAGKESDPHRYDSIIAAMRAELAKVA

SEQ ID NO: 1208 - protein, 213 aa, Oryza sativa
MRRDGHEDGERSQGIEDSLMFGPDDDNGSNIPTQVETLVRGTATVATPEYKSIPDLDYLQELLAIQQQGPRAIGFFGTRNMGFMHQQLIEILSYAMVITKNHIFTSGASGTNAAVIRGALRAEKPELLTVILPQSLKKQPPESQELLSKVQNLIEKPQYDHLPLIEASRLCNMDIISKVQQVICFAFHDSKLLMETCQEAKNLRKIVTLFYLD

SEQ ID NO: 1209 - protein, 304 aa, Prochlorococcus marinus subsp. pastoris str. CCMP1378
MQEFLPYAWFEGKCIPFKDAKVSIATHALHYGTAAFGGMRAIPNPSNKDEFLLFRTDKHVKRLSQSARLLLTEISEEYIFNALKTILKKNKPSKPIYIRPFVYTSDLGIAPRLHNIETDFFIYCIELGDYLSPDGVSCRMSSWTRQEDRSLPLRGKISGAYITSSLAKTEASLSGFDEALLLNSSGKVSEASGMNLFIVRNGELITPGVDQDILEGITRASVIELAKSFGINVIERPVDKTELLIADEVFLTGTAAKITPVKQIESTNINNYRPIMTKLKNKLIEITEGRSQDYDDWITRIDIS

SEQ ID NO: 1210 - protein, 409 aa, Arabidopsis thaliana
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVAALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPATV

SEQ ID NO: 1211 - protein, 271 aa, Oryza sativa
MALPLHDATTSPSDPDDLGGGGEEEEERLASKPLLSSPSTYPSAGTEEGVEELELDRRYAPYARRDAYGAMGRGPLGAAGAGRLAVGAAVLFPLRLAAGVLEEEREGGGGGAAGEVEGDGYARLEGWRREGVVRCGRALARAMLFVFGFYWIREYDCRFPDAEDEHQEQSKELGRPGAVVSNHVSYVDILYHMSSSFPSFVAKARHVFLLLCQFVNNLEVIHLPVYYPSEQEKEDPKLYANNVRKLMAVEGNLILSDLGLAEKRVYHAALN

SEQ ID NO: 1212 - protein, 337 aa, Claviceps purpurea
MAVKVGINGFGRIGRIVFRNAVEHPEIEVVAVNDPFIDPEYAAYMLKYDSSHGVFKGEIKKDADGLIVNGKKVKFHTERDPSAIPWKASGAEYIVESTGVFTTTEKAKAHLTGGAKKVIISAPSADAPMYVMGVNEKTYDGKADVISNASCTTNCLAPLAKVIHDKYTIVEGLMTTVHSYTATQKTVDGPSGKDWRGGRGAAQNIIPSSTGAAKAVGKVIPDLNGKLTGMSMRVPTPNVSVVDLTVRIEKGATYDEIKATVKEAANGSLAGILGYTEDDIVSSDMNGNTNSSIFDAKAGISLNKNFVKLIAWYDNEWGYSRRVLDLLAYVAKADASK

SEQ ID NO: 1213 - protein, 188 aa, Bacteroides thetaiotaomicron VPI-5482
MKILLLDNYDSFTYNLLHAVKELGATDVEVVRNDQINLDEVERFDKIILSPGPGIPEEAGLLLPIIKRYAPTKSILGVCLGHQAIGEAFGARLENLKEVYHGVQTPISILQKDVLFEGLGKEIPVGRYHSWVVSREGFPECLEITAESQEGQIMALRHKTYDVHGIQFHPESVLTPQGKEIIKNFLNE

SEQ ID NO: 1214 - protein, 317 aa, Pseudomonas fluorescens PfO-1
MCVRGVEVSVSRRSADGFALQVMIGLCLIWGVQQVMIKWAATDIAPVMQAAGRSGISALLVGLLICWKGGWDQVGATWRGGLLAGALFGLEFLFISEGLQLTTAAHMSVFLYTAPIFTALGVHFLLPSERLRPVQWLGIFMAFVGIAVAFAGGVSWDNLDRRMLMGDALGVLAGASWGATTVVVRASRLSEAPVTLTLFYQLIVGFIGLLLIALLSGQITHVSLTVVAVGSVLFQGLVVSFFSYLTWFWLLRRYLAANLAVFSFMTPLFGVTFGVVLLGEELSLNFIIGAVLVLLGITFVSAEQWVRRRLRKALGQP

SEQ ID NO: 1215 - protein, 496 aa, Trichodesmium erythraeum IMS101
MLRKLMDKNWFSRFRYFCLFLGTIVVLIGCQVALANGGSDDFVKVDNIWLLLAGALVFFMNAGFALLEAGFCRSDNSVNVLAKNLIVFCVAAIAFWMFGFGLMFGDSSYHLPCRGNFEQKNEKVQSYHGHFSPTMEYNEFEQKSQFILPPKNDTPLGYPSKGFSCLQRQFPKRSIASIFFFQLAFAGTAATIVSRAVAEKMKLWVFFCFSFILVGFLYPIVGHWVWSEYGWLKQGLNFIDFAGSTVVHTVGGTAALAVAILLKPRWSWLGYDPWEDLETDEGSEALSPQGQKESYDQRNLTSATLGCLILWLGWLGFNGGSTTELKEVGHIIITTIMSAATGGIIAILLSPLFSQRSSNNSEIGKLDLSSLINGILGGLVGITASAAYVDIPIAIFIGAVSGVVVVLTRKLLKWIKLEDPLGAIPVHLFCGCWGTIAVSFSLRGTIVYEKTYNFLERLEWQFSGWGVVFITTFLVSCIIWIFIGLTLYLFEKILRK

SEQ ID NO: 1216 - protein, 607 aa, Oryza sativa
  unsure (1)..(607): unsure at all Xaa locations
KLGSDGRLRIISYALVNSSAPVGGDFIAPAGDCDLPLQCPSLGYCSPAGNGSTCTCPPLFAASVTVAGSCTPGDGSTLASPAACQNNDSSSGGASVSYIALKPLTSYFATKFDAPTNTGVNKTACRALCTASCACLGFFHDSVSLSCRLIGGKQLGSLYKGASDTNLGYIKTFNSATKAGSNQIGSSSANHTVPIVLPSVAAFLLLAVLGWYIWWRNKMSKNGRKKKGKSSTMKVYFGGGDDDDIVIPGMPARFSYQEITTMTSNFATKVGSGGFGTVYKGELPGGEGLIAVKKLEAAGVQAKREFCTEITIIGNIRHVNLVRLRGFCAEGSRRLLVYEYMNRGSLDRSLFGRTGPVLEWGERMEVAIGAARGLAYLHTGCEQKIVHCDVKPENILLANGGQVKISDFGLAKLMSREQSALFTTMRGTRGYLAPEWISNAAISDRADVYSFGMVLLELIHGRKNXASRRRRRRPTTSPSAMTSTASGTSGGGDEYFPMLALELHEQRRYLDLVDARLEGRVDEAEAARTVRVALCCLHEDPALRPSMATVVRILEGSVPPPEPRVEALGFLRLYGRSYPLPVPGSLTAMAGGGSHLDESLKDTSAPR

SEQ ID NO: 1217 - protein, 180 aa, Butyrivibrio fibrisolvens
MKKVEDYIRTIPDFPEPGIMFRDVTSILQDAEGFKLAIDEMIKLLDGVDCDVIAGAESRGFIFGAPLAYALGKPSVLVRKKGKLPCETIEKTYDLEYGTATIEMHKDAIKPGQKVVVVDDLIATGGTIEAACQLIEELGGEVSKIVFLMELAGLNGREKLKYDVASVCYLRGKIITDFLG

SEQ ID NO: 1218 - protein, 268 aa, Thermoanaerobacter tengcongensis
MAIAFITGATDGIGREVAKRLAFHGYDVIIHGRNELKLEKVADEIRDLTGKSVFKIKADFSSLKDLKKLVKEIKDNFSKVDLLLNNAATFEKERKVTEEGFERTFMVNYLAPFYLTISLINEGVDIKYVLNVSSMAHASSIEFEDLQLEKGYDGYKAYSLSKLYITLFTYYLAEMLKGKIYVNCLHPGVINTKLLMENWGAIGASIEEGAKNVIDAIKYIEAHNVTGVYFDNGKPSKSKPITYDREVQRKLWEKTLKLLKINERDLKF

SEQ ID NO: 1219 - protein, 175 aa, Glycine max
  unsure (1)..(175): unsure at all Xaa locations
LSLSSHLTSAPVLSSSLPPEAAASLLSARIAMAAAADSKIDNLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIXIQIESLNKKYGCXGPLLLMNSFNTHDDT

SEQ ID NO: 1220 - protein, 118 aa, Glycine max
  unsure (1)..(118): unsure at all Xaa locations
QTKRFSSIIGAVNCSSENFKVQSPNVKDTVTDIQFVYIYETKKLVHENRSGTYHWIVIPKPENYQFKTISERAKLGGEKSVXCGVNNGCTITCGVIANREGISXTTKDKRGEANHFGS

SEQ ID NO: 1221 - protein, 249 aa, Oryza sativa
MGRGRVELKRIENKINRQVTFAKRRNGLLKKAYELSVLCDAEVALIIFSNRGKLYEFCSTQSMTKTLEKYQKCSYAGPETAVQNRESEQLKASRNEYLKLKARVENLQRTQRNLLGEDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEAMNSACMNTYMPPWLP

SEQ ID NO: 1222 - protein, 465 aa, Ferroplasma acidarmanus
MLLNSMILYYTTIPDSTSWLNTGNNGWMLTASTLVGLMSIPGLAIYYAGLTKRKYMVNAMMMALYAFAAVLIIWILAGYNFGFGTSSLLKIDGYYIFGIPSPAGAGSFISGQAIVGPLKDALTIPNSTVMFFQFVFAAITPILLLGGILERMNFKAWMIFVPIWSLIVYSPVAYWLFAGGWLNQLGAVDFSGGYVIHLDAGIGALAAAFVIGPRLKDEMKMKANNLGLVMLGLGLIWLGWDGFNGGDPYGATIDAGIAIINTNVATAVSMMTWMFMDLKFFKKPSLIGASVGAIAGLVGITPAAGYVNIYGAMVIGIATGIIPWIFLYKIEPKFKVDDSLGVFSSHAVAGVVGGLLTGVLADPVVTQYIDPGLRGALYGNFYELGIQAFAAVIVILYVFALTYGLLRLIGVFIPLRETNARLKIGDMAIHGEAGLDITGYPPSPPMHAIEHNNIHMEGNEKIDKD

SEQ ID NO: 1223 - protein, 501 aa, Lotus japonicus
MALPECSAANLAQLIGPNATDAAAVAGFICDQFTAVGQRFSDTAFAVDSTYLLFSAYLVFSMQLGFAMLCAGSVRAKNTMNIMLTNVLDAAAGGLFYYLFGFAFAFGAPSNGFIGRHFFGLKDVPTVAFDYSYFLYQWAFAIAAAGITSGSIAERTQFVAYLIYSSFLTGFVYPVVSHWFWSGDGWASATNTGNLLFGTGVIDFAGSGVVHMVGGVAGLWGALIEGPRIGRFDHAGRAVSLRGHSASLVVLGTFMLWFGWYGFNPGSFTKILSAYDSGNYYGQWSAIGRTAVTTTLAGCTAALTTLFGKRIISGHWNVTDVCNGLLGGFAAITAGCSVVEPWAAIVCGFVAAVVLIACNMLAEKVRYDDPLEAAQLHGGCGAWGIIFTALFAKEEYVNQVYPGKPGRPYGLFMGGGGKLLGAHVIQILVIIGWVSATMGPLFFILNKMKLLRISTEDELAGMDLTRHGGFAYAYEDDESHKPGIQLRKIEPNSSSTPSAES

SEQ ID NO: 1224 - protein, 314 aa, Mesorhizobium ciceri
  unsure (1)..(314): unsure at all Xaa locations
VMFDGSSIAGWKAITKSDMVLMPDPETVHMDPFFAQSTMVILCDILDPVSGESYNRDPRGTAKKAEAYMKAEGIGDTIFVGPEAEFFVFDDVKYKADPYXTGFKLDSTELPSNDDTDYETGNLGHRPRIKGGYFPVPPIDSAQDMRSEMLTVLAEMGVRVEKHHHEVAAAQHELGIKFDALVRNADKMLIYKYVVHQVANAYGKTATFMPKPIFGDNGSGMHVHMSIWKNGKPTFAGNEYAGLSESCLFFIGGVIKHAKAINAFTNPLTNSYKRLVPGYEAPVLLAYSARNRSASCRIPFGSSPKAKRVEVRFP

SEQ ID NO: 1225 - protein, 289 aa, Vibrio cholerae
MKGIILAGGSGTRLYPLTRGVSKQLLPIYDKPMIYYPLSTLMLAGIRDILIITTPEDNEAFRRLLGNGSDFGINLSYAVQPSPDGLAQAFIIGEEFIGNSNVCLVLGDNIFYGQSFSKTLKNAATRPTGATVFGYQVKDPERFGVVEFDADMKAVSIEEKPAKPKSNYAVTGLYFYDNKVVELAKEVKPSHRGELEITTLNDMYLKAGELNVELLGRGFAWLDTGTHESLHEASSFVQTIEHVQGLKVACLEEIAFRNGWLSADELKNIAKLMLKNEYGQYLAQLADKK

SEQ ID NO: 1226 - protein, 364 aa, Agrobacterium vitis
MREYKIAAIPADGIGPEVIAAGLQVLEALEKRSGDFSIHTETFDWGSDYYKKNGVMMPADGLEQLKKFDAIFFGAVGAPDVPDHITLWGLRLPICQGFDQYANVRPTKVLPGITPPLRNCGPGDLDWVIVRENSEGEYSGHGGRAHKGLPEEVGTEVAIFTRVGVTRIMRYAFKLAQARPRKLLTVVTKSNAQRHGMVMWDEIAAEVSKEFPDVTWDKMLVDAMTVRMTLKPQSLDTIVATNLHADILSDLAGALAGSLGVAPTANIDPERRFPSMFEPIHGSAFDITGKGIANPVATFWTAAQMLEHLGEKDAATRLMSAVERVTEAGILTPDVGGTADTQQVTDAVCEAIAGSNILNMAAVG

SEQ ID NO: 1227 - protein, 542 aa, Mycobacterium tuberculosis CDC1551
MRAAGISVVCGLPTSRLDSLLVRLSRDAGFQIVLARHEGGAGYLADGFARASGKSAAVFVAGPGATNVISAVANASVNQVPMLILTGEVAVGEFGLHSQQDTSDDGLGLGATFRRFCRCSVSIESIANARSKIDSAFRALASIPRGPVHIALPRDLVDERLPAHQLGTAAAGLGGLRTLAPCGPDVADEVIGRLDRSRAPMLVLGNGCRLDGIGEQIVAFCEKAGLPFATTPNGRGIVAETHPLSLGVLGIFGDGRADEYLFDTPCDLLIAVGVSFGGLVTRSFSPRWRGLKADVVHVDPDPSAVGRFVATSLGITTSGRAFVNALNCGRPPRFCRRVGVRPPAPAALPGTPQARGESIHPLELMHELDRELAPNATICADVGTCISWTFRGIPVRRPGRFFATVDFSPMGCGIAGAIGVALARPEEHVICIAGDGAFLMHGTEISTAVAHGIRVTWAVLNDGQMSASAGPVSGRMDPSPVARIGANDLAAMARALGAEGIRVDTRCELRAGVQKALAATGPCVLDIAIDPEINKPDIGLGR

SEQ ID NO: 1228 - protein, 334 aa, Clostridium thermocellum
MKNRVISLLMASLLLVLSVIVAPFYKAEAATVVNTPFVAVFSNFDSSQWEKADWANGSVFNCVWKPSQVTFSNGKMILTLDREYGGSYPYKSGEYRSKSFFGYGYYEVRMKAAKNVGIVSSFFTYTGPSDNNPWDEIDIEFLGKDTTKAQFNWYKNEVGGNEYLHNLGFDASQDFHTYGFEWRPDYIDFYVDGKKVYRGTRNIPVTPGKIMMNLWPGKGVDEWLGRYDGRTPLQAEYEYVKYYPNGVPQDNPTPTPTIAPSTPTNPNLPLKGDVNGDGHVNSSDYSLFKRYLLRVIDRFPVGDQSVADVNRDGRIDSTDLTMLKRYLIRAIPSL

SEQ ID NO: 1229 - protein, 522 aa, Metarhizium anisopliae
MPSLGFLKKKRTRDSNPDPSTSTPTSPVAATSPSKPFDSSTLQQRTSGSQAKTAPGTAPAPSQGSAATAAPASQQQQMNPANAQGGTFVTPLPMQTNQADSQSLPSINNLIHQPQNGASTNNYSSFNPAALGAQISHPPSASPGTDPGHMQQQQQQAYPQPAMQPQQQAGHLPDQQQQQYQQQQHEQRVHHQHQGSVTRVTKGKYSLGDFDILRTLGTGSFGRVHLVQSKHNQRFYAIKVLKKAQVVKMKQVEHTNDERRMLSDVKHPFLITLWGTFQDWKNLYMVMDFVEGGELFSLLRKSGRFPNPVAKFYAAEATLALEYLHSKNIIYRDLKPENLLLDRHGHLKITDFGFAKRVPDKTWTLCGTPDYLAPEVVSNKGYNKSVDWWSLGILIYEMLCGYTPFWDSGSPMRIYENILKGKVKYPAYINTDAQNLLERLITSDLTKRLGNLYGGSQDVKNHPWFSEVTWDRLARKDIDAPYTPPVKAGTGDASQFDRYPEDPEKYGGIGGSDEYGHMFTDF

SEQ ID NO: 1230 - protein, 444 aa, Glycine max
MATIVSINARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVFLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 1231 - protein, 90 aa, Oryza longistaminata
DAKARYVKFHWKPTCGVSCLMDDEATLVGGKNHSHATQDLYDSIAAGNFPEWKLFVQVIDPEEEERFDFDPLDDTKTWPEEEVPLRPVGR

SEQ ID NO: 1232 - protein, 443 aa, Chondracanthus teedii
VSPQPGVDPVEASAAVAGESSTATWTIVWTDLLTACDLYRAKAYKVDPVPNVSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRSIAAAGETKGHYLNVTAATMEEMYERAEFAKELGSIIVMIDLVIGYTAIQTMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMVIARNEGRDYVAEGPQILQDAAKTCGPLQTALDLWKDITFNYTSTDTADFVETPTANV

SEQ ID NO: 1233 - protein, 520 aa, Brassica napus
MESSISQTLSQVIDPTTGILIVVSLFIFIGLITRRRRPPYPPGPRGWPIIGNMSMMDQLTHRGLANLAKKYGGLCHLRMGFLHMYAVSSPDVAKQVLQVQDSVFSNRPATIAISYLTYDRADMAFAHYGPFWRQMRKVCVMKVFSRKRAESWASVRDEVDKMIRSVSSNVGKSINVGEQIFALTRNITYRAAFGSACEKGQDEFIRILQEFSKLFGAFNVADFIPYFGWIDPQGINKRLVKARNDLDGFIDDIIDEHMKKKENQNSVDAGDVVDTDMVDDLLAFYSEEAKLVSETADLQNSIKLTRDNIKAIIMDVMFGGTETVASAIEWALTELLRSPEDLNRVQQELAEVVGLDRRVEESDIEKLTFLKCTLKETLRLHPPIPLLLHETAEDTEIDGYFVPKKSRVMINAFAIGRDKNSWVDPETFRPSRFLEPGVPDFKGSNFEFIPFGSGRRSCPGMQLGLYALELAVAHILHCFTWKLPDGMKPSELDMSDVFGLTAPKATRLYAVPSTRLICSV

SEQ ID NO: 1234 - protein, 283 aa, Glycine max
  unsure (1)..(283): unsure at all Xaa locations
MAVADPGFHFQHLQSSLTANTKVWNFFKLPFRHSATTNTTPSSANLHHLHHHHHNHHHHHHHHHNPXIVPLEGSTSHTSNSVSSVARSLLPTRRRLKLDPSNKLYFPYEPGKQVXRSAIRIKNTSKSNVAFKFQTTAPKSCFMRPPGAILAPGESIIATVFKFVEQPENNEKPEKTGLKFKIMSLKVKGLIDYVPELFDEQKDQVAVEQILRVVFLDPERPCPALEKLNRQLADADAALEARKKPAEDAGPKIIGEGLVIDEWKERRERYLAKQQGEVAVDSV

SEQ ID NO: 1235 - protein, 190 aa, Triticum aestivum
  unsure (1)..(190): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATXXNKVEEVKKEYLTLCPHIGSTHAQVHASLASSNCKIRKAKHSRRHLMHAPECLVPPLLLFPK

SEQ ID NO: 1236 - protein, 138 aa, Glycine max
MAAPTPIQKTEEEWKVILSPEQFRILRQKGTELKGTGEYNKFYEEGIYNCAGCGTPLYKSSTKFDSGCGWPAFFEGFPGAIDRSPDPDGRRTEITCAACGGHLGHVFKGEGFKTPTDERHCVNSISVKFVPGNASSSI

SEQ ID NO: 1237 - protein, 209 aa, Orchis italica
MGRGNTEIKRIENSTNRQVTFSKRRSGIIKKAREISVLCDAQVSLVIFSSLGKLSEYCSPSTTLSKMLERYQQNSGKKLWDATHENLSAEIDRIKKENDTMQIELRLKGEDLNSLTPKELIPIEEGLQNGLTSVREKQMDFLKMLKKNERMLEEENKRLKYLLQHQQLAIEGSMRELEISYHQKDPEYADQMPMTFRVQPFQPNLHGNN

SEQ ID NO: 1238 - protein, 373 aa, Desulfovibrio vulgaris subsp. vulgaris (strain Hildenborough)
MTAPSMSRPDDVRPEVLDFKPYVPGLSIDEIRDRFGLADVVKLASNENPLGTSPVVQRTLKTKADLAFRYAQSGNPRLTRAIAAHHGVAPERVVAGNGSDEIIDLLIRVRATPGKHNIVAFRPCFSIYELQAKFCGLEFRQADLRPDFTFDWDAFLAATDENTAIAFVTTPDNPSGWCPPVSELEHVARTLPPSCLFVIDEAYMDFCGDEAAHSLLSRLDAFPNIAVLRTFSKSFGLAGLRLGYGILPERLADYLHRVRLPFSVNILAEEAGLAALEDTVFRSETLRVTAEGRAYIAEGLTALGCEVMPSWANFIMFRPPTDATDLFEALLRRGIIIRPLKSYGLPQHLRVSVGNADENRRFIEACKEILPHA

SEQ ID NO: 1239 - protein, 398 aa, Simmondsia chinensis
MALKLHHTAFNPSMAVTSSGLPRSYHLRSHRVFMASSTIGITSKEIPNAKKPHMPPREAHVQKTHSMPPQKIEIFKSLEGWAEENVLVHLKPVEKCWQPQDFLPDPASEGFMDQVKELRERTKEIPDEYLVVLVGDMITEEALPTYQTMLNTLDGVRDETGASLTSWAIWTRAWTAEENRHGDLLNKYLYLTGRVDMKQIEKTIQYLIGSGMDPRSENNPYLGFIYTSFQERATFISHGNTARLAKDHGDFQLAQVCGIIAADEKRHETAYTKIVEKLFEIDPDGAVLALADMMRKKVSMPAHLMYDGKDDNLFENYSAVAQQIGVYTAKDYADILEHLVNRWKVENLMGLSGEGHKAQDFVCGLAPRIRKLGERAQSLSKPVSLVPFSWIFNKELKV

SEQ ID NO: 1240 - protein, 154 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCV

SEQ ID NO: 1241 - protein, 375 aa, Azotobacter vinelandii
MDLSAVLSSLFTGAQAVGVNGVFQFVFPPEKAVWAEVGEQVTIRSGHHPTADVTIELDERDFTGILQGTQDVEELFANGRLRIGGQMGLATLLPQIIGAARRGVAPPEQVRGMNQRYPAPERASDKVSAGQPPLKAVERRPRSGLSVEEFRQHYVPQGLPVIISDALQDWPLFNMSREESLVHFAKLQGITRHGDYAQKTFSTERDFRSTSMAEFIAGLDQELEEGVPSPYMGNNVVPEQLLELIRFPDYFDRSLFIKPRIWIGPKGTLTPLHRDDSDNLYAQVWGRKSFILAAPHHCEALSTWSTSPQGGLEGCEVNPKAPDYARFPRAREVDFLHIVLEAGDLFFLPDGWFHQVESVSTSLSVNFWVNSGRGW

SEQ ID NO: 1242 - protein, 419 aa, Oryza sativa
  unsure (1)..(419): unsure at all Xaa locations
MIMVLAKCTRCLALVVVVLVGVAAPVVFSVTDGLLPNGNFEHGPDKSQLNXNWEISGFVEYIGSGHKEQDMILAVPEGAYAVRLGNDATIRQRISVTRHMYYSVTFSAARTCAQAEKLNVSVTLEFGVLPIQTVYTSTGWDSYSWAFKAEHSAVWLSIHNPGVEEDPACGPLIDLVAIKTLPPPHHTRENFRHVASKTRYDEFRIYSTELAGGTMLRNGDFEEGPYIFADTPWGVLVPPMDEDVHSPLPGWMVMSTTKVVKYVDSARHAVPSGAHAVEMVAGRECALVQEVATVPGRRYTLSFSVGDAGNGCIGSLAVDAYAARATLKVSYESRGTGGHERAELVFAAVANRTRVVFHSSNHHMKSDGTLCGPVVDDVSLVSVDKHTLPMLETRSSRMDNASTTTLVLFNWKSRHSSPS

SEQ ID NO: 1243 - protein, 809 aa, Escherichia coli
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFYKVRFGGRIQQEGKKTRWIETEEILGVAYDQIIPGYDTDATNTLRLWSAQASSEINLGKFNQGDYFAAVEDKNHSENVSRVLYPDDSTYSGRDVRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLLADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGTGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 1244 - protein, 312 aa, Glycine max
SARDNPFGDFKSMHRHISKGSWTFSDQDHGWQVSDCTAEGLKCCLLLSMLPPEIVGEKMEPERLYDSVNVLLSLQSKKGGLAAWEPAGAQEWLELLNPTEFFADIVVEHEYVECTGSAIQALVLFKKLYPGHRKKEIENFITNAVRFLEDTQTADGSWYGNWGVCFTYGSWFALGGLAAAGKTYTNCAAIRKAVKFLLTTQREDGGWGESYLSSPKKIYVPLEGSRSNVVHTAWALMGLIHAGQADRDPMPLHRAAKLLINSQLEEGDWPQQEITGVFMKNCMLHYPMYRDIYPMWALAEYRRRVPLPSTEV

SEQ ID NO: 1245 - protein, 416 aa, Photobacterium profundum
MSEDFRQQALNYHAYPVPGKTAIALTKPADTVQDLALAYSPGVAEPVREIAQNAENVYKYTGKGNMVAVITNGTAILGLGNLGPLASKPVMEGKSLLFKRFAGLDSIDIEVKHRTIDEFVDTVANIADTFGGINLEDIKAPDCFEIEKRLIERCSIPVFHDDQHGTAIVTAAGMLNALEIQGKEISESVIVCLGAGAAAVACMELLIKSGAQREKIYMLDRKGVIHTRRDDINEYKQLFANNTDKRTLEDVIDGADIFVGVSGPNLLAPEALKLMADKPVVFACSNPDPEIKPELAHAVRDDLIMGTGRSDYPNQVNNVICFPFIFRGALDVRASEINDEMKLAAVKAIRELTKEPVPAEVMKAAGVDELEFGINYIIPKPMDPRLLPRVAKAVAQAAIDSGVAQIDMPVGYMEDK

SEQ ID NO: 1246 - protein, 454 aa, Synechocystis sp. PCC 6803
MAIATINPATGQTVQTFIAHSQVEVNAKLDLAQETFQSFRHLPFAQRGQWLRKAADILEQRRDEWAALMTLEMGKSIPQAIAEVNKCALVCRFYADKAEEYLADEVVTTDASQSFIAYQPLGVILAVMPWNFPFWQVFRFAAPALMAGNVGLLKHASNVPQCALAIAEIFQTAGFPEGAFQTLLIGGKVASELMADDRIQAGTLTGSEPAGASFASAAAGQIKKTVLELGGSDPFIVLEDADLDQALKVAVPARMQNNGQSCIAAKRFIVQASVAEEFFQRLTKAFQALKVGDPSLSTTDIGPLATPDILADIVAQVEQTIAAGAHCRCGGQALDQPGNYYPPTLLTDVPPNAPTYRQEFFGPVALGFTVDNLEEAIALANDIPFGLGASAWTTNPENQQKLIRGIEAGAVFINGMTKSDPRIPFGGIKRSGFGRELGRMGILEFVNAKTVWIA

SEQ ID NO: 1247 - protein, 127 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPVSVLCRPADGRSGR

SEQ ID NO: 1248 - protein, 57 aa, Brassica napus
VSKYPNLKGINFDLPHVIEDAPSHPGVEHVGGDMFASVPKGDAIFMKWICHDWSDEH

SEQ ID NO: 1249 - protein, 302 aa, Emericella nidulans
MTRTHPSSFQQLEKLGEGTYATVYKGRNCQTGEMVALKEIHLDSEEGTPSTAIREISLMKELHHDNILSLYDVVHTENKLMLVFEYMDQDLKKYMDTHGNHGQLEPAIVKSFAFQLLRGIAFCHDNRILHRDLKPQNLLINSKGQLKLADFGLARAFGIPVNTFSNEVVTLWYRAPDVLLGSRTYNTTIDIWSIGCIIAEMFTGRALFPGTTNEDQLQKIFRVMGTPSERTWPGVSQFPEYKSDFPVYPPQDLRQVVPRIDPYGLDLLRCMLRLQPDLRISAVDALRHPWFNDVPGAQPVPV

SEQ ID NO: 1250 - protein, 338 aa, Desulfovibrio desulfuricans G20
MRQVTVTEHLLLHQTKSPAATGQFTALLYDLILAAKIISKSVNKAGLLDVLGGTGQVNVQGEHVQKLDEYANRVLIHRMERTGVLCAMASEENADLIRVPERFEAGDYILIFDPLDGSSNIDVNINVGTIFSILKRKPGASGSKDVTLGDVLQSGVEQVAAGYFLYGPSTMLVYSSGQGVHGFTLDPSVGEFLLSHPDIRYPEQGRIYSVNESYWHYWDEPTREVVSYFKGPDNPLGKPYSLRYVGSLVADFHRNLFYGGIFMYPMDYRLPEKPQGKLRLMCEASPLAFLAEQAGGRATDGTKRILDIVPGELHQRVPLFIGSAGDVDAVEAIYRRHS

SEQ ID NO: 1251 - protein, 486 aa, Microscilla sp. PRE1
MIMSTVKNYKLYIDGEWIDATTGESQEILSPTDETVVGTVQMGVEADAQIALEAAERAQKQWKKVPARKRADLLRTFAAEIKANKNQLAELLVREQGKLLAVAKMEVEVTASFIEYACDGARSIEGDIIPSDNPAEHIMIHKIPRGVVVAITAWNFPLALAGRKLGPALVAGNSVVLKPTQETPIATLELGNIANKVGLPKGLINILTGQGSVLGNALVANPITKMVSMTGSTPAGQQIFRTAAENLIHVQLELGGKAPCIVFDDADLEQAVEGAFHSRFDNCGQVCTSNERLYVHESIYNEFMERFMEKVKGLKLGNPMDAATTIGPKVNAKEVAHMEHLVTKSVEEGATVAIGGKKPQGKAFEKGHWFEPTILTDVKQNMTIVHEESFGPILPVIKFSEFNEVIGYANDCEYGLAAMVFTNDMNKIMRLNDELEFGEIYINRGHGEQHQGFHNGYKLSGTGGEDSKYGFEQYMEKKTFYIKYKA

SEQ ID NO: 1252 - protein, 353 aa, Shigella flexneri 2a str. 2457T
MLYTSQTTPEKAPKMSMIKSYAAKEAGGELEVYEYDPGELKPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALSGQFDLIINTVNVSLDWQPYFEALTYGGNFHTVGAVLTPLSVPAFTLIAGDRSISGSATGTPYELRKLMRFAARSKVAPTTELFPMSKINDAIQHVRDGKARYRVVLKADF

SEQ ID NO: 1253 - protein, 250 aa, Oryza sativa
MSRRYDSRTTIFSPEGRLYQVEYAMEAIGNAGSALGVLAADGVVLVGEKKVTSKLLQTSRSAEKMYKIDSHLACAVAGIMSDANILLNTARLHAQRYALSYQEPIPVEQLVQSLCDTKQGYTQFGGLRPFGVSFLFAGWDKHHGFQLYMSDPSGNYSGWKAAAVGANSQAAQSMLKQDYRDGLTREEAVALALKVLSKTMDSTSLTAEKLELAEVFLQPGTGEVQYQVCSPEAMGKLLAKAGLSQPAPEA

SEQ ID NO: 1254 - protein, 306 aa, Petunia x hybrida
DPTNKVSDVSFSARAFADVDLNKCEPWDLPAKASMGKKEWYFFNLRDRKYPTGLRTNRATEAGYWKTTGKDKEIFHGGVLVGMKKTLVFYRGRAPKGQKTNWVMHEYRLETEHGLKPSKEEWVVCRVFQKSSTVKKQQPTSSSPQYSLESPNCDTNYTIANEIGDIHELLNFNGIATPSNGINNNISLQNYVNENMNMNLNLAAATNIVPLLPNLSSSLLSSNLSSVSSLLLRALQSRVYNQPREAATVSDYYSLITPSLQGISHFGNDFTNSNFAEGVASSSMVLDSVQQQQVQEEPCKLDIDIW

SEQ ID NO: 1255 - protein, 119 aa, Triticum aestivum
  unsure (1)..(119): unsure at all Xaa locations
ARVRLSPLLAFSALRSIRFDLFRVRVQAAAVGVTIQSVKARQIFDSRGNPTVXVDVCCSDGTFARAAVSSGASTGVYEALELRDGGSGYLGKGVSKAGDNENWSMAPALIGEDPTGNTG

SEQ ID NO: 1256 - protein, 58 aa, Zea mays
FHSFHPVATILSYLSKAPLVPPGTPVVNALAKQRAMLENILRACIGLAPENNMMLEHK

SEQ ID NO: 1257 - protein, 282 aa, Escherichia coli
ALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQSALEGMLDT

SEQ ID NO: 1258 - protein, 397 aa, Methanosarcina barkeri
MGRIFKEQTSVDEALKLFLENISPLRKTEEISLEVCIDRILAETVVSERNVPHYRRAAMDGYAVQASDTLGASTTNSIFMKLSNYVEEGVTKWVHTGAVMPVEADAVVVVEDTVTVGDTVEVRAQVYPNKNVAQVGEDIKVGDLLFEEGHLLRPCDAAVLASIGFERVKVFRKPIVAVIPTGNELVSREKVEDIPPSGMVLETNGLMVSLYVEKWGGIPRYTRIVPDDKESIKKAIEENLDADMILFSGGTSVGKRDYTTEVVASMGKLLVHGIAVSPGKPTALGTIGKIPVVCLPGYPVAEVVALYLFVHPGIRRLASIPDFPKLPLKKTLATKISSKIGYVNFIRVIFEGDRVRPLTGAKAGVLSSVSKADGFVLVPQNVEGYEEGEEVDVFLIE

SEQ ID NO: 1259 - protein, 314 aa, Geobacillus stearothermophilus
MDVVTIGESMAVFTPTSVGLMRQATTFTMRIGGRESNVAVGLARLGHRVGWISKVGSDEFGKAILSFLKGEGVDVSRVKWMGNTDRHLLKEQRRLNDTRVYYYRKGSAASRLTPADLDEKYIAEAKYLHITGITPALSENCRDTVFAAMAMARRHGVKIVFDPNLRLKLWNEADRAKEVMLRMAAESDVVLPGEAEASFLFGKHSVEEWGSRLLDMGASLVVIKLGANGAHYFTNAHHEYVQGFLLKGYDPVGAGDGFVEGYPDCLKDFVLTEAVQRANAVGALVTMVEGDADGMPERDDVERLINQRRKMLRR

SEQ ID NO: 1260 - protein, 605 aa, Schizosaccharomyces pombe
MTKDAESTMTVGTYLAQRLVEIGIKNHFVVPGDYNLRLLDFLEYYPGLSEIGCCNELNCAFAAEGYARSNGIACAVVTYSVGALTAFDGIGGAYAENLPVILVSGSPNTNDLSSGHLLHHTLGTHDFEYQMEIAKKLTCAAVAIKRAEDAPVMIDHAIRQAILQHKPVYIEIPTNMANQPCAVPGPISAVISPEISDKESLEKATDIAAELISKKEKPILLAGPKLRAAGAESAFVKLAEALNCAAFIMPAAKGFYSEEHKNYAGVYWGEVSSSETTKAVYESSDLVIGAGVLFNDYSTVGWRAAPNPNILLNSDYTSVSIPGYVFSRVYMAEFLELLAKKVSKKPTTLEAYNKGRPQTVVSKAAEPKAALNRVEVMRQIQGLVDSNTTLYAETGDSWFNGLQMKLPAGAKFEVEMQWGHIGWSVPSAMGYAVAAPERRTIVMVGDGSFQLTGQEISQMIRHKLPVLIFLLNNRGYTIEIQIHDGPYNRIQNWDFAAFCESLNGETGKTKGLHAKTGEELTSAIKVALQNKEGSTLIECPIDEAACIQEWIAGYRTFTPRKIQLTFLDTQACMAAGLLSASEGTPYSESYFLSASEGICPYSESY

SEQ ID NO: 1261 - protein, 107 aa, Tulipa gesneriana
MAVRKSSNLPQAAVIRHILKRCSSFGRKNGACSDKGHSLPLDVPKGHFAVYIGEKRSRFIVPISLLAHPEFQSLLRAAEEEFGFDNDMGLTIPCEEVVFRSLTAVLC

SEQ ID NO: 1262 - protein, 380 aa, Oenococcus oeni MCW
MLNYRDLMVFLFATKEGIKIFKESRELKMKAAVVREKNDGFVDLIDDWKPRELGFGDALVDVEYCGLCHTDLHCASGDFGDPNTLGERNGDFRRVAGHEGVGIVSKLGEGADQYLKVGDRVSIAWFYDACGVCDYCVSGNETFCRKVRNSGYTVDGAMAQQVVVDAKYAVKVPEGLDPAQASSITCAGVTMYKSLKVGETKPGQWVSVHGAGGLGNLAVQYAHNVFGAHVVAIDGNPDKLEAAKEGGAEVLINRKQPGIDVAAEVQKDTGGVHNAQVTAVNDAAFKQAVDSLRPMGKLVAVALPQGDMELNIVKTVLDGIEVRGSLVGTRADLKEAFQFGAEGKVTPIVEKVDLNDINDVIEEMKEGTITGRKVFDFTHM

SEQ ID NO: 1263 - protein, 526 aa, Oryza sativa (japonica cultivar-group)
MAAAIIGGGGWTRLRSVGRGASGAVVSLAANDVSGELFVIKSAGEGAARQQLRREWSVMSGLSSPHVLKCLGFVQASGGCGGGEHQLFLEYAPGGSLADVVARNGGRLDEGAVRTYAADVLRGLDYLHGKLVVHGDVKGSNVLVGADGRAKLTDFGCARVAMPGGSKQPVLGGTPAFMAPEVARGEEQGLAADVWALGCTVIEMATGRAPWSDMDNVLPALHKIGYTDAVPDLPRWLSPEAKDFLRGCLQRRAGDRPTAAQLLQHPFISKSCGLNNKETVKATWVSPTSALDATLWESESSSTDGEEVDDMSSNSPTGRIRAMACSCQTLPDWDSDDHGCSWIEVLGSVSINVANKTAAIEQRVTSMACSPSSVPDWDSGNQGWIDVLSSVSISIANKLETATAADNVSSECPAKWVRAMACSPSSVPDWDSDQGWIDVLGASPDVVAAEEFDVAAAADQISGQAVGSIVVGVGSSEQSVVVENQEDEFTSLSSCSERVLLVGVHAADNNAASRKAGIKRCSNFSC

SEQ ID NO: 1264 - protein, 507 aa, Mycobacterium tuberculosis H37Rv
MTVFSRPGSAGALMSYESRYQNFIGGQWVAPVHGRYFENPTPVTGQPFCEVPRSDAADIDKALDAAHAAAPGWGKTAPAERAAILNMIADRIDKNAAALAVAEVWDNGKPVREALAADIPLAVDHFRYFAAAIRAQEGALSQIDEDTVAYHFHEPLGVVGQIIPWNFPILMAAWKLAPALAAGNTAVLKPAEQTPASVLYLMSLIGDLLPPGVVNVVNGFGAEAGKPLASSDRIAKVAFTGETTTGRLIMQYASHNLIPVTLELGGKSPNIFFADVLAAHDDFCDKALEGFTMFALNQGEVCTCPSRSLIQADIYDEFLELAAIRTKAVRQGDPLDTETMLGSQASNDQLEKVLSYIEIGKQEGAVIIAGGERAELGGDLSGGYYMQPTIFTGTNNMRIFKEEIFGPVVAVTSFTDYDDAIGIANDTLYGLGAGVWSRDGNTAYRAGRDIQAGRVWVNCYHLYPAHAAFGGYKQSGIGREGHQMMLQHYQHTKNLLVSYSDKALGFF

SEQ ID NO: 1265 - protein, 345 aa, Xylella fastidiosa Dixon
MPRRGHQEFVNMAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLVAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILDYIEDKVVATDFRGETCTCVFDADAGIALDPTFIKLIAWYDNEWGYSNKCLEIAKVIAAK

SEQ ID NO: 1266 - protein, 530 aa, Blumeria graminis f. sp. tritici
MGKPESFMSPYLQPLLQFGFSIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEVYSVLTTPVFGTDVVYDCPNSKLMEQKKFMKAALTTEAFRSYVPIIQNEVESFINKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 1267 - protein, 475 aa, Escherichia coli
MSIRLEGYMQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 1268 - protein, 107 aa, Lactobacillus delbrueckii subsp. lactis
  unsure (1)..(107): unsure at all Xaa locations
LKAAEGSNLHVGAENCYWENSGAFTGETSPAVLKEMGVQYVIIGHSERRDYFHETDEDINKKAKAIFANGLTPILCCGESLEIREAGKEKEWVVSQIKADLEGXTSE

SEQ ID NO: 1269 - protein, 424 aa, Brassica rapa
MATPMVEDTSSFEEDQLASMSTEDIVRATRLLDNEIRILKEDAQRTNLECDSYKEKIKENQEKIKLNKQLPYLVGNIVEILEMNPEDDAEEDGANIDLDSQRKGKCVVLKTSTRQTIFLPVVGLVDPDSLKPGDLVGVNKDSYLILDTLPSEYDSRVKAMEVDEKPTEDYNDIGGLEKQIQELVEAIVLPMTHKERFEKLGVRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPTEEARARILQIHSRKMNVHPDVNFEELARSTDDFNGAQLKAVCVEAGMLALRRDATEVNHEDFNEGIIQVQAKKKASLNYYA

SEQ ID NO: 1270 - protein, 160 aa, Hordeum vulgare
MTGRRAVAHVFKADLPGVKKEEVKVEVEDGNVLVVSGERTKEKEDKNDKWHRVERSSGKFVRPFRLPEDAKVEEVKAGLENGVLTVTVPKTEVKKPEVKAIEISGCVFESEPFWLMCVRVLQPKYSCDLFLSSLVEASLYRVSFLGRLCTCVIAMNKCST

SEQ ID NO: 1271 - protein, 283 aa, Bacillus licheniformis
MKVLFNGRLMERSECAVDIEDRGYQFGDGVYEVIRIYNGILFTLDEHIARLYKSAAEIGIDLSFSEAELKSQLKELVDINQRRDGGLYLQVTRGKAPRKHQYGAGLTPQVTAYTFPIQKPEKEQQNGVSAITADDMRWLRCDIKSLNLLYNVMIKQKAQEASAFEAILIRDGLVTEGTSSNVYVAKQNVIYTHPVTTLILNGITRMKVLQLCEENGLNYEEKAVTKDELLNADEVFITSTTAEVIPVTSIDGQTIGSGAPGPLTKNVQTALQNSILSETAKTV

SEQ ID NO: 1272 - protein, 973 aa, Arabidopsis thaliana
MVWFRIGSSVAKLAIRRTLSQSRCGSYATRTRVLPCQTRCFHSTILKSKAESAAPVPRPVPLSKLTDSFLDGTSSVYLEELQRAWEADPNSVDESWDNFFRNFVGQASTSPGISGQTIQESMRLLLLVRAYQVNGHMKAKLDPLGLEKREIPEDLTPGLYGFTEADLDREFFLGVWRMSGFLSENRPVQTLRSILSRLEQAYCGTIGYEYMHIADRDKCNWLRDKIETPTPRQYNSERRMVIYDRLTWSTQFENFLATKWTTAKRFGLEGAESLIPGMKEMFDRSADLGVENIVIGMPHRGRLNVLGNVVRKPLRQIFSEFSGGTRPVDEVGLYTGTGDVKYHLGTSYDRPTRGGKHLHLSLVANPSHLEAVDPVVIGKTRAKQYYTKDENRTKNMGILIHGDGSFAGQGVVYETLHLSALPNYCTGGTVHIVVNNQVAFTTDPREGRSSQYCTDVAKALSAPIFHVNADDIEAVVHACELAAEWRQTFHSDVVVDLVCYRRFGHNEIDEPSFTQPKMYKVIRSHPSSLQIYQEKLLQSGQVTQEDIDKIQKKVSSILNEEYEASKDYIPQKRDWLASHWTGFKSPEQISRIRNTGVKPEILKNVGKAISTFPENFKPHRGVKRVYEQRAQMIESGEGIDWGLGEALAFATLVVEGNHVRLSGQDVERGTFSHRHSVLHDQETGEEYCPLDHLIKNQDPEMFTVSNSSLSEFGVLGFELGYSMENPNSLVIWEAQFGDFANGAQVMFDQFISSGEAKWLRQTGLVVLLPHGYDGQGPEHSSGRLERFLQMSDDNPYVIPEMDPTLRKQIQECNWQVVNVTTPANYFHVLRRQIHRDFRKPLIVMAPKNLLRHKQCVSNLSEFDDVKGHPGFDKQGTRFKRLIKDQSGHSDLEEDAEIVWCQEEPMNMGGYQYIALRLCTAMKALQRGNFNDIKYVGRLPSAATATGFYQLHVKEQTDLVKKALQPDPITPVIP

SEQ ID NO: 1273 - protein, 529 aa, Zea mays
MSSVGRSNGTRAANGAAAISTSTTEAGSADARFHSQLLHQDRQSRWAGCFSGLSCFGSQKGGKRIVPAARTSDGNGSNTRGNGLQSGANSNQNLPMNLSLLAPPSSPASFSNSALPSTAQSPNCFLSVSANSPGGPTSNMFAVGPYANEPQLVSPPVFSTYTTEPSTAPLTPPPELAHATTPSSPDVPYARFLSSSMGIKTASKDHNMPFLSTTYSGGSGLQTSYPLYPESPCSSLISPASVTPRTGLSSPIPEQEVPPAHWKTSRSACDTPYFRASPIPEQETTAQWKTSRSACDTPYARTSPTNIFGLDSNTPRNYMLDSNFFRPAASAQFYLDQAQQAFPHNGGRVSVSREKQDADEIEAYRASFGFSADEIVQSQSYVGIPDAVDESFSISPFGNNAPATEICPFSDLPSEVQKADKSCTYVKDGTSPKKSANQLSIDSPNKVLRLDVFKGTKGGHLSEDECIRKDGHLFRKTADEISLKPIEVRKKSLPGHSCSDAEIEYRRTRSLRDANGVLSRRSALARQLH

SEQ ID NO: 1274 - protein, 504 aa, Brucella suis 1330
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVECMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 1275 - protein, 745 aa, Oryza sativa
MAPPPNTYSESWWGGKEERGTPVVVKMDNPYSLVEIDGPGMAAPSEKARGKNAKQLTWVLLLRAHRAVGCVAWLAAGFWAVLGAVNRRVRRSRDADAEPDAEASGRGRAMLRFLRGFLLLSLAMLAFETVAHLKGWHFPRSAAGLPEKYLRRLPEHLQHLPEHLRRHLPEHLRMPEKEEIEGWLHRAYVAWLAFRIDYIAWAIQKLSGFCIALFMVQSVDRLVLCLGCFWIKLRGIKPVADTSISNDDIEATAGDGGGYFPMVLIQMPMCNEKEVYETSISHVCQIDWPRERMLVQVLDDSDDETCQMLIKAEVTKWSQRGVNIIYRHRLNRTGYKAGNLKSAMSCDYVRDYEFVAIFDADFQPNPDFLKLTVPHFKGNPELGLVQARWSFVNKDENLLTRLQNINLCFHFEVEQQVNGVYLSFFGFNGTAGVWRIKALEDSGGWMERTTVEDMDIAVRAHLNGWKFIFLNDVKVLCELPESYQAYRKQQHRWHSGPMQLFRLCLPAVFKSKISTWKKANLVMLFFLLRKLILPFYSFTLFCVILPLTMFVPEAELPIWVICYVPVIMSVLNILPAPKSFPFVIPYLLFENTMSVTKFNAMVSGLFQLGSSYEWVVTKKAGRTSSESDILALAEAADADARPPPAKLHRGVSEGGLKEWAKLHKEQEDATAAAAAAAAPGTPVKKSKAAKAPNRIFKKELALAFLLLTAATRSLLSAQGLHFYFLLFQGVTFLAVGLDLIGEQVS

SEQ ID NO: 1276 - protein, 365 aa, Phaeosphaeria nodorum
MPSHNIVVLAGDGVGPEVVAEAFKILKVVEKHTDNTFNFQEHLFGGCSIDAHNNPLTDEALAAAKGADAIILGAVGGPKWGTGKVRPEQGILKLRKELGTFGNLRPCFFASDSLVDSSPLKAENVRGVNFNIIRELTGGIYFGERKEDEGDGKAMDTEPYSVEEIERVVRLAGSLASAENPPVPVWSLDKANVLATSRLWRKTFERIMKDEYPHLKSGTHLIDSAAMLMIKNPRALNGVVVTSNLFGDIISDEASVIPGSLGLLPSASLGGIPDGKTKLNGIYEPIHGSAPDIAGQGIVNPIATILSISMMFKYSLCLPELALKIDEATKITIDKGVRTGDIGGTSKTAEVGDAIAAELETLLKK

SEQ ID NO: 1277 - protein, 181 aa, Lycopersicon esculentum
MASSIVSSAAAATRSNVAQASMVAPFTGLKSAASFPVTKKNNNVDITSLASNGGRVRCMQVWPPINMKKYETLSYLPDFSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 1278 - protein, 425 aa, Blastocladiella emersonii
MTLIDKLMEKTKKVVGSSDKDAPAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 1279 - protein, 468 aa, Desmarestia latifrons
IPYAKMGYWDADYNVKDTDILALFRITPQPGVDPVEAAAAVAGESSTATWTVVWRDLLTACDIYRAKAYRVDPVPGTSDQFFAYIAYECHLFEEGSLANLTASIIGNVFGFKAVKALRLEDMRIPYAYLKTFQGPAKGEVVERERLDKFGRPLLGATVKPKLGLSGKNYGRVVYEGLRGGLDFLKDDENINSQPFMRWKERYLYCMEGVNRAAASTGEVKGSYLNITAATTQQMYERAEYAHSIGSVIVMVDLVIGYTAIQTMAIWARKAEMILHLHRAGNSTYARQKNHGINFRVICKGMRMCGVDHIHAGTVVGKLEGDPLMVRGFYNSLLLTELKVNLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFDYTSTDTPDFVEVATGSN

SEQ ID NO: 1280 - protein, 386 aa, Solanum tuberosum
MADMNQHPTVFQKAANQLDLRSSLSQDVHARYGGVQPAIYQRHFACGNYSNAGLQRGQATQDLSLITSNASPVFVQAPQEKGLAAFATDFLMGGVSAAVSKTAAAPIERVKLLIQNQDEMLKAGRLSEPYKGIGECFGRTIKEEGFGSLWRGNTANVIRYFPTQALNFAFKDYFKRLFNFKKDRDGYWKWFAGNLASGGAAGASSLFFVYSLDYARTRLANDAKASKKGGERQFNGLVDVYRKTLKSDGIAGLYRGFNISCVGIIVYRGLYFGMYDSLKPVLLTGNLQDSFFASFGLGWLITNGAGLASYPIDTVRRRMMMTSGEAVKYKSSLDAFSQIVKNEGPKSLFKGAGANILRAVAGAGVLAGYDKLQVLVLGKKYGSGGA

SEQ ID NO: 1281 - protein, 163 aa, Glycine max
VATQNCCCFQVVSIGLGSRPFSLHLLLNLLNFLFPFLPSKFSLDSSSMLSSAAVVTSPAQATMVAPFTGLKSSSAFPVTRKANNDITSIVSNGGKVSCMKVWPPVGKKKFETLSYLPDLTEVELGKEVDYLLRNKWIPCVEFLLPRGSACPGPAATPGCSGGR

SEQ ID NO: 1282 - protein, 533 aa, Physcomitrella patens
MMAFNNLSHDVSLQQFPELWESSRFSQRHDTLDADQHTQGFDDTQFPKEPLEPNTNLHQVAMEIQPNATIIGDESSRGRNPVVNESDDREDDNHLLGTEDGIVKNGRTWLNSALLREQNQASEDRSGYGDHNAAERWCPVCSASGSQSCMCGMPMHAGDSSTISFPNQSTYTHWLSMQGANMLASQHRTGGEVDAKAAGFTVSPQSTKMATELNLSPAGHGRDNHALFTDPRHSVAQGGSRYAEDYERTEHQTDWEGATQKMEWEQARDKFLIVAHPLYPDLLNAHASCLRVGTPVDQLPHIEAQLTQARHVTSKYSVLHPDHLEITEDEKTELDQFMAQYIMLLCSFKDHLQQHVYYDVTEAMMSCWELEQALHNLTGVSAGESTGATMSEEDEDYDSDYGAYDAHMDPQDSGGFGPLVPTESERTLMERVRQELKYELKQGYRARIVDVREEILRKRRAGKLPEGTTTVLKAWWQAHSKWPYPTEDEKERRIQETGLELKQVNNWFINQRKRNWHSNPLSSSSELKSKRKK

SEQ ID NO: 1283 - protein, 367 aa, Oryza sativa
MLRRWFCCTQFHAPYREHENEFPDIPEEKEGIFLIERNGFAPKSDDPTKAPPPIEVPELSFDELKEKTDNFGSKALVGEGSYGRVYYATLDNGKQVAVKKLDASTEPEVDNDFLTQVSIVSRLRHENFVEMLGYCVEGNQRLVAYEFATMGSLHDILHGRKGVPGAQPGPALDWMQRVRIAIDAAKGLEYLHEKVQPSIVHRDIRSSNVLLFEDYKAKIADFNPSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPPPPPAVAPET

SEQ ID NO: 1284 - protein, 345 aa, Trichodesmium erythraeum IMS101
MLGKASESKKKIYQIIYGYWQSQCVYTATNLGIPNLLHYGPQTVEIIAEKTGTKSEKLYVVLRALAHLGIFVEKPGRVFAATELSELLMTDDSPSIGHFLMHITEPNMWDSWRELESGLKTGEVPFKIAKGQDFYTSYMTENPQSKNLFNNAMSFLTAEAVDPLFEVYNFSRFKTVMDIGGNQGTLIANIVKKFGCQGILFDLPHEVETAPNNISKYGVLDSVKIIGGSALESLPKGADAIIMKYFLSVFNQEDSIKVLTNCREALPQDGRVILLQTLVPSLGAPVEYPDGTIPALAAVQMMITNPGGYWRTEEEYKNLFAASGFKLEQVVYTGTSLTVMEFSPC

SEQ ID NO: 1285 - protein, 241 aa, Oryza sativa
  unsure (1)..(241): unsure at all Xaa locations
MTSPPPPPSSLLRRLPTTRCCCFASASSGWSASASVRLGSLGGKQRRGHRGVAVMAAAAAGGGGFEARVARIASTIRVIPDFPXKPGIMFQDITTMLLKPDAFRDTIELFVERYKDKGITVIAGVEARGFIFGPPIALALGAKFVPLRKPKKLPGEVISEEYSLEYGTDKIEMHVGAVEPNGRAVVVDDLIATGGTLSAAVKLIERAGAEVVECACVIELPELKGRDKLGNKPVFVLVKAD

SEQ ID NO: 1286 - protein, 402 aa, Oryza sativa
MVLEATMICIDNSEWMRNGDYSPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKVLETIGKKLKKNNVALDIVDFGETDDDKPEKLEALISAVNSSDSSHIVHVPPGENALSDVLISTPIFTGEEGGSGFAASAAAAAATGAAGFEFDVDPNVDPELALALRLSMEEERARQEAIAKKAAEESSGAENKDHASSSNADSVMAEAEPASNAADDKKDQPKEDDDAQLLQQALAMSMEEGSSGAAAADAAMAEAAVDDQDLALALQMSVQDAGGSSQSDMSKVFEDRSFVTSILNSLPGVDPNDPSVKDLLASLHGQGEQEKKEDKSDKPEDEKK

SEQ ID NO: 1287 - protein, 192 aa, Photobacterium profundum
MLLIIDNYDSFTYNLYQYFCELGAEVTVIRNDEIDIAGIAALNPSHLVISPGPCTPDDAGISLQAIEHFSGKLPILGVCLGHQSIAQVFGAQVVRARQVMHGKTSPIMHTDASVFRTLNNPLTVTRYHSLVVKADTLPECFEVTAWTERDGEFDEIMGISHKTLPIEGVQFHPESILTEQGHQLLANFLARR

SEQ ID NO: 1288 - protein, 246 aa, Oryza sativa
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKELVEKQKVQKQQLQWDQTQPQTISSSSSFMMREALPTTNISNYPAAAGERIEDVPAGQPQHVRIGLPPWMLSHING

SEQ ID NO: 1289 - protein, 429 aa, Triticum aestivum
MLPQQSQAAAMMQQAAAMQSMYAMPPPPHHHHLLGAAPPQQIEPILTGNLPPGFDTSTCRSVYVGNIHVQVTEALLREVFQSAGSVDGCKLIRKEKSSYGFVDYYERGSAALAILTLNGKQIFGQPIRVNWAYASGQREDTTDHFHIFVGDLSPEVTDSALFAFFSAYSPNCSDARVMWDQKTGRSRGYGFVSFRNQQDAQSAINDLNGQWLGNRQIRCNWATKGANSGEDQLTSDSKSIADVNNNFTENAKQKSNEDAPENNPLYRTVYVGNLAHEVTQDVLHRFFHALGAGAIEEVRVQHGKGFGFVKYSNHAETALAIQTGNGRILGGKPVKCSWGNKPTPPGTTSAPLPPPAAPSHPAAADLVAYQRAIAMSKMASTQALMQAQHLRHAAMGMGVGASQAMYDGTFQNVGASQQQQQQQQQLMYY

SEQ ID NO: 1290 - protein, 256 aa, Zea mays
MDPGAGAHYSARTAEEVFRDFRGRRAGMIKALTNDVEKFYQLCDPEKENLCLYGYPNETWEVTLPAEEVPPEIPEPALGINFARDGMNEKDWLALVAVHSDAWLLAVAFYFAARFGFDKEARRRLFNMINNLPTIFEVATGVAKKQNKEKEPNSTSKSNKPSSKMTTRPESHLKATKVAPPKDEDDESGEEYEEEEERDNTLCGSCGTNDGKDEFWICCDSCERWYHGKCVKITPARAEHIKHYKCPDCNNKRAGA

SEQ ID NO: 1291 - protein, 361 aa, Tropheryma whipplei TW08/27
MSAKNYKKTLLVNPISQDELQKRLSAPGFGSVFSEHMVSADWHRDLGWHDYRVEPYGPISLAPSAMVFHYGQEIFEGLKIFRHSQDSSVRAFRPLENAKRFQKSSERIALPVLPVEDFLQSLREWVMVDGRWVPNAPSCVYARPFMIATEEALGLRATCSARYTLICCPVGDLFGQIRPIKVRVSSKYSRASRGGTGSVKFGGNYAASILPQVEAGNNGFDQVLFLDSASYKNIEELSASNIFFVLSSKTLITPSLDGTILPGVTRDSIIRIAEDLGFVVEQRQISLDEVTHLFSQDKVTEMFCCGTAASVTPIGSVSFDGGTLGSGQAGPVTMLLREYLRDIQFGNRPDKYNWMVNLEDT

SEQ ID NO: 1292 - protein, 505 aa, Xanthobacter autotrophicus
MNKPEIAITKQSPFKARYGNFIGGKFVEPVGGRYFDNTSPVTGGKICEIARSDADDIEKALDAAHAAKDAWGKTSAAVRALILNRIADRMEENLDLLALAETWDNGKPIRETTAADMPLAIDHFRYFAGAVRAQEGGISEIDHDTVAYHFHEPLGVVGQIIPWNFPILMAVWKLAPALAAGNCVVLKPAEQTPASILVLAELIADLLPPGVLNIVNGFGLEAGKPLASSSRIAKIAFTGETTTGRLIMQYASQNLIPVTLELGGKSPNIFFADVVAEDDDFFDKAVEGFVMFALNQGEVCTCPSRALIQESIYDRFMEKALKRVAAIVQGSPLDPATMIGAQASSEQLEKILSYIDIGKQEGAEVLIGGERNTFGGDLAGGYYVKPTVFKGHNKMRIFQEEIFGPVVSVTTFTDDAEALHIANDTLYGLGAGVWTRDGNRAYRFGRAIQAGRVWTNCYHAYPAHAAFGGYKQSGIGRENHKMMLDHYQQTKNMLVSYSPKKLGFF

SEQ ID NO: 1293 - protein, 473 aa, Synechocystis sp. WH 8501
MTKRTFGVIGLAVMGENLALNVESRGFPIAVYNRTASKTEEFMKTRAQGKDVKAAYSLEEFVKTLERPRKILVMVKAGAPVDYVIEDLKPLLEEGDMIIDGGNSLYEDTERRTRDLESTGLGFVGMGVSGGEEGALKGPSLMPGGTKAAYEELEPILTKIAAQVDDGPCVTFVGPGGAGHYVKMVHNGIEYGDMQLIAEAYDIMKNALGLSNEELHEVFKEWNTTDELNSFLIEITADIFKYVDPDSKKHLVDLILDSAGQKGTGRWTVVSSLELGVPIPTMYAAVNARVMSSYKEERESASHQLTGPAIKFDGDKKAFINKVRDALYCSKMCSYAQGMALIAKASAEYYGNQVSLPESARIWKGGCIIRAGFLDKIKKAFVDNPDLPNLLLAPEFKQSILDRQEAWREVLVLANQVGIPVPAFSASLDYFDSYRRADLPQNLTQAQRDYFGAHTYERVDKPKGEAFHTEWAA

SEQ ID NO: 1294 - protein, 502 aa, Caulobacter crescentus CB15
MATLEAFWRLTGAGWALVRADALIPRELEPLLPPSAKLAGRVLRLFAGPAARKGRPGERLAAVLERQGPAAIKMGQFLSTRADIFGAAFADDLSRLKDRLPAFPLSVAKAEIARNLGKPLDEIFAEIGEPVAAASLAQAHPATLVDGQKVAVKVLRPGVERQVARDTAVLRLAARLAETLVPVSRRLRPTEFVEVVIRALELEMDLRFEAAGCAELGEAMAKDPYMRAPAVCWEGVGKRVLTLSWAEGAPLSDPAALDLPGLDRKALAENVTRGFLAQALDHGLFHADLHEGNLFIAAPAAITAVDYGIVGRLGPGERRYLAEILYGFLNRDYARVAKIHFDAGYVPAHQDMDAFAQALRAVGEPVFGRNAREVSMGRLLAQLFEITALFDMALRPELVLLQKTMVTVEGVARRIDPTHDLWAAADPVVRRWIGRELSPAAKARDFAEEAIRAIKALARLAETPTTPPPVAAERLHTWPLLWFLVGAATAGAAFVTGVLLAR

SEQ ID NO: 1295 - protein, 206 aa, Cryptomeria japonica
MGRGKIEIKRIESTTNRQVTFSKRRSGLFKKAKEISILCASDVAVIVFNSTGRLFDFASSSMKRILERYRNASGRGVWNNEYEQMLSQFRNLKKENEELQKELSCVTGENVETLAPKQLDYLEENLVLAAKKVRERKTEVLKYERRKTESKVIGLQQKQSILMELLAHAENHEEYGFTVSNSEGQTTPPPAFRVQPSQPNLQGSGH

SEQ ID NO: 1296 - protein, 461 aa, Streptomyces coelicolor A3(2)
MSNSTTAKAPRQPADASLSHGLKQRHLSMIALGGVIGAGLFVGSGAGIAAAGPSIVVAYTVSGLLVMLVMRMLGEMSAAYPSSGSFSAHAERAIGPWAGFTAGWAFWVLLCTAVGLEGIGAAQIVHGWLPGTPEWAWVALFMVVFCGTNLAAVKNFGEFEFWFAALKVGAISLFLVLGVLAICGVLPGTDSPGTSHLGDFLPHGGNGLIIGLLASVFAYGGLETVTIAAAESENPVRGVASAVRTAMWRIALFYIGSMAVIVTLVPWDSPEVVEKGPYVAALDELGIPGAGQLMNIVVLVALLSAMNANIYGASRIGYSLVERGQGPKVLGRVSGGVPRVAVLVSSLFGFGCVLLSYWRPDDVFSWLLNMIGAVILVVWIFIAAAQLRLRRRLEREAPEKLVVRMWAFPWLTWVALAGMAAVFVLMAREPDTRVQLYSTGGMTLVLAAVGYARQRRGAARD

SEQ ID NO: 1297 - protein, 397 aa, Mycobacterium tuberculosis H37Rv
MTVSRLRPYATTVFAEMSALATRIGAVNLGQGFPDEDGPPKMLQAAQDAIAGGVNQYPPGPGSAPLRRAIAAQRRRHFGVDYDPETEVLVTVGATEAIAAAVLGLVEPGSEVLLIEPFYDSYSPVVAMAGAHRVTVPLVPDGRGFALDADALRRAVTPRTRALIINSPHNPTGAVLSATELAAIAEIAVAANLVVITDEVYEHLVFDHARHLPLAGFDGMAERTITISSAAKMFNCTGWKIGWACGPAELIAGVRAAKQYLSYVGGAPFQPAVALALDTEDAWVAALRNSLRARRDRLAAGLTEIGFAVHDSYGTYFLCADPRPLGYDDSTEFCAALPEKVGVAAIPMSAFCDPAAGQASQQADVWNHLVRFTFCKRDDTLDEAIRRLSVLAERPAT

SEQ ID NO: 1298 - protein, 593 aa, Comamonas sp. SFCD1
HGPQAMTPSEAFVETMVANGVTDMFGIMGSAFMDAMDIFAPAGIRLIPVVHEQGAAHMADGYARASGRHGVTIGQNGPGISNCVTAIAAAYWAHSPVVIVTPETGTNGMGLGGFQEANQLPMFQEFTKYQGHVCNPKRMAEFTARCFDRAMSDMGPTQLNIPRDYFYGTIECEIPKPIRIERGAGGEKSLNAAVELLSTAKFPVILAGGGVVMGDAVKELQALAERLGAPVATGYLRNDAFPASHPLWAGPLGYQGSKAAMKLIAQADVVIALGSRMGPFGTLPQHGMDYWPKNAKIIQVEADHTNIGLVKKITVGIHGDAKAVAKALVERLAGKTLAADATKAERAQAIKAEKDAWEQELDGWTHEKDPYSLDMIEEAKGEKPFSGGEYLHPRQVLRALEKAMPPRVMVSTDIGNINSVANSYLRFEEPRSFFAPMSFGNCGYALPTIIGAKLACPDRPAVAYAGDGAWAMSMVEIMTAVRHDIPVTAVVFHNRQWGAEKKNQVDFYNRRFVAGELDNESFAAMAKAMGAEGIVVDRLEDVGPALQKAIDMQMNEGKTCVIEVMCTRELGDPFRRDALAKPVRMLDKYKDYV

SEQ ID NO: 1299 - protein, 486 aa, Pseudomonas sp. S-47
MKEIKHFISGAFVGSASGKLFDNVSPANGQVIGRVHEAGRAEVDAAVRAARAALKGPWGKMTVAERAEILHRVADGITARFGEFLEARMPGHRQAEVAGQPHRHSARRANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKPREKVPSYYQQAVDDGATVVTGGGVPEMPAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 1300 - protein, 341 aa, Spinacia oleracea
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSSNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIGSMVADVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 1301 - protein, 496 aa, Arabidopsis thaliana
MSGAITCSAADLSALLGPNATAAADYICGQLGSVNNKFTDAAYAIDNTYLLFSAYLVFAMQLGFAMLCAGSVRAKNTMNIMLTNVLDAAAGGLFYYLFGYAFAFGESSDGFIGRHNFGLQNFPTLTSDYSFFLYQWAFAIAAAGITSGSIAERTKFVAYLIYSSFLTGFVYPVVSHWFWSPDGWASPFRSEDRLFGTGAIDFAGSGVVHMVGGIAGLWGALIEGPRIGRFPDGGHAIALRGHSASLVVLGTFLLWFGWYGFNPGSFTKILIPYNSGSNYGQWSGIGRTAVTTTLSGCTAALTTLFGKRLLSGHWNVTDVCNGLLGGFAAITAGCSVVDPWAAIVCGFVASLVLIGCNKLAELLKYDDPLEAAQLHGGCGAWGLIFVGLFAKEKYINEVYGASPGRHYGLFMGGGGKLLGAQLVQIIVIVGWVSATMGTLFFILKKLNLLRISEQHEMRGMDLAGHGGFAYIYHDNDDDSIGVPGSPVPRAPNPPAV

SEQ ID NO: 1302 - protein, 476 aa, Aureoumbra lagunensis
SDRYESGVIPYAKMGYWDSSYTIKTTDLLALFRITPQPGVDPVEAAAAVAGESSTATWTVVWTDLLTACDVYRAKAYRVDPVPSAADQFFAYIAYEGDLFEEGSLANMTASIIGNVFGFKAVKALRLEDMRIPHSYLKTFQGPATGVIVERERLDTFGRPLLGATVKPKLGLSGKNYGRVVFEGLKGGLDFLKDDENINSQPFMRWRERFLYCIEGINRAVSVTGEVKGSYLNITAGTMEEMYTRAEYAKELGSIIVMIDLVIGYTAIQSMAIWARNNDMVLHLHRAGNSTYARQKTHGINFRVICKWMRMAGVDHIHAGTVVGKLEGDPLMVQGFYDTLLLTHLKIDLPKGIFFDMDWASLRKCMPVASGGIHCGQMHQLLNYLGDDVVLQFGGGTIGHPDGIQAGATANRVALEAMVLARNEGRNYVEEGPQILRDTAKMCGPLQTALDLWKDISFNYASTDTADFVETATANV

SEQ ID NO: 1303 - protein, 488 aa, Physcomitrella patens
MNRDMVGIVSSASARLEENPRLESYIASTGELAGWVEKSASVEATRSSLQLSQSQAFFEQYSTQYPQSDISSSSQADISAHDYLNIFKGTHAQAKADMKPRITQFMIPVQNQLEAGSYLLPHMAHDDSNNFSTSSNIGRATQSLCTMHQDMETLRQVPKSNDLLIAITASAAAAVNQERGSGSETGQHDRDDDEKNKATDRGKLPENEEEQLLRDAIVDHPLYPELVVAHISIFKIGAPKGLLIKLDEMEKKFQRFQYGESSWNVLHVTKFGQDPSLDFFMRSYIDLLTKFREDLENPYNKFAQYKDKVTKDLEDLCGHYIETTPDEEDNFGSDIGTKDMSQDLNDLEILGEENLMYTADIDESIVIDPDAADEELKKMLRLKYGKHIAGLKAEFNRVRKKGKLPTNARQILKDWFSRHSYWPYPSEMEKAYLQRLCGLNLKQINNWFINERKRHWSCKGKCMYPNTKFYPRDGHVDPNNHGEGYLEQ

SEQ ID NO: 1304 - protein, 392 aa, Solanum tuberosum
MLSVVLENMGSLCSRNKHYSQADDEENTQTAEIERRIEQETKADKHIQKLLLLGAGDSGKSTIFKQIKLLFQTGFDEAELKNYIPVIHANVYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVLKVPLNTCEWFKDYQSVSTGKQEIEHAYEFVKKKFEESYFQCTAPDCVDRVFKIYRTTALDQKLVKKTFKLVDETLRRRNLFEAGLL

SEQ ID NO: 1305 - protein, 87 aa, Triticum aestivum
MARLGPGQGLGCEAAVGSLAPSRSREYKLCSKHTEGKRPLYAIGFNFIDARYYDVFATVGGNRVTTYRGLPDGNLAVLQAYIDADDA

SEQ ID NO: 1306 - protein, 474 aa, Glycine max
  unsure (1)..(474): unsure at all Xaa locations
MPEETTSIDYVMEAASGPHFSGLRLDGRVPSSATAASSTPDSTLTLDSLPNQPFVIGVSGGTASGKTTVCDMIIQQLHDHRVVLVNQDSFYRRYNPEDLEPVSEYNSDHPDVFDTNQLLDCARIFIRGLGVHVPIYDFKKHQRSSDSFRQVNASDVIILEGILVFHDQRVRDLMXMKIFVDTDADVRLPRRIRRDTVERGRDINSVLEQYAKFVKPAFDDFVLPSKKYADVIIPSGGDNHIAINLIVQHIRTKLGQHDLCKIYPNVYVIQSTFEIRXMHTVNRDCDISKHYFIFXEXRLIRLLVEHLXGHLPFSEKHVFTYIGSFYTGVDISKKXCVISIVRRGESIXNALNAXCKGIKFGKILIHQDGDNGKQFKYEKIPKDISERHVLLLNLVRATGHEANQAIELLTQIGLPESHIILLNLISAPEGIHCVCKRFPSLKIVTSEIDIEINEEYRVIPGLGEFGDRYFGTDD

SEQ ID NO: 1307 - protein, 473 aa, Synechocystis sp. PCC 6803 [sequence omitted]

SEQ ID NO: 1308 - protein, 222 aa, Bifidobacterium longum DJO10A
MSNIAIAPSILSADFCNLERDLKAIANADLVHVDVMDHHFVPNLTLGEPIVGRICQVTDLPVDVHLMIEDPDRWAPEYAKLGAASISFHMGATHAPVRLARQLREMGCKACFAVRPAEPVEPIFDILDEFDMVLIMTVEPGFGGQKFLDNQMAKVRRLRDEITRRGLKTRIQVDGGVSPKTAHIVAEAGADVLVAGSAVYGAENPAQAIDDIRAKAEAAFKA

SEQ ID NO: 1309 - protein, 405 aa, Thermoplasma acidophilum
MAYIQVKDDGTLQVPDRVTIGYIEGDGIGPDISKTTINVLNAALEIAYGGKRSIEWKKILAGDEAYDKTGDRLPQSSLDELKKCVVALKGPLTTPIGEGFRSLNVTLRQYLDLYANIRPVRYFPGVPSPVVHPEYMNMVVFRENTEDLYAGIEWRYDSDGPKKVREFLASTFNINLTADTGIGIKPISKFKSTRLVRKAIQYAIANKRKSVTLVHKGNIMKYTEGAFKEWGYEVAKTEFGNYTVTETEYLQDPEKYSNKIVIKDRITDNMFQQVLTRTQEYDVIATPNLNGDYLSDALAAQVGGIGLAPGANIGDHYAVFEAVHGTAPKYAGMDVANPTSLILSGEMMLQHIGWNEAANILDEAIMQTYKDQKLTQDIARLLNVKALKCSEFGEEIINRMKKPVH

SEQ ID NO: 1310 - protein, 223 aa, Oryza sativa
  unsure (1)..(223): unsure at all Xaa locations
MAAAAVDPMALGLGTSGGGGGGESAVGGDGAAXXDLVEHPSGXVPTLQNIVSTVNLDCRLDLKKIALQARNAEYNPKRFAAVIMRIRDPKTTALIFASGKMVCTGAKSEDHSKLAARKYARIVQKLGFPAKFKDFKIQNIVGSCDVKFPIRLEGLAYSHGAFSSYEPELFPGLIYRMKQPKIVLLIFVSGKIVLTGAKYRKEIYAAFENMFPVLTEYRKTQQR

SEQ ID NO: 1311 - protein, 488 aa, Bacillus anthracis str. Ames
MNPNNRLTTNQGAPVGDNQNSRTAGRRGPVLLEDYHLVEKLAHFDRERIPERVVHARGAGAHGVFVTKNSMKKYTKAAFLQNEGTETPVFVRFSTVIHGQGSPETARDPRGFAVKFYTEEGNYDIVGNHLPVFFIRDAIKFPDMVHSLKPAPDTNIQTPDRYWDFMTLSPESTHMMTWVFSDYGTPASYREMEGFGVHSFKWINAEGKIVYIKYHWKPQQGVRNLSAKEVQEVQGKDFNHATRDLFDAIEKGNYPKWDLHVQVMQLEETDSLDFDPLDPTKVWPEDRFPLMEVGTMTLNRNPKNFFAEVEQVAFSPSATVNGIEPSEDKLLQGRLFSYPDTQRYRLGANYLQIPVNCPYAAVHNQQRDGAMQINQNPSTINYEPSRHAENPVEDPAYRDSTMKVEGYVSREKIDKPNDFKQAGERYRSFSKEEQDNLIANLTSDLKDVNERTKLLAVCNFFRADQEYGMRLAQALNVDITQYVGNAPK

SEQ ID NO: 1312 - protein, 382 aa, Catharanthus roseus
SEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 1313 - protein, 571 aa, ASPERGILLUS NIDULANS FGSC A4
MPHPLTAKYDWILAITSMAFVFSAASNGANDVANAYATSVAARTLKMWHVGILAAITEFVGAVALGNRVTDTIKSGIITPDRFIGNPGTYMLAMGCAEVGSAAWLTTATFLGWPVSTTQSIIGALVGVGFATQADITWEWTSGSVSQTAASWGVAPGIACGFSAIIFGTLKYAVLEREDPFKWGLRLIPWYIALTGGILALFITIEAPTAPSLEEFGAGKAVGIILGCFFGCLFVGYVFFMPYFHRRLVRRDARVRFYHIPLGPLLWTENPPLYFPREGEWAITNHYEDAYGEVRAGGQQTITAAVAGSVLPPADGKEARDTDIERQPDSLASSPEIAPKKRIIEPEERFLDPVRDLSWGNPRKWLGYIKYAFLQGVTRDVITHDSQLLRDIHARARRYDDRVEHMWTYCQVVSAMMMSIAHGSNDVANAVGPWAGSYHTFNSGSVETEASTPVWFLVIAGLLLGGGFWFYGYHIMRALGNKITQMSPTRGFATELGAATTVLLASRLGLPVSTTQCLTGAAIGVALMNYDLAAVNWRQIAFIFSGWVLTLPCAGLIAGLLCVMALNAPHF

SEQ ID NO: 1314 - protein, 334 aa, Triticum aestivum
VGGRRGFCYVAWNSWHSWFFLLPLPTSASCSSFFASSSLSALAASRCRERGGRHRRLLSATPLRPETGEMEGFEFFQIILDNSSSRLRLPDKFTRVLLDGGKPQEVKLREAGHRRRFWDVKVVLDADGHMYLGRGWEQFARAHGLRLGYFLVFSYDGDAVLTVKVFDVSMCRRHYQHDGDTSSGSSSDGDSGSSNTSDGGGGGNNWSLAEMDVEDGPTGQFSAMLRKCNLGMKQEQYLNVPVDFQLAHGYAERSKVELRMRGKSWLVHLKHNPKTGGRSRASFRYGWHQFCVDNALGVGDTCFFRALRQGSAGGGGEDHLLKVEVRKRDGSFLV

SEQ ID NO: 1315 - protein, 345 aa, Triticum aestivum
WIPRAAGIRHEQGTADAVRQYLWLFEEHNVMEFLILAGDHLYRMDYQKFIQAHRETDADITVAALPMDEERATAFGLMKIDDEGRIVEFSEKPKGEKLKAMMVDTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSKVLNADVTDSVIGEGCVINHCTINHSVVGLRSCISEGAVIEDSLLMGADYYETENDKKVLSESGGIPIGIGKNAHIRKAIIDKNARIGENVKIINVDDIQEASRESDGYFIKSGIVTVIKDALIPSGTVI

SEQ ID NO: 1316 - protein, 226 aa, Davidia involucrata
SLPNNATFFLTYVALKFFVGYGLELSRIVPLIIYHLKRKYLCKTQAELKEAWSPGDLGYATRFPGDMLIITIVLCYSVIAPIIVPFGVLYFGLGWLVLRNQVLKVYVPSYESYGRMWPHMHTRILAALLLYQVTMFGYFGVKKFYYVPILIPLPILSLIFAFVCKKKFYHFFQATALEVACREMKETPNMELVFRSFIPPSLSAEKSDDDQFEDAKSQVSRAASFV

SEQ ID NO: 1317 - protein, 119 aa, Zea mays
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALA

SEQ ID NO: 1318 - protein, 192 aa, Triticum aestivum
  unsure (1)..(192): unsure at all Xaa locations
MAPTVMASSATSVAPFQGLKSTAGLPVSRRSNGASLGSVSNGGRIRCMQVWPIEGIKKFETLSYLPPLSTEALLKXVDYLIRSKWVPXCLEFNKVXGFIFREAQTQSLGYYDGXYWTMWKLLCSVQPTQKKLINEXXEVXKEYPDPLSAIIGFXKMRKXKWVNLTXXKPPGXKDXGXAKSPKGNKGIDFLNN

SEQ ID NO: 1319 - protein, 394 aa, Zea mays; identical to SEQ ID NO: 926

SEQ ID NO: 1320 - protein, 379 aa, Phaeodactylum tricornutum
MKFSAATFAALVGSAAAYSSSSFTGSALKSSASNDASMSMATGMGVNGFGRIGRLVTRIMMEDDECDLVGINAGSATPDYMAYQYKYDTIHGKAKQTVEIDGDFLVLDGKKIITSRCRDPKEVGWGALGADYVCESTGVFLTKESAQSIIDGGAKKVIYSAPAKDDSLTIVMGVNQEAYDGSEDFISCASCTTNGLAPMVKAIHDEFVIEEALMTTVHAMTATQAVVDSSSRKDWRGGRAASGNIIPSSTGAAKAVTKVIPSLVGKITGMAFRVPTIDVSVVDLTAKLEKSTTYEEICAVIKAKSEGEMKGFLGYSDEPLVSTDFEGDLRSSIFDADAGIMLNPNFVKLIAWYDNEYGYSGRVVDLMKHVAAVDAKIKA

SEQ ID NO: 1321 - protein, 394 aa, ASPERGILLUS NIDULANS FGSC A4
MASQSFPPPPVDTIDWSNIGFKVREVNGHVESHYTPATKSWSPPKLVKSPYLPIHGMAPGLNYGQQAYEGLKAFRHPNNSKITIFRPDRNALRMQRSASFISIPPVPEDLFLEAVELAVGANAGFVPPHETGAAMYIRPLIFGSSAQLGLSPPEEYTFVVFVMPTGVYHGVHAVDALILEDFDRAAPEGTGSAKVGGNYAPVLRHSAKAHAEGFGITLHLDSRTRSEIDEFSTSGMIAVKKNKESGKVTLVQPDSPNVIDSVTAASVCEIGKLWFGYDVEKRRIPYEELNEFDEVMAAGTAAALVPIRSITRRSSGNRFEYECGGEEAGGGEVCVKLLRTLKGIQLGKIEETLGWNRVVKAPPAEWVGAADEKEEAGIEVPQACRMICTASNWY

SEQ ID NO: 1322 - protein, 395 aa, Zea mays
MDYNFDTSVLDEDVAGRGGREGSCPPAWARACDGCRAAPSVVYCHADTAYLCASCNSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 1323 - protein, 486 aa, Saccharomyces cerevisiae
MVHLGPKKPQARKGSMADVPKELMDEIHQLEDMFTVDSETLRKVVKHFIDELNKGLTKKGVNIPMIPGWVMEFPTGKESGNYLAIDLGGTNLRVVLVKLSGNRTFDTTQSKYKLPHDMRTTKHQEELWSFIADSLKDFMVEQELLNTKDTLPLGFTFSYPASQNKINEGILQRWTKGFDIPNVEGHDVVPLLQKEISKRELPIEIVALINDTVGTLIASYYTDPETKMGVIFGTGVNGAFYDVCSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFENLEDTDDMFQKDFGVKTTLPERKLIRRLCELIGTRAARLAVCGIAAICQKRGYKTGHIAADGSVYNKYPGFKEAAAKGLRDIYGWTGENASKDPITIVPAEDGSGAGAAVIAALSEKRIAEGKVSGIIGA

SEQ ID NO: 1324 - protein, 366 aa, ASPERGILLUS NIDULANS FGSC A4
MPSYNIVVFGGDHCGPEVTAEAVKILRVIEKSRDDITFNLQDHLLGGCSIDATGSPLTDQALEAAKNADAVFLGAIGGPEWGTGAVRPEQGILKLRKEMGTFANLRPCNFAAPSLVESSPLRPEICRGVDFNIIRELTGGIYFGERKEDDGSGFALDTEPYSRAEIERITRLGAHLALQHNPPLPVWSLDKANVLATSRLWRKTVTEIMAKEFPQLKLEHQLIDSAAMIMVKDPRKLNGIVITSNLFGDIISDEASVIPGSLGLLPSASLSSIPDGKGKVNGIYEPIHGSAPDISGKGIVNPVAAILSVGLMMQYSFALFEEARAVATAVSNVIEAGVRTGDIGGKASTKEVGDAVAAELEKLLKK

SEQ ID NO: 1325 - protein, 444 aa, Lycopersicon esculentum
MATIKSIKARQIFDSRGNPTVEVDVHISNGVFARAAVPSGASTGIYEALELRDGGSDYLGKGVSKAVNNVNSIIGPALVGKDPTDQTGLDNFMVHQLDGTQNEWGWCKEKLGANAILAVSLAVCKAGAAVRNVPLYKHIADLAGNKKLVLPVPAFNVINGGSHAGNKLAMQEFMILPVGAANFKEAMKMGCEVYHHLKAVIKKKYGQDATNVGDEGGFAPNIQENKEGLELLKTAIEKAGYTGKVVIGMDVAASEFYGKDKSYDLNFKEESNDGSQKISGDQLKDLYKSFVSEYPIVSIEDPFDQDDWETYAKLTAEIGEQVQIVGDDLLVTNPKRVAKAIAEKTCNALLLKVNQIGSVTESIEAVKMSKKAGWGVMTSHRSGETEDTFIADLAVGLSTGQIKTGAPCRSERLAKYNQLLRIEEELGSEAVYAGASFRKPVEPY

SEQ ID NO: 1326 - protein, 478 aa, Mycobacterium tuberculosis H37Rv
MTEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 1327 - protein, 459 aa, Dictyocha speculum
  unsure (1)..(459): unsure at all Xaa locations
DAAYSVKQTDLLALFRITPQQGVDPVEATAAVAGESSTATWTVVWTDLLTACDVYRAKAYRVDPVPNTPGQYFGYVAYEVDLFEEGSLANMTASIIGNVFGFKAVKALRLEDMRIPFAYLKTFQGPATGVVVERERMDKFGRPLLGATVKPKLGLSGKNYGRVVFEGLKGGLDFLKDDENINSQAFMRWRERFLYCQEGIQRAAAATGEVKGXYLNGTAGTMEXVYERAEYAKELGTIGIMNDLGMGYTAIQSNAYWARKNDMILHLHRAGNSTYARQKNHGINFRVICKWMRMAGVDHIHAGTVVGKLEGDPLMVKGFYHTLLDVKTDVNLPQGLFFAQDWASLRKCLPVASGGIHCGQMHQLLNYLGDDVVLQFGGGTIGHPDGIQAGATANRVALETMVLARNEGRDYVAEGPEILQDAAKMCGPLQTALDLWKGISFNYASTDTADFSEIATANA

SEQ ID NO: 1328 - protein, 739 aa, Glycine max
MWRLKIADGGNDPYIFSTNNFVGRQTWEFDPEAGSPEERAQVEAARQHFYHNRFKVKPCADLLWRFQVLRENNFKQTIPRVTIEDGEEITYQKVTSAVRRGAHHLAALQTSDGHWPAQIAGPLFFLPPLVFCMYITGNLESVFPEEHRKEILRYTYYHQNEDGGWGLHIEGHSTMFCTALNYICMRMLGEGPNGGHDNACARARKWIRDHGGVTHIPSWGKTWLSILGVFDWCGSNPMPPEFWILPSFLPMHPGPITPLILQLREELFTQPYEKVNWKKARHQCAKEDLYYPHPLIQDLIWDSLYIFTEPLLTRWPFNKLIREKALQVTMKHIHYEDETSRYITIGCVEKVLCMLACWVEDPNGDAFKKHLARVPDYLWVSEDGMTMQSFGSQEWDAGFAVQALLATNIIEEIGPTFAKGHDFIKKSQVKDNPFGDFKSMHRHISKGSWTFSDQDHGWQVSDCTAEGLKCCLLLSMLPPEIVGEKMEPERLYDSVNVLLSLQSKKGGLAAWEPAGAQEWLEYSNPTEFFADIVVEHEYVECPGSAIQALVLFKKLYPGLRRKEIENFITNAVRSLEDTQTADGSWYGNWGVCFTYGSWFALGGLAAAGKTYTKCAAIRKAVKFLLTTQREDGGWGESYLSSPKKIYVPLEGSRSNVVHTAWALMGLIHAGQADRDPMPLHRAAKLLINSQLEEGDWPQQEITGVFMKNCMLHYPMYRDIYPMWALAEYRRRVPLPSTEV

SEQ ID NO: 1329 - protein, 321 aa, Synechococcus sp. PCC 7942
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFSSLYPGCVADTPLFRNTPKLFQKIFPWFQKNITGGYVTQELAGERVAQVVADPEFKTSGVHWSWGNRQQKDRQSFVQELSDKASDDRTAQRLWDLSAKLVGL

SEQ ID NO: 1330 - protein, 95 aa, Rhodopseudomonas palustris
MTTAKEVLKSIKDNDVKYVDLRFTDPRGKWQHVTFDVSMIDEEIFSEGTMFDGSSIAGWKAINESDMTLMPDPATATIDPFFAETTMVITCDILE

SEQ ID NO: 1331 - protein, 556 aa, Oryza sativa (japonica cultivar-group)
MATVAVFFPLPVAKEAFYNTPVGRWPYVGFLRLRQLASSKQRSTAMSRSVGVTMDAAGADADQARLHQLGYRQELKRGLSLVSNFAFSFSIISVLTGVTTTYGTGLRYGGPVSMTLGWLVVAAFNGCVALSMAEICSAYPTSGGLYYWSAKLAGKEWAPLASWVTGWFNIMGQWACTTSVDFSLAQLLQVIILLATGGANGGGYMASKYVVLAIYSAILILHGLINSLPIRWLSWFGQLGAFWNVAAVAKERVSPEFIFTHFNAENGAGIHDKAYILAAGLLMSQYSLIGYDTSAHIIEETKNADWSGPIGIITSVALSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTSLGSQVAFQAMVSIATLGLLIACALPVFFRVTTARRSFVRGPFHLGKYGVIVGWVGVVWVATVTVLFSLPVAYPVAKETFNYTPVAVGGVLLLSLVAWVLHARFWFQGPVTNVDTYNVP

SEQ ID NO: 1332 - protein, 359 aa, Buchnera aphidicola (Melaphis rhois)
MNIKKLVRKDIRELIPYQSARKIGGKGDIWLNANEFPEFNNIKLNNIILNRYPECQPEQLTSCYSSYIGINKSNILITRGIDEAIELLIKTFCNPQNEKIIFCPPTYDMYNISAKIIGIKSYEVPLLNFSWQLDINNIAKYISDAKLIYICNPNNPTGNLINYQDIITLLNITLGKTLVIVDEAYIEFSPIHSLTNLIDTYPNLVILRTLSKAFALAGLRCGFILTNVNIVKFLLKVINPYPIPIPTTSIAVQFLSKNNINEMRNRIFDLTLNRFWLVNKLKSMNNCVEHVFNSFANYILVRFYNSRKVFDILSKKGIIVRDQSNKLHLSRCLRISIGTSKECLEVVRVIQKINSLCVY

SEQ ID NO: 1333 - protein, 488 aa, Vaucheria canalicularis
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPFLGATVKPKLGLSGKNYGRVVYEGLRGGLDFLKDDENINSQPFMRWRERFLYCMEGVNRAAAATGEIKGSYLNTTAGTIEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNTLLQTKLDINLPQGLFFEMDWAALRKTVPVASGGIHCGQLHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 1334 - protein, 178 aa, Arabidopsis thaliana
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 1335 - protein, 277 aa, Ricinus communis
TNNNELFLNLVMEYVPESMYRVLKHYSNAKQTMPLVYVKLYMYQIFRGLAYIHTVPGVCHRDLKPQNILVDPLTHQVKLCDFGSAKVLVKGEANISYICSRFYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHPFFDELREPNARLPNGRPLPPLFNFKQELNGASPELVNKLIPDHMKRQMGLNFLHLAGT

SEQ ID NO: 1336 - protein, 143 aa, Nitrosomonas europaea ATCC 19718
MCHTCDGKDFSPELAWTGVPENTKSLVLIVDDPDAPDPQAPKMTWVHWILYNIPPATRKLPERVTVAELPSGTLEGVNDWERTGYGGPCPPIGTHRYFHKLYALDTLLPDLNQPTKAILEKAMQGHIIARTELIGLYHRSDNV

SEQ ID NO: 1337 - protein, 475 aa, Streptococcus mutans UA159
MTKQYKNYVNGEWKLSENEIKIYEPASGAELGSVPAMSTEEVDYVYASAKKAQPAWRSLSYIERAAYLHKVADILMRDKEKIGAVLSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRCTAVKRVLVMESVADELVEKIREKVLALTIGNPEDDADITPLIDTKSADYVEGLINDANDKGAAALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 1338 - protein, 96 aa, Glycine max
VLEATMICIDNSEWMRYRDYSPSRFQAQTDAANLICGAKTHSNPYYTAGVLTMAGTGTRVTATHPSDLGRILSGLHGLEMGAKLNLSDRMQEAQLG

SEQ ID NO: 1339 - protein, 409 aa, Oenococcus oeni MCW
MSMANILAQLIIVNWQICSMLKLNKNYRRNKMSNISKTNDQILDFDYQLKAQDDAFPTLKVLDNDGKIVDEKALERADLSDDDLINIFHNMLLNRQLDIRSTKLARQGRFGFFAPTAGQEASQMASAYAFHDEDWLFPGYRDIPEIVAKGWPIWKAILWSRGHVVGNEYTTDDGKEVNSWFPQIIIGAQYVEAAGVALGLKKRNKKAVSYAYTGDGGTSQGDFYEGMNFAAAYHANEVFFVQNNGFAISTPRKLQTAAPHLAAKGWAVGVPSLVVDGQDAIAVYLAAKEARAWAVSGKGPVLIETLTDRFEAHSTAGDDPLRYRTKEDIADWWKKDPLIRMRKYITDKGLWDEDKENDYIAQIDARIDEDIKKADNIDKQKISDYLKNTLEVPGYAMKEQIEKFESEGK

SEQ ID NO: 1340 - protein, 2393 aa, Neurospora crassa
MAAVLLTLVLATLVQGLRYDPDYVDYNLNQNKDAVNPLDYSAPKRDNYTASPKNWKFPFYTLFLDRYANGDPTNDNINGTVYEQDPTSNQLRHGGDVQGVIDSLDYIQGMGIKAIYIAGSPFINLPWGVDSYSPIDLTLLDMHYGTIKDWQRMVDEIHKRDMYVMIDHTFSTELSMSDLLAFKGFENETAPFSLKEHKVHYKGNREYLDFAPSNEYKDECQYPRFWDETGMPVGEDVTSQLKGCYDSDFDQYGDMEAFGVHPDWQRSLAKFASVQDRLRDWAPSVRKRIELFSCLSIRVLDVDGFRFDKATQVTVDAMAEHNEAIRKCAKEHNKDNFFMPGEITGGDGYGAIYIGRGRQSNQRPSFPQVMNLTTKELSKNNSLVIRDEGKNGLDAAAFHYSAYRFLTRFAGMSGNLEAGYDLPLNWVEMWNQMIITNDFVNPNTGLFDPRHMYGTMNQDVFRWSGIKQGTQRMLLGLFIMTLHMPGIPLVFYGEEQEFYVLDSTADNYLFGRQAFSPTPGWMLHGCHVGNSTQYVGWPIETSRTGCTDPKVALDHRDPSAPVRNIMKSMYHMRDTYETFREAWLLQTLSSKVRNVTLEGSTTSTEFGIWSVARAFMPSVQKESYPAEPVWLVYHNEDKETEYTFDCSKKGQDFVSPFDAGATVKNLFYPYDEIKLEKSTQSLGFANSHAVSGCLSNITMAPFEFRAYVLKEDWESPPPMITKFTPGHDASVESYGNGKVDIQLEFSEEMDCEEVLNSISFTSTTEENASIKIDAHRCDNIKASFIAEYVGTIPSTWRFNATLSNVKDGIHRITVKDPQSGRNASTGATDHFLLRVGSSNNPLVNPMKANYSKTLVTKEGSDLFVNHAAAGADKWRYSTNWGSTWSDWLEYKGGKEKIDKLAWNGTKRQEWDGDHVMVQYWSKLLGSASFVQSGDSKETKTRRFPHLFAHGLFNKFGFDAGVKNELKLVGDGLWEGHVMDEWPTHFQLNVWGMNPDQRPDAGWVFGDVDGDGVLDRMPPSSLALNVINATEPPPMPALSWKLVFNDALLTFHKEPQGNVAVQIIMFILLASLPIVGGLTAVWTFMGSFYKVKVNKVGFKRRGRSPLRDIGKRISSTVSFENFRHKDVGDTELAVIPGKRRKVIIATMEYNIDDWNIKIKIGGLGVMAQLMGKALEHQDLIWVVPCVGGIDYPIDQRAEPMYVPIMGKEYEIEVQYHQVQNITYVLLDAPIFRTQSKADPYPPRMDDMDSAIYYAAWNYCIAEAIRRFNPDLYHINDYHGAAAPLYLLPERTIPCALSLHNAEFQGMWPMRTPEESKEVCEVFNLDPEIVKEYVQFGSVFNLLHAGASYLRVHQKGFGAVGVSKKYGDRSYARYPIFWGLSKIGQLPNPDPSDTAEWSRDEQIQAKDVVVDLEAEAKRGDLRRQAQEWAGLEVNPDAELFVFVGRWSLQKGVDLIADIFPSILEKYPTTQLICVGPVIDLYGKFAALKLAKLMEKYPKRVYSKPEFTALPPCIFSGAEFALIPSRDEPFGLVAVEFGRKGALGVGARVGGLGQMPGFWYTIESTAPQHLIQQFRGAIVSALESKKKDRQMMRAWSAKQRFPVAQWVEDLDTLQTEAIRIHHKEAKKRKRVPSGSLLTVPSTVDLHGNNTQRDYFDDAVSTPAGARSRTASTVSTPGPQDGATHHRRTLSSPFDDDIPSIASPPPGTPGSPPTVNVDRVGDHSDHNGEDGADEPLMPPNPLFLNPSASSSVTDVASIAANVYGHAGDRSSVDTFAMRMMSPDSSEIRPQAFGLLNPQARPGAEALYQARNRNSSRLSVIDVVGDRQDFRLQKVDPFFTDANGQYYREFERKLNGLTAKNSETELCIEDYLKESEKEWFKEFRNAKLGRSRSPSRSRSPMPGLKIKKTRHASIGSVQSISPTEDDDRENEERNSSNNEGVGHHRDDQFLLGDGYKPPTGLKKLLSIRLGDWPIYSFIIALGQILAANTYQIVLLAGESGQTPTQLYIVAGTYALGSLLWWFMFRRLPALYSLSLPWLFYGLAFMLLGVTPFMPDHVRFPVQNTASALYAAGASSGSLFFAMNFGDEGGVPIMTWIFRAAIIQGIQQVYILALWYWGSLLTAQTPTGSPHVGTWIANKVPVALVITVPIALIFWCLGVISFVGLPDYYRQLPDKIPSFYKSLLRRHIVPWFLLMVVIQNYFLSAPYGRTWEFLFYSRAVPGWAILLLAIGFFVGVWCLLLWLFAYFTKTHPWIVPLFAIGLGAPRWAQMLWATSGIGLYLPWCGTVVLSAIISRCLWLWLGLLDTVQGVGLGMVLLLTLTRQHVAATLIGAQFLGAVFMMLARATAPDKDGPGDVFPDFSAGVMPGLGRPWFWVVLGLQLVLPIGFFKFFRKEQVAKP

SEQ ID NO: 1341 - protein, 248 aa, Azotobacter vinelandii
MAREYYPFHAERWPAFRRLPWAGNRIRPVMCLTEMRLNFPFPSNHMEEIIMAQANQNVPVNRERQSQRPAASSGDLWRPLTSLRQQIDHLFEDFDRISPFWPMGRSAFGSLMEPFGRAGREMASMPAVDIVDQDKAILISAELPGMDEQNIELKVCNGNLMLKGEKREEREENSQGLYLSERSYGAFQRSFALPDSVDADNIEAHFDKGVLTITLPKRPEAQQSERAIEIRRGEAAAQQQDTTQATTH

SEQ ID NO: 1342 - protein, 55 aa, Zea mays
EKYEKELKDTRARELMYAEEAAILDKELKKEKLKNAAALKELQEKAEQKLQDELQ

SEQ ID NO: 1343 - protein, 279 aa, Arthrobacter ilicis
MTMTYAGTTALITGASSGLGAEFAGQFAARGSNLVLVARRGDRLEELAQELRSRHGVTVTVLPKDLGLAGVGRELFDELAGRGISVDTLINNAGFGTHGPLIEEDPETIASEISLNVAALVDITRAFLPELLASGKGALVNVASTAAFQPIPGMAVYGATKAFVLSFTEAVAHETKKSGLTSWPFAPVQQEQNSSMCSAVTPQQWARCRPLHRLWALLSRPSTARTHPAAWSRAGLTALRPDSRSVCPGPSPSPSLHALYRTGRTGRKGSSVPRLRNSG

SEQ ID NO: 1344 - protein, 522 aa, Desulfitobacterium hafniense
MCKSKRENPGWSISGGSLFFFSTGVHHYYLNKNHFKERGEWTRRTSTVFENYLSNSKEEYQMKRVWVLLLAIISMLALPVAVLAEDGAVVDTGDTSFIILSAALVFLMTPGLALFYGGMVRKKNVLSTVMHSFILMGVSSVLWVLIGFSLAFGTDHAGIIGSLEWIGLSGVGMEPNGDYSSTIPFLLFMAFQMMFTIITPAIISGSVAERMRFPAFLGFMVLWLLVVYYPLAHSVWGVGGFLREMGALDFAGGTVVHISSGVTGLVAALILGKRKGHGKEPMAPHQLPMTVLGAGLLWFGWFGFNAGSALGANGLAAMALVTTNTSAAAGALAWMATEWMHRGKPTILGAASGAIAGLVAITPGAGFVTPMSSLVIGLVGGAICYFGVSVLKAKLGYDDSLDAFGCHGIGGIWGALATGIFASASVGGTDGLLYGNAAQVGIQAIGVAVTIVLAVVATFIIMKLVGIFTPLRVTAEEEEMGLDISLHGEEAYPDFIGSGYLPTIVSAAKAVSVSTPSGQPGK

SEQ ID NO: 1345 - protein, 397 aa, Lycopersicon esculentum
MSSSLHSPLYSSLSSSSALQDRKLRNAVNFAKPNLIFKPRRSFPLIRASAGFSSSLDTGLSTELDAVANHSEIVPDTVIFDDFEKFPPTAGTASSSLLLGICGLPDTKFKSAVDRALSDSECYGLESSDLQMSCFFNKALAHVGGDLAKLVPGRVSTEVDARLAYDTHGIVRKVHDLLKAYTEIEVPPERLLFKIPATWQGIEASRVLEAEGIQTHLTFVYSFCQAAAAAQAGASVIQIFVGRLRDWSRNHTGDSEVESALRRGEDPGLALVTKTYNYIHKYGHKTKLMAAAVRNKPDVFNLLGGGYIITPLKVLQSLKESVTLLDEKYSFTRRLSPQSAAAFNFTQDELQKWDQYSFSSAMGPASVELLTIGLDGYINQAKRVEELFGKIWPPPNV

SEQ ID NO: 1346 - protein, 366 aa, Zea mays
MALMQESSQDLLEAHDELFHHCLCFAKSLALAVAQDLRIPDAIHHHGGGATLHQILAEAALHPSKLRALRRLMRVLTVSGVFTVQYSSTVDASDGADVVYRLTAASRFLVSDSDEAGTASLAPFANLALHPIAISPHAVGICAWFRQEQHDPSPYGLAFRQIPTIWEHADNVNALLNKGLLAESRFLMPIVLRECGDEVFRGIDSLVDVGGGHGGAAATIAAAFPHVKCSVLDLPHVVAGAPSDACVQFVAGNMFHSIPPATAVFFKTTLCDWGDDECIKILKNCKQAISPRDEGGKVIIMDVVVGYGQSNMKRLETQVMFDLVMMAVNGVERDEQEWKEMFIEAGFKDYKIRPVAGLMSVIEVYP

SEQ ID NO: 1347 - protein, 147 aa, Zea mays
  unsure (1)..(147): unsure at all Xaa locations
RSLLNHPTLEPLLDHAIIACVEPSGGSXSHEPYLLLPVPLNGTLVRQXNIVLSRREFYSTADVLQIFQHMREWLIHMHSXDPPYAHKDAKPGNALITWRXGHAPVATLMDSGSAGPARXEITSRSEALQTQEWAADHCSAPYQAPEL

SEQ ID NO: 1348 - protein, 271 aa, Rhodobacter sphaeroides
MKSVLITGCSSGIGLDAARGLAARGWRVFATCRQEADCDRLRSEGLESFRLDYDDPESLAAAVEEATRRTGGTLDALYNNGAFACPGAVEDLPREALRAVLETNIVGVHDLTRRVIPIMRRQGHGRIVNCSSVLGFVAYPWRGAYVASKFAMEGLTDVLRIEMADTPIRVILLEPGPIASRIRENSIPHFERWIDWRASARADQYRTLLGRLYEGGEDRWQLPPSAVTEKLVQALESPRPRARYRITVPSRTAWVLRRLLPTAALDRVLGR

SEQ ID NO: 1349 - protein, 321 aa, Stellaria longipes
MENFPIINMENIERKNTRDMIKDACENWGFFELVNHGIPHSLLDKMEKLTKDHVRKCLEERFKEMVASKGLEAVEAEVTDLDWESIFFLKHLPVSSISELPDLDEEYREVMIDFSKRKEKKAETKKDKKCENKGKEKSYLKNTFYGSKGPNFGTSVSNYPPLPKPDLIKGLSAHTDAGGIILLSEDDKVSGLELLKDGDWIDVPPMRHSIVVNLGDELEVITNGKYWSVEHRVQIDTNITRMSTASFYVPGNDRVIAPAEALPKEFKKDEVYPKFVFKSYMKAYAKLIRQSGLKFEAKEPRFEAMKAHRIGSSCNSHLEHD

SEQ ID NO: 1350 - protein, 434 aa, Neisseria meningitidis MC58
MKKHIWAASLLPASLSAEPLNWWKPYSAVNSGDTAWVMTAAALVLLMTLPGLALFYGGMVRKKNLLSTMMHSFSIATLVGILWVAVGYSLAFTPGNAFIGGLGRVFLSGMQIDATAQMLTVSPNAPTVPEPVFMFFQMTFAIISTAIITGAFAERMKYSAMMLFSGIWFLLVYVPGAHWVWGGGFMSKGGVLDYAGGTVVHINAGIAGLVAALVLGRRIGYGREAMPPHNMAMTLIGAAMLWFGWFGFNAGSALAADAAAGMAMAVTQVSAVFGAAGWLACEKIAGHKPSALGLASGAVSGLVGITPAAGFTGPSGAAAIGILTAAACFVSVTVVKHKLRYDDSLDAFGIHGFGGLVGGILTGIFFDNRIFGGDAAVWQQLWIQVKDGVVMAAYSGLMSWAILKVVGKICGGLRVGKDVEREGLDLNIHGERVE

SEQ ID NO: 1351 - protein, 510 aa, Oryza sativa
MAARQRPQAQLARINAMRHSYTAAGDDGSGDDVCGELDDGGGEYASQTSFRIRGGRGAAEVTAIFRKLGLSGPEDFTIPPAVYAAAMSHLSSSARRRASLEVASPPELLEASPAEAAVPMNREAVEKGEEAGPAPKLVQSEVTEVSTRAYANATPAAESSIRVVAPSATKFVQAEAIEVSTRSYARPAASVRSVASKRALLKQDSADEDKEKGKLVRLDKSREEIRGEVVVEATRETTGASALVVEATRESTSRDIEHLISPSPHRRFRRTITSWLKGEHLGSGSFGSVYEAISDDGFFFAVKEVSLIDQGINAKQRIVQLEHEISLLSRLEHENIVQYFGTDKDSQVSAYTRQILIGLNYLHQRNVLHRDIKCANILVDSNGLVKLADFGLAKEMSILSQARSSKGTVYWMAPEVAKAKPHGPPADIWSLGCTVLEMLTGKVPYPDMEWVTHALLKIGRGIPPEIPATLSEDARDFIIKCVKVNPNDRPSAAQLLDHPFVQRSLQHKGA

SEQ ID NO: 1352 - protein, 322 aa, Streptococcus agalactiae 2603V/R
MVTLSKEQHLDMFLKMQRIRDVDMKFNKLVRRGFVQGMTHFSVGEEAASVGAIQDLTDSDIIFSNHRGHGQTIAKGIDIGGMFAELAGKATGTSKGRGGSMHLANLEKGNYGTNGIVGGGYALAVGAALTQQYEGTDNIVIAFSGDSATNEGSFHESVNLAAVWNLPVIFFIINNRYGISTDITYSTKIPHLYMRADAYGIPGHYVEDGNDLMAVYEKMHEVINYVRSGNGPAIVEVESYRWFGHSTADAGVYRTKEEVDSWKAKDPVKRYRAYLIENEIATEEELAAIEAQVIKEVEEGVKFAEESPFPDMSVAFEDVFVD

SEQ ID NO: 1353 - protein, 244 aa, Triticum aestivum
MFGYRKAPDLDLEAGGSAALYPGMTEDVELRWAFIRKIYVILSVQLAMTAAVAGFVVKVPAVSEFFVSSNAGLGLYIFLLVLPLIVLCPLRYYHQKHPVNLILLGVFTVSISFAVGMTCAFTSGKIILEAAILTAVVVISLTAYTFWAAKRGHDFNFLGPFLFGALMVLLVFSLIQIFFPLGKISTMIYGAVASIIFCGYIIFDTDNIIKRHTYDEYIWAAVSLYLDIINLFLNLMQILRAADS

SEQ ID NO: 1354 - protein, 91 aa, Zea mays
  unsure (1)..(91): unsure at all Xaa locations
KIVETIHSAKASQIFDSRXLPRVQVDAYLSHGPLVRAVCPRGASTGIYEAMXFRDGGSHYXGKGVFQAVNTENTDIGPAMIGWDPTAQTEM

SEQ ID NO: 1355 - protein, 496 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 1356 - protein, 292 aa, Thermoanaerobacter tengcongensis
MNERYELNKNLAQMLKGGVIMDVTTPEEAIIAEKAGAVAVMALERVPADIRARGGVARMSDPKIIKEIKAAVSIPVMAKVRIGHFVEAQILEALGIDFIDESEVLTPADEMYHINKWDFKVPFVCGAKNLGEALRRIAEGASMIRTKGEAGTGNVVEAVRHMRMINAEIKRLTTLGEEELMAAAKELQAPYDLVKYVAQHGKLPVVNFAAGGIATPADAALMMQLGADGVFVGSGIFKSQNPEKMAAAIVKAVTYYDKPEILAEVSEGLGEAMTGIDIRQLEEKDLYATRGW

SEQ ID NO: 1357 - protein, 395 aa, Zea mays
  unsure (1)..(395): unsure at all Xaa locations
MAAAALLRRLPAARAQAQAPAFMAARPISDSTAALTIETSVPFTSHLVDPPSRDVTTTPAELVTFFRDMSLMRRMEIAADSLYKAKLIRGFCHLYDGQEAXVAVGMEAAITRSDSIITAYRDHCTYLARGGDLVSAFSELMGXRRLGASRGKGGSMHFYKKDANFYGGHGIVGAQVPLGCGLAFAQKYKKEDTATFALYGDGAANQGQLFEALNISALWKLPXAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLTHDLANAAELKNMEKEIRKQVDDAIAKAKESSMPDTSELFTNVYKKGFGVESFGPDRKEMRASLP

SEQ ID NO: 1358 - protein, 304 aa, Pseudomonas syringae pv. syringae B728a
MPQSVRVSPLLIGAFLALYLIWGSTYLVIRIGVESWPPLMMAGVRFLIAGCLMYGFLRFRGVPAPTWREWKAAFVIGFLLLACGNGGVTLAEHAGVASGVAALAVATMPLFTLLFGLFWGNRTTNLEWAGIVLGLIGIGLLNLGSNLQASPYGAAVVIFAAAAWAFGSVLSKHLPLPKGPMASAAEMITAGATLLIGSALSGERLAHMPTAAGWGALLYLVVFGSIVAFSAYMYLLKNVRPAAATSYAYVNPAVAVMLGVVFAGETIGVEECMAMVVIISAVVLIGLPQWRRSPPPEVASTRTS

SEQ ID NO: 1359 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 1360 - protein, 157 aa, Glycine max
MVSNGDEESGTQVQLPETTTKNSPSPFFRYNSPLVQVILIGVICFCCPGMFNALSGMGGGGQVDHTASNNSLTALYTTFAIFGILGGGIYNILGPHLTLLAGCSSYVLYTSSFLYYNHHHHQAFVILAGALLGVGAGLLWAAQGAIMTSYPPTNRKG

SEQ ID NO: 1361 - protein, 344 aa, Zea mays
  unsure (1)..(344): unsure at all Xaa locations
MRPSLLKSTAELLRRSRGYASSANPERKVAILGAAGGIGQPLSLLMKLNPLVSSLSLYDIAGTPGVAADVSHINSPALVKGFMGDDQLGEALEGSDIVIIPAGVPRKPGMTRDDLFNINAGIVKALCTAIAKHCPNALVNMISNPVNSTVPIAAEXVFKKAGTYDEKKLXFGVTTLDVVRAKTFYAXERAGVPVTEVNVSCLSGAMAGITILPLFSQATPAXNSLSQEDIEALTKRTQDGGTEVVEAKAGKGSATLSMAYAGAVFADACLKGLNGVPDIVECSFVQSTVTELPFFASKVRLGKNGVEEVLGLGELNDFEKKGLESLKVELKSSIEKGIKFAHGN

SEQ ID NO: 1362 - protein, 503 aa, Yersinia pestis CO92
MTQQNTKIPAQQGAQRLRRELKSRHLAMIAIGGSIGTGLFVASGATVSQAGPGGALLSYALIGLMVYFLMTSLGELAAFMPVSGSFSTYGSKYVEEGFGFALGWNYWYNWAVTIAVDLVAAQLVMNYWFPDAPGWIWSALFLGLMFLLNYISVKGFGEAEYWFSLIKVTTVVIFIIVGVMMITGIMKGGETAGWHNWTIGDAPFAGGFSAMIGVAMIVGFSFQGTELIGIAAGESKDPGKNIPKAIRKVFWRILLFYIFAILIISLIIPYTDPSLLRNDVKDISVSPFTLVFQNAGLLSAAAVMNAVILTAVLSAGNSGMYASTRMLFTLASEGKAPRIFAKLSKGGVPRNALYATTVVAGLCFLSSMFGNQTVYLWLLNTSGMTGFIAWLGIAISHYRFRRGYMMQGRDLNDLPYQSGFFPLGPIFAFVLCLIITLGQNYQAFLQDRIDWYGVTATYIGIPLFLVIWFGYKLSRGTRVVKYQEMEFPKWRDESEEHQKPTSR

SEQ ID NO: 1363 - protein, 585 aa, Lactobacillus plantarum WCFS1
MAKMIEASVAMLKVIEAWDVKQIYGYAGGSFNSTMHALDVEQERLQYVQVRHEQVGALAAAADAKLTGKIGVAFGSAGPGAVNLLNGLYDAKEDHVPVLALVGQVAHTNMNYDYFQEFAEEPIFSDVAVFNRTVMTPESLPYVVDKAIRTAYRENGVAVVTIPNDFGYVEIPDLNYDSASVPAKLTGIPTIDDEQVKTVLTMIKNAKYPVFHVGQGTRGATEDMMALAERLQVPIIITGLAKGVIPDSFDGNMGSAYRAASKAADELMGITDLVVSVGADYSFAQIMYTTHDFKYVQIELDPGKFGRHHHLDFGVNGDAKVFIKRALALSEPASPSPYYQAAKADMADWKQYLKKLSERTTDPLEYEQVYQEINRVAADDAVFSMDVGDNTINSFRFLKMNPKQKLLTSALFATMGAGVPGAIAAKMSYPDRQAFNIAGDGAFSMVMQDLLTEVKYHLPIFNIVTSTQTLNFIKSEQEDVPQPYYGIDLIDADFAKIAEGMGVKGIRVEHFDQLHAAFETAMTELKAGRPVLIDAKITDKRGLPVEILDVDPTKTSDASVSAFKEKYDANELKPLTSYFKEFNVE

SEQ ID NO: 1364 - protein, 323 aa, Zea mays
MTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVSDVVILSSDGEKLNSMNLLLYMAPIAVIFLLPATIFMEDNVVGVTIELAKKDFTIVWLLLFNSCLSYFVNLTNFLVTKHTSALTLQVLGNAKGAVAVVVSIMIFRNPVSITGMLGYTLTVFGVILYSESKKRSNKP

SEQ ID NO: 1365 - protein, 825 aa, Pichia anomala
MLLPLYGLASFLVLSQAALVNTSAPQASNDDPFNHSPSFYPTPQGGRINDGKWQAAFYRARELVDQMSIAEKVNLTTGVGSASGPCSGNTGSVPRLNISSICVQDGPLSVRAADLTDVFPCGMAASSSFNKQLIYDRAVAIGSEFKGKGADAILGPVYGPMGVKAAGGRGWEGHGPDPYLEGVIAYLQTIGIQSQGVVSTAKHLIGNEQEHFRFAKKDKHAGKIDPGMFNTSSSLSSEIDDRAMHEIYLWPFAEAVRGGVSSIMCSYNKLNGSHACQNSYLLNYLLKEELGFQGFVMTDWGALYSGIDAANAGLDMDMPCEAQYFGGNLTTAVLNGTLPQDRLDDMATRILSALIYSGVHNPDGPNYNAQTFLTEGHEYFKQQEGDIVVLNKHVDVRSDINRAVALRSAVEGVVLLKNEHETLPLGREKVKRISILGQAAGDDSKGTSCSLRGCGSGAIGTGYGSGAGTFSYFVTPADGIGARAQQEKISYEFIGDSWNQAAAMDSALYADAAIEVANSVAGEEIGDVDGNYGDLNNLTLWHNAVPLIKNISSINNNTIVIVTSGQQIDLEPFIDNENVTAVIYSSYLGQDFGTVLAKVLFGDENPSGKLPFTIAKDVNDYIPVIEKVDVPDPVDKFTESIYVDYRYFDKYNKPVRYEFGYGLSYSNFSLSDIEIQTLQPFSENAEPAANYSETYQYKQSNMDPSEYTVPEGFKELANYTYPYIHDASSIKANSSYDYPEGYSTEQLDGPKSLAAGGLGGNHTCGMLVTLSLLKSQIKVLMLVGLHLNCMLDIQIMMNSQHLQCNYVDLKRCFWIKIILKLFLLN

SEQ ID NO: 1366 - protein, 380 aa, Triticum aestivum
MADRANHPSVMQKFGGQFHLASSFSEGVRARNICPSVPSYERRFTTSSYMTQNLGISVPIMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILKKEGAKSLFKGAGANILRAIAGAGVLSGYDQLQILFFGKKYGSGGA

SEQ ID NO: 1367 - protein, 686 aa, Bacillus circulans
APDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIINFAPNHTSPASSDQPSFAENGRLYDNGTLLGGYTNDTQNLFHHNGGTDFSTTENGIYKNLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 1368 - protein, 427 aa, Chlorobium tepidum TLS [sequence omitted]

SEQ ID NO: 1369 - protein, 211 aa, Zea mays
  unsure (1)..(211): unsure at all Xaa locations
MISLTKLLSSALHGYHSCSIRRFSWFAALGEHQFAVANFSKFVTRLVRQKSSCVCWRLNQKTCGXLYDPLRDKWITLPVMPSQIRNIARFGVASVAGKLYVIGGGSDRVDPLTGDHDRILASNEVWSYDPLHRVWSQRAPMLVARAMFACCALDGKIIVAGGFTNCRKSISKAEIYDPEAGIWEPLPDLRLAHSSACTGLVIRXKMHVLHK

SEQ ID NO: 1370 - protein, 327 aa, Bradyrhizobium japonicum USDA 110
MRAMVLAAPRARLRMEERPDPIPGEGQIRVRVSACGVCRTDLHVVDAELPDIRYPIVPGHEIVGRIDLVGPDVATHALGDRVGIPWLGFTCGNCRFCREGMENLCDRPLFTGYTRDGGYATHVVADARYAFPLGEAGDDVALAPLLCAGLIGWRSLVLAGQAERLGIYGFGAAGHIVAQVAVWQGRSVHAFTRRGDLAAQDLARRLGAVWAGASDEMPDTPLDAAIIYAPAGELVPAALRAVRKGGRVVCAGIHMSDIPSFPYDLLWQERQLISVANLTRQDGLDFLRIAPQAGVRTETTAFPLDQANEVLDMLRNGQILGAAVLRP

SEQ ID NO: 1371 - protein, 481 aa, Sorghum bicolor
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMQGRKNVMKVLKQQLDERRNGAERKTVDFFDLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 1372 - protein, 464 aa, Onikusa sp. No103
KMGYWDPDYVVKETDVLALFRVSPQPGVDPIEASAAVAGESSTATWTVVWTDLLTACDLYRAKAYKVEAVPKTTDQFFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAASGEVKGHYMNVTAATMEEMYERAEFAKQLGTVIIMIDLVIGYTAIQTMAIWARKNDMILHLHRAGNSTYSRQKNHGMNFRVICKWMRMAGVDHIHAGTVVGKLEGDPEMIRGFYNTLLLTHLDKNLVQGIFFEQDWASLRKVTPVASGGIHCGQMHQLLDYLGNDVVLQFGGGTIGHPDGIQAGATANRVALEAMVIARNEGRNYVAEGPQILRDAAKTCGPLQTALDLWKDITFNYTSTDTADFVETPTANV

SEQ ID NO: 1373 - protein, 195 aa, Zea mays
  unsure (1)..(195): unsure at all Xaa locations
ACVSPAGGKGRRWWRWRPLTRAWRGIASSIRVIPXFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRDKLGDRPVFVLVEADA

SEQ ID NO: 1374 - protein, 127 aa, Glycine max
CGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 1375 - protein, 247 aa, Desulfitobacterium hafniense
MGFTKEECLKYVQENDVRFIRMQFTDIFGQMKNIAITHNQLAQALDEGVLFDGSAIKGFAGVEASDMLLLPDPSTFTLIPWRPQQGKVARIICDVKNHDGSQFEGDPRYILKRTLQKAHDLGYVFQVGPECEFFLFHTDEEGQPTTITHDAAGYCDLAPIDQGENTRREICLVLEEMGFEIETSHHESAAGQHEIDFKYTDALTAADHIMTFKYVVKIVSQRNGLHATFMPKPLHGVNGSGMPSICP

SEQ ID NO: 1376 - protein, 577 aa, Bacillus anthracis str. Ames
MNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVQAVNKQFPKALLHWEDFSSRNARKILDKYRHDICTFNDDIQGTGAVSLAAVLSAVKASGVPLSEHRVVVFGAGTAGIGIADQVRDAMVRVGVSEEESYKRFWCIDRNGLVTDNMEDLLDFQIPYARKEAEVSEWKENGVIGLAEVVKHVKPTILIGTSTVAGAFKEEIIKEMASHVERPIILPMSNPTPLAEAKPADLIEWTEGRALVATGSPFEPVTYNGVTYVIGQSNNALIFPGLGLGTIVVRASVMTDGMFAAAAEAVASMVDTSQPGAPILPEVEELRNISEMVAIEVAKVAVAEGVARENFSDNDIKIAVKEAIWEPEYRQIKAVEKVTI

SEQ ID NO: 1377 - protein, 456 aa, Oenococcus oeni MCW
MKKLNDSKNNMKRELSNRHIQLISIGGTIGTGLFLGASRSIAFTGPSIMLVYLAAGIFMFLVTRAMGEMLYMDPDQHTFINFISKYLGKPFGFFSGWTYWLSIIFTGMGELTAVGIYFQFWFPKMPMWIIQLMFLAAIMSINLITVKFFGEAEFWFAMIKISAIVALILTSIFMLATDFKTPIGAVGLTNISKNFQLFPNGFKNFVMAFPMVFFAYQGIEFVGITTSETKNPRAVLPKAINQIIIRILIFYIGSLIAIMLIYPWQSLDPKQSPFVWIFKLLGISWAAGLINFVVLTAASSALNSILYSSGRHLYQLASDSSGKFNKNCAVISKNGVPARTICLSALAVAVSPIINSIPTIKDAFSVIASVSSGAYLLIYILTLFAHRKYTQSKDYLANGFLMPKPKFFGPLTIAFMVFILISMLFQKETCPGVVTALIWLVVFGGYSLAKYKNENS

SEQ ID NO: 1378 - protein, 517 aa, Arabidopsis thaliana
MGLGGDQSFVPVMDSGQVRLKELGYKQELKRDLSVFSNFAISFSIISVLTGITTTYNTGLRFGGTVTLVYGWFLAGSFTMCVGLSMAEICSSYPTSGGLYYWSAMLAGPRWAPLASWMTGCKVVVCLQWAVTASVDFSLAQLIQVIVLLSTGGRNGGGYKGSDFVVIGIHGGILFIHALLNSLPISVLSFIGQLAALWNLLGVLVLMILIPLVSTERATTKFVFTNFNTDNGLGITSYAYIFVLGLLMSQYTITGYDASAHMTEETVDADKNGPRGIISAIGISILFGWGYILGISYAVTDIPSLLSETNNSGGYAIAEIFYLAFKNRFGSGTGGIVCLGVVAVAVFFCGMSSVTSNSRMAYAFSRDGAMPMSPLWHKVNSREVPINAVWLSALISFCMALTSLGSIVAFQAMVSIATIGLYIAYAIPIILRVTLARNTFVPGPFSLGKYGMVVGWVAVLWVVTISVLFSLPVAYPITAETLNYTPVAVAGLVAITLSYWLFSARHWFTGPISNILS

SEQ ID NO: 1379 - protein, 224 aa, Zea mays
MDHAAEAQRTDLMTITRHALNEQGRHPESRGDFTILLSHIVLGCKFVASAVNKAGLAKLIGLAGETNVQGEEQKKLHALSHEVFGEALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEVILTHPHIKIPNKGKIYSVNEGNARNWDA

SEQ ID NO: 1380 - protein, 374 aa, Triticum aestivum
  unsure (1)..(374): unsure at all Xaa locations
MALTGDYKLISTDDMLQGHAELCIHAYGFVKSMALKCAIELGIPGAIHGHGGGATLGELATIIALPPSRLPRLRRLMRVLTVSGVFSVQNQQPDDPAGCAAVVYGLTAASRLLVGDGESIVGAAPPRXSLMVDPNLTAPFSGMSAWFMDDEQPRSFFEMHHGEDMWDMAARDAALSRTIGDGMTDDSRFVVEVLLREGRARDVFSGVRSMVDVGGGTGTIAKAIAAAFPHVECSVLDLPHVVAEAPAGGEVRFIEGDMFEHIPPADAVLLKSVMHDWRDDECVKILRRCKEAIPSREAGGKVIIINMVVGSEKSKGNSTKKGGGTSIVRSSSSWFLREVNEKSMSGRRSFLEAGFSGYSIIPMLGIRSIIEVYP

SEQ ID NO: 1381 - protein, 419 aa, Eremothecium gossypii
MSHPNTHMPRTHAVHGRAAPQRRGCRTSVEKTDQSGHSRSSLAESAMEQAQLRSRGEAGGGRSVLCASGEPGSAHKWAGAVTCSGAEEQPLHWAESRARGLARHLHYWELPYAWRENRYIIYGHRFYHSHRKSLLSVLNAYGWHNETINIWSHLVGAAVLAYLLCWGWPRSDVYRAAQVPRLAKWAIGAFLACGVKCMASSVAWHTFNGTCHLKLRSRFVCVDYTGITLLVTASVVTTVAVTLYGLSRPLMYAYMVASIGLGTAAGVMNWSPHFDRPEARPLRIAVYVGLAALGLVSFVHVWMQVRWASAHLMAPLVYKSLVWYGIGVVFYATLVPERWRSDVTLDCCSGPVHEAACRQFRDLPPVARKDRQFWSLWWVDYFCHSHFLWHVFVVLGVVGHYRAVLQMSRIVWLDAGRAF

SEQ ID NO: 1382 - protein, 535 aa, Triticum aestivum
MVHPLHALHELLLQARSPHAALGLVFVLLVCPLLALLVVRRLATPSTAAATARAREELLGRLPSPPSRLPIIGHMHLVGSLPHISLRDLAAKHGRDGLMLLRLGAVPTLVVSSPSAAEAVLRTHDHVFASRPYSAVAASLVSGPTGAAVAPFGLLWRQRWKVASSHRLSYGMVRAYRCARDHQVRSVVAKIRDAASKCTVIDLTDLLNAFTNDIVCEAVSGRLFRERGHKKLFRELVEANSLLLGGFNLEDYFPMLVKMDIIKRIVCAKAQKVNKMWDNLLNNIIDEHARKSVPEHNNEDSDFTDVLLSIQQEYKLTRDHIKAQLEIMFEAGTDTSFIVLEYAMVQLMRKPHLMNKLQAEVRSTITKGKEIVTEDDLDSLAYLKAVIKETLRLHMPGPLLIPHLSMADCNIKGYTIPSGIRVIINSWALARDPSSWEHADEFMPERFMECGSAATMDYKGNDFQYLPFGAGRRICPGMNYATASIEIMLANLMYHFNWKLPVELMDEGGISMTEFFGMTVHRKEKLLLVPVVPED

SEQ ID NO: 1383 - protein, 69 aa, Zea mays
NGKLRILYEVFPMSFLMEQAGGQSFTGKERALDLVPTKIHDRSPIFLGSYDDVEEIKALYAEQAKSSSA

SEQ ID NO: 1384 - protein, 564 aa, Saccharomyces kluyveri
MSEITLGLYLFERLNQVDVKTIFGLPGDFNLSLLDKIYEVPGMRWAGNANELNAAYAADGYARVKGMSCVITTFGVGELSALNGIAGSYAEHVGVLHVVGVPSVSSQAKQLLLHHTFPNGDFTVFHRMSANISETTAWVTDIATAPAEIDRCIRTTYVTQRPVYLGLPATLVDLMVPASLLDTPIDMSLKPNDPEAEAEVVNSVLELIKEAKNPIILADACASRHDVKPETKQLIDITQFPAFVTPLGKGSIDEQHPRFGGVYVGTFANDDVKEAVESADLILSVGALLSDFNTGSFSYSYKTKNIVEFHSDYIKIRNATFPGVQMKFALQKLLSEIGAVVKDYKPVAVPPKPTPNPACDPSTPLKQEWVWNQVGRFLQEGDVVITETGTSAFGINQTHFPNNTYGISQVLWGSIGFTTGACLGARCAAEELDKNKRVILFIGDGSLQLTVQEISTMIRWGLRPYLFVLNNDGYTIERLIHGENAQYNEIQPWKNLDLLPTFGAKDYETHRVATTGEWDKLAQDEAFNKNSRIRMVEVMLPVMDAPSNLVKQAQLTASINAKQD

SEQ ID NO: 1385 - protein, 219 aa, Lilium longiflorum
VEQFSPVPYLATLLNCMLWVVYGLPLVHPHSTLVLTINGLGLIIELTYVLLFLLYSNGRARIRVLAMLLTEIVFVGLITVIVLSTAHTLVTRSLIIGVLCVFFGTMMYAAPLSVMKLVIQTKSVEYMPLFLSVASFLNGICWTTYALIRFDLFITIPNALGTMFAVAQLILHAMYYKSTKIQMEAQKRKLEMGFEEVMAPVENTEKIRGASQTGKYPPV

SEQ ID NO: 1386 - protein, 204 aa, Zea mays
MGNPEKLMNQIFDLKFTSKSLQRQARKCEKEEKEQKLKVKKAIEKGNMDGARIYAENAIRKRTEHMNYLRLASRLDAVVARLDTQAKMQVIGKSMQSIVKSLDSALATGNLQKMSETMDNFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 1387 - protein, 365 aa, Mesembryanthemum crystallinum
MTTYTNGNYTQPKTLDKDEQLAGLAVTLANAAAFPMILKSAFELKILDIFSKAGEGVFVSTSEIASQIGAKNPNAPVLLDRMLRLLASHSVLTCKLQKGEGGSQRVYGPAPLCNYLASNDGQGSLGPLLVLHHDKVMMESWFHLNDYILEGGVPFKRAHGMIQFDYTGTDERFNHVFNQGMAHHTILVMKKLLDNYNGFNDVKVLVDVGGNIGVNVSMIVAKHTHIKGINYDLPHVIADAPSYPGVEHVGGNMFESIPQADAIFMKWVLHDWSDEHCVKILNKCYESLAKGGKIILVESLIPVIPEDNLESHMVFSLDCHTLVHNQGGKERSKEDFEALASKTGFSTVDVICCAYDTWVMELYKK

SEQ ID NO: 1388 - protein, 191 aa, Cucumis sativus
EFCSTSNMLKTLERYQKCSYGAVEVTKPTKELESSYREYLKLKSRFESLQRTQRNLLGEDLGPLNSKELEQLERQLESSLKQVRSTKTQYMLDQLSDLQNKEQMLIETNRALQIKLEEISSRNNIRLTWDGGDQSMSYGPQNAQTQGFFQPLECNPTLQIGYTSAVSDQITSTTTPTHAQQVNGFLPGWML

SEQ ID NO: 1389 - protein, 408 aa, Magnaporthe grisea
MAAALAHSSGMIPSMVGVPPSTSYENGSGGNSSTTAGHGSVNDGSRTSRNALQGDLKSDAASAQSQNRKLQLSDFKKVRTLGTGTFARVCLVRPSNPQNETERNKVFALKILRKSEVVKLKQIDHVRHERAILADVSGFPFITNMLASFSDHDFLYIVLDYVPGGELFSYLRKYRRFDEDMARFYAAEIVLVLEYLHEAQDGVAYRDLKPENLLLDGQGHIKLVDFGFAKRLGGRRDGDNSGTQETYTLCGTPEYLAPEVIHNKGHTTAVDWWALGILIYEFLTGYPPFWHQNPIEIYKQIVEKPVVFPQDPPISPNAQDIIRQFCTVDRSRRLGNISGGAARVKEHPFFEGVDWEAIYSRKFPGPILPPIRYPGDAQCFDIYPEEDVGKDPYTDEMAQKYDHYFQDF

SEQ ID NO: 1390 - protein, 317 aa, Bacteroides thetaiotaomicron VPI-5482
MRVIDLIHNSEKTAFSFEILPPLKGTGIEKLYQTVDTLREFDPKYINITTHRSEYVYKDLGNGLFQRNRLRRRPGTVAVAAAIQNKYNITVVPHILCSGFTREETEYVLLDLQFLNITDLLVLRGDKAKHESVFTPEGDGYHHAIELQEQINNFNKGIFVDGSEMKVTNSPFSYGVACYPEKHEEAPNIESDLFWLKKKVEAGAEYAVTQLFYDNKKYFEFVEQAKAAGINVPIIPGIKPFKKLSQLSMVPKTFKVDLPEDLVKEALKCKNDKEAEQVGIEWCVAQCKELMAHGVPSIHFYSIGAVDSIKEVAKIIY

SEQ ID NO: 1391 - protein, 347 aa, Eucalyptus gunnii
MRASMLRLIRSRSSSAAPRPHLLRRAYGSESVPERKVAVLGAAGGIGQPLALLMKLNPLVSQLALYDIAGTPGVAADVGHINTRSEVAGYVGEEQLGQALEGSDVVIIPAGVPRKPGMTRDDLFNINAGIVKSLCTAIAKYCPNAVVNMISNPVNSTVPIAAEIFKKAGTYNEKKLLGVTTLDVVRAKTFYAGKAKVPVEEVNVPVVGGHAGITILPLFSQAVPKANLADEDIKALTKRTQDGGTEVVEAKAGKGSATLSMAYAGALFADACLKGLNGVPDVVECSFVQSSIITELPFFASKVKLGKNGVEEVLELGPMSDYEKQGLEILIPELKASIEKGIKFANQ

SEQ ID NO: 1392 - protein, 45 aa, Zea mays
SEKLAEGIAGFTKALEVLEHLLEERLKVLDGQEHIKHGAEEIFHA

SEQ ID NO: 1393 - protein, 917 aa, Botryotinia fuckeliana
MPSLHGLWSHINVTLANLTNNRDEDGDHIDSDTPRSGVATPQPDPSDKRTPGILHSFYGQVGLGSSSSQNSAKHISRTSQNPNTSALEGHYTSPRQRFEAEGALLKATPSSLDERRIDGGVEKENSLLPPHELLGSSQISKQQYPYPTPPVSHPSSLHKVKLSDASFEDIGNNVQKTAAPTDRDCISESIPSHARRASSMTPLSNIVTPSNVHAAHFSNPSDTPSEHKLSTPPLSRLNSEFHKSPSYDRLKKLTCDGLKSIPSTPTRALSNQTSKSDQSVMSTNSEHVAQNGKSGASERPAVTPRTDSSMGGTVVPPKGKLTVKINEARGLRRSVDPYVVAVFQRNELVSKGPQSEEDDEDDGNSHSPGGIPIGGIPIGGIPITRSGSDSGRSMAIPMKSRQSSNTSLSEYRDFKNKGRKMFTHPKWDAEAVFDVVGSDTRVNITIYDRAQQAEEFLGHVDLQANLVENVDAPVSGWFQLRGKDMTSNAGNVGEVHVEISFQRTEKRHYGPDDFQILKLIGKGTFGQVYQVRKKDTKRIYAMKVLQKKVIVQKKEVAHTVGERNILVRTATADSPFIVGLKFSFQTPTDLYLVTDYMSGGELFWHLQKEGRFDEQRAKFYIAELILALEHLHKHDIVYRDLKPENILLDANGHIALCDFGLSKANLTKNATTNTFCGTTEYLAPEVLLDEAGYTKMVDFWSLGVLVFEMCCGWSPFYAEDTQQMYKNIAFGKVRFPRDTLTTEGRNFVKGLLNRNPKHRLGATDDAEELKRHPFFQDIDWHALTQKLITPPFKPKLKSETDTSNFDPEFTNALNGASSLNARAAALAAGMATSTPLSPGMQANFKGFTFVDESSIEENMKDRIKDEYEDRMDQDNNDPERDWEDTFDIPDKSRMDRMSGVVRNHNEDERMFNGDDFH

SEQ ID NO: 1394 - protein, 614 aa, Glycine max
  unsure (1)..(614): unsure at all Xaa locations
MFRRSILLISSRPTLRRNPRRFVYQKIPLHLSLQKNFSTASKPGVSSASGSPGKPPESNGTLSKFFIGSVALGAAFLAAYQTGYLDQYLKKEHYSVPQEPHVNATIEDLKSVQHSTDQLISPSEKFNHENPTVEITEQKIDAHFSQPEIVVEDQVDKPVPAQDVSDIAEDVTAAAKENQLPEHPQSSLTFNDPSKESVAQFDGIIGIQSHETGNAPRLEEGHHTSTSTQTSAVPDENGMKNIQPEQLAIQETERRESALGKDIEQLPTLLEEYQLRNKSEKSPATYRSSHGFTENSHFPEGKEALSGAMEELKDGYISENGKLVLDFLQAIHAAEKRQADLHARVFSEEKKVLKEKFQXKSLQEKMEEKLKTELEQKEIETDLKFKQTQELAKAELNAAIANEKAAQIEKMAEANVNINALCMAFYARSEEARQSHATQNFALRALALEDALSKGLPIETEIASLQSYLGSTDKDSILDLVLASLPEETRSNGTDTQLQLKQKFDALKGSVRHFSFFPPGGGGMLAHSLAHLASWLKVREDDQSGDGIESVINKVEVYLAEGKLAEAADCLEESVRGTQAAEIVAGWVRQARNRAISEQAVLLLQSYANSLSLT

SEQ ID NO: 1395 - protein, 539 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVLQTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESKGKSLEEMSGEAEDSEEEPVGARAVRPSETQMV

SEQ ID NO: 1396 - protein, 395 aa, Beta vulgaris
MALLHHLNKTKSLSSLLLPLTSTHTHSRRLSSDSTKTLTIETSVPFKSHIVEPPSRSVDTTPAELMTYFRDMALMRRMEIASDSLYKAKLIRGFCHLYDGQEAVAVGMEAAITKKDNIITAYRDHCIYLARGGSLLSAFAELVGRQDGCSRGKGGSMHFYKKDSGFYGGHGIVGAQVPLGVGLAFAQKYNKEDCVSFALYGDGAANQGQLFEALNMAALWDLPAILVCENNHYGMGTAEWRAAKSPSYYKRGDYVPGLKVDGMDVLAVKQACKSAKEYVLKNGPIILEMDTYRYHGHSMSDPGSTYRTRDEISGIRQERDPIERVRKLLLAHDIAGEKELKDIEKEIRKEVDEAIAKAKESPMPDTSELFTNIYVKGYGVESFGADRKVLRTTLP

SEQ ID NO: 1397 - protein, 779 aa, Burkholderia fungorum
MPSNVYSNLPFEARLMSTPVNSKLREAALDYHEFPTPGKIAIAPTKQMINQRDLALAYSPGVAFACEEIVENPLNAARFTARSNLVGVVTNGTAVLGLGNIGPLASKPVMEGKAVLFKKFAGIDVFDIELNESDPHKLVDVIAALEPTFGGINLEDIKAPDCFIVERECRKRMKIPVFHDDQHGTAIVVAAAITNGLKVVGKDIREVKLVSSGAGAAALACLDLLVDIGLPLENITVTDLAGVVYKGRVELMDPDKERFARETDARTLAEAIGGADVFLGLSAGGVLKQDMVKQMADKPLILALANPTPEILPELALEVRPDAVLCTGRTDYPNQVNNVLVFPFLFRGALDAGATTVTREMEIAAVNAIAELARQEQSDIVATAYGIQDLSFGPEYLIPKPFDPRLIVKVAPAVAQAAMDSGVAERPIEDMDAYEQHLQQFVYHSGTTMKPIFQLARSVEPEKKRIVFAEGEEERVLRAMQIIVDEKLAKPILIGRPAVIEQRIARYGLRLVAGQDYTVVNTDHDERYRDFWQEYHRMMSRKGISAQMAKLEMRRRTTLIGAMLVEKGEADGMICGTVSTTHRHLHFIDQVIGRKAGAKVYAAMNALVLPNRQIFLVDTHVNVDPTPEQLAEITIMAAEEVRRFGIEPKVALLSHSNFGTSNAPTAQKMRDTLAILRERAPDLQVDGEMHGDIALDANLRREVMPDSTLEGDANLLVLPNIDAANISYNLLKTAAGNNIAIGPILLGAARPVHVLTASATVRRIVNMTALLVADVIAAR

SEQ ID NO: 1398 - protein, 882 aa, Xylella fastidiosa Temecula1
MPLPIAAPPILASTLTLLLATTPTAAALTPEQHAAALVAQMTRQEKIAQTMNAAPAIPRLGIPAYDWWSEGLHGIARNGYATVFPQAIGLAASWNTDLLQHVGTVTSTEARAKFNLTGGPGKDHPRYAGLTLWSPNINIFRDPRWGRGMETYGEDPYLTSQLAVSFIRGLQGDTPDHPRTIATPKHFAVHSGPEQGRHSFDVDVSAYDLEATYTPAFRAAIVDGHAGSVMCAYNALHGTPACASDWLLNTRLRNDWGFNGFVVSDCDAIEDMTRFHFFRQDNASASAAALKSGNDLNCGNTYRDLNQAIARGDIDESTLDQALIRLFTARQRLGTLQPREHDPYAAIGIKHIDTPAHRALALQAAAQSLVLLKNSGNTLPLPPETTLAVLGPDADSLTALEANYQGTSSTPVTPLTGLRTRFGTAKVHYAQGASLAPGVPNTIPETALRNHGHPGLKGEYFDTIDFSGPPHLVRQDRIIAFNWDHVAPAPGMNPHRYAVRWTGELLPPGPGTYTFAVHVARCFDCNGRDPIRLYIDDRQIIPDNATAAQATTAPQQTNNTHLEATLHFTDTRPHHIRLDMEHRGEDQGVRLEWLAPETPQLAEAERAVAHADAIVAFVGLSPEVEGEELHIDTPGFSGGDRTTIDLPATQETLLQHVKTTGKPLIVVLMSGSAVALNWAQHHADAILAAWYPGQSGGTAIAQALAGDVNPGGRLPVTFYRSTQDLPPYISYDMTGRTYRYFKGQPLYPFGYGLSYTQFAYEAPQLSTATLKAGNTLTVTTHVRNTGTRAGDEVVQLYLEPPYSPQAPLRSLVGFKRVTLRPGESRLLTFTLDARQLSSVQQTGQRSVEAGHYHLFVGGGQPNTGAPGGTAAFSIIGRALLPK

SEQ ID NO: 1399 - protein, 422 aa, Schizosaccharomyces pombe
MDRRHRVYRVFNQEMYVEPNFKVVKELGQGAYGIVCAARNVASKDQEAVAIKKITNVFSKSILTKRALREIKLLIHFRNHRNITCIYDLDIINPYNFNEVYIYEELMEADLNAIIKSGQPLTDAHFQSFIYQILCGLKYIHSANVIHRDLKPGNLLVNADCELKICDFGLARGCSENPEENPGFMTEYVATRWYRAPEIMLSFSSYHKGIDVWSVGCILAELLGGTPLFKGKDFVHQLNLILHQLGTPDEETLSHISSSRAQEYVRSLPKQRPIPFETNFPKANPLALDLLAKLLAFDPNRRISVDDALEHPYLAVWHDPSDEPVCDSVFDFSFEYIEDANELRRVILDEVLNFRQKVRRRSHPTNPTVNIPQPAQTVPSNDNGSFNVSSSSSSQTSNKKRHDHSYNETAAIDHKSDDNRHN

SEQ ID NO: 1400 - protein, 666 aa, Streptococcus pyogenes M1 GAS
MSDSHLTAFDKASKAGFIIALGIVYGDIGTSPLYTIQSLVENQGGVNQVSESFILGSISLIIWTLTLITTIKYVLIALKADNHHEGGIFSLFTLVRKMSPWLIIPAMIGGATLLSDGALTPAVTVTSAIEGLKAVPGLSHIYQNQTNVIITTLVILIVLFGIQRFGTGFIGKIFGPVMFIWFSFLGVSGFFNTLGHLEIFKAINPYYALHLLFSPENHRGIFILGSIFLATTGAEALYSDLGHVGRGNIYVSWPFVKMCIVLSYCGQAAWILANKHSGIELNPFFASVPSQLRVYLVSLATLAAIIASQALISGSFTLVSEAMRLKIFPLFRVTYPGANLGQLYIPVINWILFAVTSCTVLAFRTSAHMEAAYGLAITITMLMTTILLKYYLIKKGTRPILAHLVMAFFALVEFIFFLASAIKFMHGGYAVVILALAIVFVMFIWHAGTRIVFKYVKSLNLNDYKEQIKQLRDDVCFDLYQTNVVYLSNRMQDHMIDRSILYSILDKRPKRAQVYWFVNVQVTDEPYTAKYKVDMMGTDYMVRVNLYLGFRMPQTVPRYLRTIVQDLMESGRLPKQEQEYTITPGRDVGDFRFVLIEERVSNARQLSNFERFIMQTKASIKHVTASPMRWFGLQYSEVTLEVVPLILSDVLKLPIKELVPVEDSEA

SEQ ID NO: 1401 - protein, 427 aa, Coxiella burnetii
MTELTGVSIVTYQHIKVPSEGEKITVNKAVLEVPDRPIIPFIEGDGIGIDITPVMKNVVDAAVEKSYAGKRKIEWMEIYAGEKATKAYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSASQFAKAIIKHIL

SEQ ID NO: 1402 - protein, 433 aa, Pinus sylvestris
MAMAASTMMRSSVTAGSFRENHRPSVAVDAQIRSKITSTDGTVRLPFGSFGSNFFGSTAEFGQGSALQCQSARTLQPVRATATEAPPRVQRSSGKERTKIGINGFGRIGRLVLRVALSKEDIQVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADAPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVGSRK

SEQ ID NO: 1403 - protein, 458 aa, Zea mays
MALTTASTVSSPSRIIRRFSSSQDSRPPSSLLHLAPRRGPGNSPRACSWHRLVVRRMGWAARALLGGLSDAGASESDEEEEHVLRVGQREGEIDDAVELSAAAVGPERWDVLGLGQAMVDFSGMVDDEFLDRLGIEKGTRKVINHEERGRVLRAMDGCSYKAAAGGSLSNSLVALARLGSSQSAGYPELNIVMGGSVGSDPLGSFYRAKLRRANVHFLSKPVKDGTTGTVIVLTTPDAQRTMLAYQGTSSTLSYDSDLASLVSKSNVLIVEGYLFELPHTIEAIKQACEDAHKNGAIIAVTASDVSCIKRCYNDFRDIVRNYADILFANANEARALCELPSTDSPMSATRYLSHSVPLVSVTDGMHGSYIGVKGEAIYIPPPQCVAVDTCGAGDAYASGILYGVLRGASDLKGIGLLASRVAAVVVGQQGTRLRVQDADRLAGSFEHHLDSLEFCSDV

SEQ ID NO: 1404 - protein, 517 aa, Bifidobacterium longum NCC2705
MTTTTASPVSKQTASAAQETSATGAAATAIETIETGVAGVAGAATNAAANAIEDLEAAESHGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 1405 - protein, 255 aa, Thermotoga maritima
ITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 1406 - protein, 486 aa, Pseudomonas sp. CF600
MKEIKHFINGAFVGSASGRTFEDVNPANGQVIARVHEAGRAEVDAAVQAARAALKGPWGKMSVSERAEILHRVADGITARFDEFLEAECLDTGKPKSLASHIDIPRGAANFKVFADLLKNVATEAFEMATPDGSGAINYAVRRPKGVIGVISPWNLPLLLMTWKVGPALACGNTVVVKPSEETPLTTALLGEVMQAAGVPAGVYNVVHGFGPDSAGAFLTEHPDVNAITFTGETRTGEAIMRAAAKGVRPVSFELGGKNAGIVFADCDLDKAIEGSMRSVFANGGQVCLGTERLYVERPIFDEFVARLKAGAESLVIGTPDDPQANFGPLISLQHREKVLSYYQKAVDEGATVVTGGGVPEMPAELAGGAWVQPTIWTGLADGAAVVTEEIFGPCCHIRPFDREEEAVELANSLPYGLAATIWTENTSRAHRVAGQLEAGIVWVNSWFLRDLRTAFGGSKQSGIGREGGVHSLEFYTELKNICVKL

SEQ ID NO: 1407 - protein, 317 aa, Phalaenopsis sp.
MELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 1408 - protein, 398 aa, Oryza sativa
  unsure (1)..(398): unsure at all Xaa locations
MAMAMAMRRAAALGARHILAASSTSSSGVLLRRHMSVDAGAAMEKVRAAGLLRTQGLIGGKWVDAYDGKTIEVQNPATGETLANVSCMGSKETSDAIASAHSTFYSWSKLTANERSKALRKWHDLIISHKEELALLMTLEPGKPMKEALVEVTYGARFIEYFAEEAKRIYGDIIPPTLSXDRRLLVLKPXPLGVVGAVTPWNFPLAMITRKVGPALACGCTVVVKPSEFTPLTALAAADLALQAGIPAGAINVVMGNAPEIGDALLQSTQVRKITFTGSTAVGKKLMAGSANTVKKVSLELGGNAPCIVFDDADIDVAIKGSFRNSGQTCVCANRILVQEGIYEKFASAFIKAVQSLKVGNGLEESTSQGPLINEAAVQKVEKFINDATSKGANIMLG

SEQ ID NO: 1409 - protein, 306 aa, Neurospora crassa
MTSDKPVVAATTTKTKKSKQQTIHYPFWFGGSASSMAATVTHPLDLVKVRLQMRTGDAPKTMSGTVLHIIRHNGITGLYNGLSASLLRQITYSTTRFGIYEELKTRFTTKDHPASFPVLIAMATVSGVAGGLVGNVADVLNVRMQHDAALPPAQRRNYAHAIDGLARMTREEGFRSWFRGVWPNSARAAAMTASQLASYDVFKRILIRHTPLEDNLATHFSASFLAGVAAATVTSPIDVVKTRVMSASGKSSIGQVLGSLYAQEGVRWMFKGWVPSFLRLGPQTICTFIFLEGHRKMYKKVKGIEE

SEQ ID NO: 1410 - protein, 300 aa, Symbiodinium sp. JCUCS-1
RIGRQVARIAMKDPETELKLINASYDSDYLAYMMKYDTIHGKYDGTVEADGDSLVVDGEKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNIIPSSTGAAKAVAKVIPDVKGKLTGMALRVPTIDVSVVDLTVELEKETTYEEICAEMKKRSEGDMKGFLGYTDEALVSTDFETCPISCTFDAKAGIMLDPTFVKVVC

SEQ ID NO: 1411 - protein, 316 aa, GIBBERELLA ZEAE PH-1
MATAQETMSKTTEASTPAKVTADAKKAMIRYPFWFGGSASSMAACVTHPLDLVKVRLQMRTGNAPKNMVGTFVHILRNDGPLGLYSGISASLLRQMSYSTVRFGVYEELKTRITRRNEGRDPSFATLVGLAAGSGFVGGIAGNFADVLNVRMQHDAALPHAERRNYRHAFDGMVRMAREEGPKSMFRGWLPNSSRAMFMTAGQLASYDISKSLLLKYTPMEDNLKTHFTASFIAGFVAATITSPVDVIKTRVMSSTHDHGVLHLIRDIHRTDGLMWMFKGWVPSFLRLGPQTICTFVFLEMHRKAYRKVQGLDANL

SEQ ID NO: 1412 - protein, 412 aa, Glycine max
  unsure (1)..(412): unsure at all Xaa locations
MLPLLHLTHSSMALRLNPIPTQTFSLPQMPSLRSPRFRMASTLRSGSKEVENIKKPFTPPREVHVQVTHSMPPQKIEIFKSLEDWADQNILTHLKPVEKCWQPQDFLPDPSSDGFEEQVKELRERAKEIPDDYXLGLGAKELPDDYFVVLVGDMITEEALPTYQTMLNTLDGVRDETGASLTSWAIWTRAWTAEENRHGDXKQIEKTIQYLIGSGMDPRTENSPYLGFIYTSFQERATFISHGNTARLAKEHGDIKLAQICGMIASDEKRHETAYTKIVEKLFEVDPDGTVMAFADMMRKKIAMPAHLMYDGRDDNLSDNYTSCMTARIGVYTAKDYADILEXGEGRKAQEYVCGLPPRIRRLEERAQARGKESSTLKFXSWIHDREXTTLNACXPREEHGEXFRQYRSEKC

SEQ ID NO: 1413 - protein, 443 aa, GIBBERELLA ZEAE PH-1
MSMIATASPSPHPSSFGMPRPWETNRCPDYSLRPRTENDKVALPSIRQAFPELQLQTQPPHDLNTKPLVTGPPLGTAPLAAASPQYVHSPNSSKRRRLSMEREMESERVRQVPRLCYSPDRESPRQISPNLAIQAGTRENWTAPTRTSPYLTNGATHHSVPMEVGERLEARPALPSLPPPRSLEREAVLVSRGPAPAPVPTPVPTPAPAPASIPASVSASAPAPAPTEGYRSSHQPMSHSRTPIPESGVSPYRESSYGYPYHHPTRYQSLSAGSAHSFDRTPFTPGAYNAPYQDFVRFGEMGPASLSGDNKQRKRRGNLPKETTDKLRAWFVAHLQHPYPTEDEKQDLMRQTGLQMNQISNWFINARRRQLPTMINNARAETDAMSSARGGDMKVLATTERGDFDHGKREPVGPLSDGEGATYEEELEALSQRRPGTMGRGSV

SEQ ID NO: 1414 - protein, 433 aa, Streptococcus sobrinus
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAAARAAADYLEIPLYSYLGGFNTKVLPTPMMNIVNGGSHSDAPIAFQEFMIMPVGAPTFKEGLRWGAEVFHALKKILKERGLETAVGDEGGFAPRFDGIEDGVETILKAIETAGYEAGEKGIMLGFDCASSEFYEDGVYDYTKFEGEKGAKRSAAEQIDYIEGLVNKYPIITIEDAMDENDWEGWKALTERLGNRVQLVGDDFFVTNTDYLARGIKEGAANSILIKVNQIGTLTETFEAIEMAKEAGYTAVVSHRSGETEDSTIADIAVATNAGQIKTGSLSRTDRMAKYNQLLRIEDQLGEVAQYKGINSFYNLKK

SEQ ID NO: 1415 - protein, 281 aa, Glycine max
MEGMAPNSCARPVLEKKTRPQEQLNCPRCNSTNTKFCYYNNYSLTQPRYFCKTCRRYWTEGGSLRNVPVGGGSRKNKKVSVTASSSSSPKVPDLNPPINLSSVSAISSQNPKIMHGGQDLNLAFPAMEKYHHGMPPYVEMQNSDTTTTHHHHQTSSSCSAPPASLSALELLRSSMASRGLNPYAPSSSLMPNSTNSNALYSSGFPMQEVKPSLNFSSADGMGNRSYDHHQIQERGGGRLLFPFGDVKQLSAAAGADQVEHNKEQQGNSTGYWTGMIGEGTW

SEQ ID NO: 1416 - protein, 475 aa, Xanthomonas axonopodis pv. citri str. 306
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 1417 - protein, 313 aa, Agrobacterium tumefaciens str. C58
MRRTVMILCCGEALIDMLPRQTTLGEAGFAPYAGGAVFNTAIALGRLGVPSAFFTGLSDDMMGDILRETLRASKVDFSYCATLSRPTTIAFVKLVDGHATYAFYDENTAGRMITEAELPALGADCEALHFGAISLIPEPCGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKALALGAKAAAVTVSRAGANPPFAHEIGL

SEQ ID NO: 1418 - protein, 141 aa, Oryza sativa
  unsure (1)..(141): unsure at all Xaa locations
MISAKRLVQLAKKWQRIAALGRKRIMAKAQETEECSTSVAVKGHCVMYTADGRRFEVPLTYLGTAVFSELLRMSQEEFGFTSDGRIVLPFDAEXMEYAMCLLKRNPSVEVVNALLSSIPMSCHCTSRMVPTGGVNQQISCL

SEQ ID NO: 1419 - protein, 328 aa, Halobacterium sp. NRC-1
MFLSADEIAGLATPADYVDAVRSGYRQRGEGAPAEPRTALLREDPAGMFTDYSALLPDDGVMGGYTYSAGFGSGDAWFMTPLYDADSGAPLALLDGASMNPLKTGAAGAVGVDELARADASELAVIGSSAQAHGQVQATATVRDLDTIHVYSPTPESRESFAADLDADLDASVSAVESSAAAVTGADIVITATSASEPVFDSDNLDAGTHVTAMGQYHPEKRELDTAAIERATYVPDLRGRTTQDAGSFIAAVDAGVVDSDHIHAELGDVVAGTAPGRQSADEITVFDSGGTGIETVAAANMLYERAVEQDLGSELDFAPASEALYGE

SEQ ID NO: 1420 - protein, 596 aa, Zea mays
MVEIGSRVRGFLRNRWLVFVAAMWMQSCAGVGYLFGSLSPVIKASLGYNQRQVAGLGVAKDLGDSVGFLAGTLCSVLPLWAALLVGAAQNLVGYGWVWLAVTRRVPVPPLWAMCILIFIGNNGETYFNTAALVSCVQNFPKSRGPIVGILKGFAGLSGAILTQIYAIVHSPDDAALIFMVAVGPTMIVIALMFIVRPVGGHRQVRPSDNTSFTFVYSVCLLLAAYLMGVMLLEDLVDLSQSVTVLLTIVLIIFLLVPIVIPVLLSFFSDDDETLHALLLPSPRKEEPSASTSSEEQQEVILSEVEDEKPKDVDLLPASERQKRIAELQTRLFQAAADGAVRVKRRKGPRRGEDFTLMQALIKADFWLLFFSLLLGSGSGLTVIDNLGQMCQSLGYEETHIFVSMISIWNFLGRIGGGYFSEIIVKDYAYPRAIALAIAQILMAIGHFNFAMAWPGTMYVGTLLVGVGYGAHWAIVPAAASELFGVKNFGALYNFLTVANPAGSLVFSGVIASGIYDAEAAKQAQQRHSTSKLLATSGRVVSVVSEAAPALKCEGAICFFLSSLIMAGFCVVAFGLSLILVYRTKVVYAGLYGKPRT

SEQ ID NO: 1421 - protein, 681 aa, GIBBERELLA ZEAE PH-1
MPLLSRYSLRRNRGFLGSDSSALPSQDAQDRQQLRYELDLNSWNFRIWGVCASGFLTDSYNLFSTNVILASIAFVYWPNGPEWSGLLINFFTLLGSVVGQVLFGYLADRYGRTRLYGVELVLVIVSTIGVATSSRGYNDLSFLGLFTWWRFVMGIGIGAEYPLSAVITSEWSSTQSRATMLSSVFMMQPIGQALAQLVGLFVLLGFQRSHDLQGMRCGLDKLHEEECKKALDGVWRIVIGSGAVPALLAIIFRFFLFDCGIYSLEVRNKPGMALVNTQRIYGAPQGGGVETFPNRGAAARSMSASGDGMNSIPMGQFSQNQAPATYQINSPGGNNVAPSYRATDFGDGTHHGNPSQQAMPVQFSREDLHNYFIRDGNWAYLLGTAATWFFLDVSFYGMSLDNRGTLSTMWATTTPTKIDDSLECWTSSLRGGNSTVPDWAADGLPVWSTDATHPCNTIYDVLIEQTKQYLLTVSLASIAGSGCFVVFANRIPRRQWLTASFLVLAGLFVTTGCVYYGVHQKQGAPATVVCVAICHFMFNFGANTLTFIIPAEIFPTCYRCLCHGISAAAGKLGSLVAVLVVYGINQSYQAENRQGLIFLLFGSVAAVGAIFSWAYLPDSQRRVEYEGKTYLEAKTLEELGEGRIKARLGGEFVTIEEKWDAIKRRKRGSMRSDPSVPDGTT

SEQ ID NO: 1422 - protein, 359 aa, Zea mays
MALTTSTNNQALLDAQLELWHTSFAFIKSMALKSAVDLGIADAIHSHGGNATLPQIVSRAALHPSKIPCLRRLMRVLTAAGIFSAAHRSPDDGGGELVYGLTPASQLLVGGSSSLAPFMSLVLHQVYVSPFLGLGTWLQHERSDPTLFEMTHGLTAWDLNDHKPAFGELFNQGMVCDSSFVMDIVVKECGDVFRGLSSLVDVAGGLGAAALAISTAFPHVQCSVLDLPHVAANAPANTSVKYIAGDMFESIPPADAVFLKWVLHDWGDADCIKILKNCKKAIPSRDAGGKVIIVDMVVGGQSSNIKHKETQVLFDLFIMTINGAERDEHEWKKIISEAGFSDYKIIPVLGVRSIIEVYP

SEQ ID NO: 1423 - protein, 362 aa, Mycobacterium tuberculosis H37Rv
MSASLPVFPWDTLADAKALAGAHPDGIVDLSVGTPVDPVAPLIQEALAAASAAPGYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSAAWLAQRGILVAPGDFYGPGGAQHVRVALTATDERVAAAVGRLTC

SEQ ID NO: 1424 - protein, 170 aa, Aquifex aeolicus VF5
MKRPIMLIDLDRCIGCLSCEVACVQEKGLESLYIRPMKVFRVEGISEEPGAFYYPMNCFHCDPAPCVVACPTSAMRKREKDGIVYVEQTLCIGCKACIIACPYGAITFNPATQKVEKCDYCYKRVDKGLLPSCVEKCVTNCLYFVEVDEVPKERHKLKRIDEKLYEEIFS

SEQ ID NO: 1425 - protein, 144 aa, Saccharomyces servazzii
DVYTKTLKSDGIVGLYRGFGPSVVGIMVYRGLYFGLYDSLKPVLLTGTLENSFLASFLLGWCVTIGASTCSYPLDTVRRRMMMTSGQTVKYKNARDCMKQIVAKEGASSLFKGCGANIFRGVAAAGVISLYDQLQLILFGKKFK

SEQ ID NO: 1426 - protein, 326 aa, Escherichia coli
LPNITILATGGTIAGGGDSATKSNYTVGKVGVENLVNAVPQLKDIANVKGEQVVNIGSQDMNDNVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 1427 - protein, 350 aa, Kluyveromyces lactis
MAASIPETQKGVIFYENGGELQYKDIPVPKPKANELLINVKYSGVCHTDLHAWKGDWPLPTKLPLVGGHEGAGVVVAMGENVKGWKIGDFAGIKWLNGSCMSCEYCELSNESNCPEADLSGYTHDGSFQQYATADAVQAAKIPVGTDLAEVAPVLCAGVTVYKALKSANLKAGDWVAISGAAGGLGSLAVQYAKAMGYRVLGIDAGEEKAKLFKDLGGEYFIDFTKSKNIPEEVIEATKGGAHGVINVSVSEFAIEQSTNYVRSNGTVVLVGLPRDAKCKSDVFNQVVKSISIVGSYVGNRADTREAIDFFSRGLVKAPIHVVGLSELPSIYEKMEKGAIVGRYVVDTSK

SEQ ID NO: 1428 - protein, 461 aa, Microbulbifer degradans 2-40
MLAPVNPTTGQPLAQVASLTLPECNRAIDKTYEAFPAWRDTSITERASALMRIAASLRKSKNTLAKLMAQEMGKPLCEGIAEVEKSAACAEYYTNNSADFLKPETLESDAAYSYVTYQPLGTILGILPWNAPVWLALRFLAPALMAGNTCVMKADPNVPATAAALTAAFNSAGLPKNVMTNLPIETELVGEAIDHPAVKAVSFTGSSAAGKKVAARAAGGIKPAVLELGGSDPCIVLADANLDKACNVITLSRMINAGQSCIAAKRVIVEASIYDDVCNRLFKIFSTITMGDPSQSSTSECTALPYAMGPIARKDLQTQLHQQVNQTIQSGARCIHGGDLPSTSGFFYPPTLLIDVQPEMSAFTEETFGPVLAIIKANDFEHAIQLANKTEYGLGASIWTADKTKAELAANKLQAGQVAVNGIVKTDPRLPSGGIGLSGYGRELGPQGIKEFVNVKQVWVG

SEQ ID NO: 1429 - protein, 138 aa, Triticum aestivum
  unsure (1)..(138): unsure at all Xaa locations
MAPTVMASSATSVAPFQGLKSTAGLPVSRRSNGASLGSVSNGGRIRCMQVWPIEGIKXFETLSYLPPLSTEALLKQVDYLIRFKWVLASSQQVGSXSVEHNATXGYYXWXFWTMWKLPILGALTHXVLTKXEEXKKTL

SEQ ID NO: 1430 - protein, 587 aa, Lactobacillus plantarum WCFS1
MMTKMIAGQALVKVLEAWGVDHIYGIPGGSINHTVEGLYLEKADIDYIQVRHEEVGALAASADAKFTGKIGVSFGSAGPGATHLFNGLYDAKMDHVPVLALVGQVPQATMNTNYFQEMDETPMFSDVAVYDRTVTTAGQLPYVINQAIREAYRQKGPAVVIIPENLSAEEIDYQPVSTPNTVSDTFEQRVDPQAITATLKMLKAAKHPLVYAGRGLLGAKADLVKFSEQFNIPVMNTVPATGVIPTNHPNAIGTFGRLGSKSGFEALQHADLILFLGSEFPFASFWPKGIKIIQVNNNSFDIGKMVPIDYAVISDAQAYLQAMIATGETLPETAWLTTNRQNKRNWDKWLQQLAADDHDGLAPEAVMHKVASMVGPRDTYGVDTGNVSEWAVRGLPMDQEQRFALSGLFATMGFGLPAGMAGALSVPDSQAWSFSGDGGFAMVAPDIITEARYGLPVINVIFSNQRFGFIYREQVDTKQHLYGVDLTDADWAKVADGLGGIGFTVQNNQEVETVFDQIKALQAKGNKRPIVVNAVIKNDDPIGTAYMPLDPELYGQAEVDAYAKANHIDIKEQPSLGALLRAQGDQL

SEQ ID NO: 1431 - protein, 87 aa, Glycine max
  unsure (1)..(87): unsure at all Xaa locations
MAALMISFPAVTTVNRAGAGMDVPFTGLKYMDGFPSMMSNIDITFIVSNGGXVQCMLDRSPYGKKKFETLFHLPDLDDAQLVKEVLF

SEQ ID NO: 1432 - protein, 388 aa, Bradyrhizobium japonicum USDA 110
MDSLCRTSGMNTLSNTITVAVVGGEGIGPEVTDQSHRILKWFSDRRGAPVILREAQYGLIPYLATGKVLPDDTVEAMEEADAILWGATGGPETTEVPPAARKAGSLLSLRSKYDLYANLRPIVANPALADSAPLKAAVLKDVDFIIIRELTSGIYFGEPRGIETLPDGQRRGFNTQQYTTSQIRRVARTAFELARTRKGRVCSVDKANVLETSVLWREEVTALHEAEFSDVELTHLYVDNAAMQIVRAPSQFDVMVTCNIFGDILSDCAAMASGSLGMLPSVSLGPPDRLGRRKALYEPVHGSAPDIAGKGIANPLGSILSVAMMLRITLHRPEDAALLEKAVDTALAAGARTADIAEPGAKRLSTQEMGDAVLNALDKVVGKEREHA

SEQ ID NO: 1433 - protein, 233 aa, Nicotiana tabacum
MFEKMDEQLLDALCDRLRPVLYTENSFIVREGDPVDEMLFIMRGKLLTVTTNGGRTGFFNSDYLKAGDFCGEELLTWALDPHLSNNLPISTRTVQALSEVEAFALVADDLKFVASQFRRLHSKQLRHTFRFYSQQWRTWAACFIQAAWRRHCRKKLEESLREEESRLQDALARGSGSSPSLGATIYASRFAANALRALRRNTSKKARMVDRYHPFCFRNQLNQILRQKISNCI

SEQ ID NO: 1434 - protein, 358 aa, Haemophilus somnus 129PT
MKSYTIAVLSGDGIGPEIMAEAIKVLDAVQKKYNFKLNYRTFDVGGIAIDNHGTPLPASTLNGCEESDAILFGSVGGPKWEHLPPNQQPERGALLPLRKHFKLFCNLRPATLYQGLEKFCPLRADIATKGFDMMTVRELTGGIYFGQPKGRDGEGMQTRAFDTEVYYKYEIERIAKVAFETAMKRRKHVTSVDKANVLISSVLWRETVNEVAKNYPDVTLDHIYIDNATMQLIKQPEFFDVLLCSNIFGDIISDEAAMITGSMGMLPSASLNEHGFGLYEPAGGSAPDIAGKGIANPIAQILSAAMMLRYSFNLNEAADSIENAVKQVLSQGYRTADLADEHPPISTAEMGDLIVNAI

SEQ ID NO: 1435 - protein, 188 aa, Staphylococcus epidermidis ATCC 12228
MILIIDNYDSFTYNLVDIVEKQCETIVKYPDDTDICNLKGITAVIISPGPGHPLDNQLLIKLIENFENLPILGVCLGAQALTCYYGGDVIQGSCVKHGKVDTLTIVNQSPLYKGIKSSFKVMRYHSLISDPCSFPESLLITGQTYDSIQSFQHKNRKHYGIQFHPESFATENGKQIIINFINIATRGS

SEQ ID NO: 1436 - protein, 633 aa, Caulobacter crescentus CB15
MENILTQTLVYLGAAVVSVPIAKRLGLGSVLGYLIAGVLIGPFALSLVGDQADVMKFAEFGVVILLFLIGLEVQPSTLWDMRKAIFGLGGAQVVGTALAIAAVALGLGLPWQTALAVGLVLAMSSTAIVLQTLDEKGLRQGPVGRAAFGVLLLQDLAVIPLFALLPLLAISAPQHAAEAGGHGGSLVATLPVWAQTLSVFAAVAAVVGGGRYLVRPLFRFIAKARLREIFTASALLIVVAVASLMQTVGLSPALGAFLAGVVLAESEFRRELETDIEPFRGLLLGLFFMTVGAGVDLPLVARQPLTLVGLVLGLMVLKFLVMYGIARLFGAQKRGALAVATALAQGGEFAFVLLTFTVGAGVIGAQLAALLTAAIAVSMALTPVAMILYERVAALMDAAIPDVTPDTGDFDEGEPDIIIAGFGRFGQVTGRLLAANGFKSTVLDTDIEQIELLRRFGRRVHYGDATRLDLLRQAGADRARMLIVALDDREKTVELVETARKAFPNLTILARAWDRRHAYDLLSNGADAVERETFESALTLGATALQKLGFRAHRAHRAAAFFRRHDRRVFEELRPMWGQEEAYILASRDAAKTMDRLLDADLHRMRPGDVGGAWDTASLDEELRERAQQEGAN

SEQ ID NO: 1437 - protein, 315 aa, Salmonella typhimurium LT2
MNITIATLGELLVEFLAKKENQGFSSPGEFWGPYPSGAPAIFADQVAKLGFRSLLFSCVGNDAFGVMNITRLSRDGVNVQGISVLPNATTGSAFVSYRSQAQRDFIFNMPDSACGLLSADHLDETLLRQYRHFHIMGSSLFSFRLIDAVRKAISIVKENGGTISFDPNIRKEMLKIREMSQAFEYILDYTDFFLPSDGELDYFGLSKSRDEEKIVARLHKRGIAHVIIKRGARGASYYSKDEQHHVAGYPVKVVDPTGAGDCFGATFVSLFLAGYSVPDALAHANAAGSLAISARGPMEGTSTLAQIKELMRQQN

SEQ ID NO: 1438 - protein, 189 aa, Mitthyridium sp. Wall 793
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSSTGAAKAVGKVLPELNGKLTGMAFRVPTTDVSVVDLTVRLEKPASYDAIKAALKEASQGKMKGILGYTEDDVVSSDFVTDSQSSIFDAKAGIAL

SEQ ID NO: 1439 - protein, 292 aa, Salmonella typhimurium LT2
MKTRKGIILAGGSGTRLYPVTMAVSKQLLPIYDKPMIYYPLSTLMLAGIRDILIISTPQDTPRFQQLLGDGSQWGLNLQYKVQPSPDGLAQAFIIGEEFIGHDDCALVLGDNIFYGHDLPKLMEAAVNKESGATVFAYHVNDPERYGVVEFDQKGTAVSLEEKPLQPKSNYAVTGLYFYDNSVVEMAKNLKPSARGELEITDINRIYMEQGRLSVAMMGRGYAWLDTGTHQSLIEASNFIATIEERQGLKVSCPEEIAFRKNFINAQQVIELAGPLSKNDYGKYLLKMVKGL

SEQ ID NO: 1440 - protein, 543 aa, Archaeoglobus fulgidus DSM 4304
MDGAEAVAKALLREKIDCAFSLPSGEILPVCEYLEAEGVRVIFTRHEQAAGNAADGYARVTRRPGFCIVPTGPGLANLMPALAQAYYASSPVVAIAGHSRYVNLDREAFEEIDGYLWVKEYTKWSRLVPFTHRLHEYVQEAFRRALSGRYGPVLLEIPKDVLNADIDGKVELAEPRNYRYTGRVGCEEEYIYRALEMLLNAEKPLIVAGSGVYWSRAENFMIAFAEKLSIPVSVSGLGGCCISPDHPLFAGQASASPAVMQSDFVLVVGTRFDEFLGFGQKFKGKVVHVDIDACELAKNRYVDIAISCDAGYFFSKALAMLEGEKKFENWARPIMEGVNRMFEEAAKGEDKPMKPQRLMRELNEVLSRDDIVILDGGETTAWGLLYLKKGKVISSQGPFGHLGAGIPMGIAAKAAYPEKRVFVVTGDGSFLFNGAEIDTAVRHGLQVVVVVVNDSAWGLVNHTRLLSTKSAERASYGVMLNPAARYDRFAESLEAYGELVEKSGEVKEAVKRAFDSALPAVLDVRVKLDEISPLAYLLSGSEG

SEQ ID NO: 1441 - protein, 515 aa, Agrobacterium tumefaciens str. C58
MGLLIVPELARLDLLTNILDELPHLFDELAVTTPQAMRDAIWKAGEARRLAETRQRLFNAAPQHSAKITLHGQQGFYGGVLATLLVLSLLTYSEIALAWLHATLSMLYLNTLLFRLFALIHIPRETDVETALSLRHENELPVYTILVALYREEAVIEQLVSALERLDWPRSRLDIKLVCEADDGATIEAIRRINPGPHMEIVQVPPSEPRTKPKALTYALSGARGTFVVVYDAEDRPHPQQLREAYAAFRNQPEDMACVQAPLIISNASSSWLSACFALEYAGLFRCMLPALATHGLPLPLGGTSNHFRTAALRRAGAWDPYNVTEDADLGLRLHRLGYRCGVIRRQTLEDAPTSLPVWLNQRTRWFKGWLQSWLVMTRTPFATARTMGWFAYMTFQLLIGGMLLSSLTHPLLFVSLVFMAIAIRENGVDLLFRWQGALFFIDALNIVGSYTIFVLMGRSRMIAYERRQVGRRWLAMPLYWLMLSVAAWRAVVELKTRPFVWNKTPHVPVAKDKT

SEQ ID NO: 1442 - protein, 342 aa, Bacillus anthracis str. A2012
MTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAAKALAKVLPHLNGKLHGMALRVPTPNVSLVDLVVDVKRDVTVEAINDAFKTVANGALKGIVEFSEEPLVSIDFNTNTHSAIIDGLSTMVMGDRKVKVLAWYDNEWGYSRRVVDLVTLVVDELAKQENVQHI

SEQ ID NO: 1443 - protein, 327 aa, Burkholderia fungorum
MRVAVDRGLSGYRRGAGEAIHDRQSITSRIFGVLMLKVTKAVFPVAGLGTRFLPATKASPKEMLPIVDKPLIQYAVEEAMAAGITEMIFVTGRSKRAIEDHFDKSYEIEAELEARGKDKLLELVRSIKPSHVDCFYVRQSEALGLGHAVLCAEKLVGDNPFAVILADDLLHGTPPVMRQMIEAFDHYHSSMIGVEEIPSQDTGSYGVIDGSEWGDSIIRMAGIVEKPEPNVAPSNLGVVGRYVLKPRIFKHLRAIKAGAGGELQLTDAIQSLLADEQVLAYKYHGTRFDCGSKLGYLKATVEFALRHPEVRSEFRAYLEKHLSLLQM

SEQ ID NO: 1444 - protein, 248 aa, GIBBERELLA ZEAE PH-1
MSDSPQSPPKEVDQGAPSPDDEAQMNEQQDPQSANAAGYEFEGVKEQDRWLPIANARSAVHIWIPLMSCDSSSKSPKASRASKADRADELDANIRNFAPVARIMKNALPDNAKIAKEAKECMQECVSEFISFITSEASEKCQQEKRKTVNGEDILFAMTSLGFENYAEALKVYLSKYREQQNQSNRERVNMDNGQWGSGTMMGDAKAESGAVGDFGHDGNSVESGADPNYMYGSQPGHNGNAPEARER

SEQ ID NO: 1445 - protein, 491 aa, Methanopyrus kandleri AV19
MPRRLQNVYKVPGRGRHQLRIAGKSIPGVSPLADEVYTVDFKKRQKENEEKVEKVMEQVESKDVKFVRLQFVDIHGFVKNFAIPAERLEDALVEGVLFDGSSIDGFVDIEESDMIAMPDPDTFAVLPWRPREGKVARIICDVYWPEGKPFEGCPRLNLKRVMNELAEKGYMMYCGPECEFYLLKQDPETGEVEAHDEGGYFDFYPLDRAEDIRREIIFAMEEFGLEVEMSHHEVGPGQHEIDFKFADAVTTADNVISFKQIVKAIARKHGLIATFMPKPIYGENGNGMHVHQSLWDPEGKENLFYDPDAEDQYYLSDTALYYIGGIMEHAHALCAVCNPLVNSYKRLVPGYEAPVYIAWSPKNRSAFIRVPAARGKATRIEYRSPDPACNPYLAFAAMAVAGVDGIENKIDPGDPVNENLYEMSEEERKELGIEHLPENLRDALEAFKEDEVVQSAFTDHIVEQWLELKWEEWSEYRERVTKWEIKKFIVY

SEQ ID NO: 1446 - protein, 214 aa, Neurospora crassa
MANDEYDFLFKVVLIGDSGVGKSNLLSRFTRNEFNLDSKSTIGVEFATRSIQVDSKTIKAQIWDTAGQERYRAITSAYYRGAVGALLVYDISKGVTFENVNRWLKELRDHADQNIVIMLVGNKSDLRHLRAVPTEDAKKFAEENHLSFIETSALDATNVELAFQNILTEIYKIVSTKNFDNGPSGSNEGHQNLSGQSISLSQTANDPQAKSGCC

SEQ ID NO: 1447 - protein, 159 aa, Frankia sp. FE245
ITKEQYSRDPRNIAKKAEEYLRGTGIADTAYFGPEAEFYIFDDVRYDYSPSGSMHAVDSVEAAWNTARKEEGGNLGYKPRFKGGYFPVPPTDHFTDLRSEMTRVLFDVGITVEMQHHEVGTAGQAEIDIRYDTLLKTADNLMLYKYVIRNVARSRGKTV

SEQ ID NO: 1448 - protein, 292 aa, Oryza sativa
MGGAHFPGEGEVVAGEGDAVVPLRDVGKMEHGCEHYRRRCKIVAPCCGEVFACRHCHNDATASGDRHTICRQDVEKVVCLLCDTEQPVSQVCINCGVNMGEYFCDVCKFYDDDTEKGQFHCYDCGICRVGGKENYFHCAKCGSCYAVALRDNHQCVENSMRQNCPICYEYLFDSLKGTRVLDCGHTMHMECFSEMVEHNKYTCPICSKTALDMTHHWALLDQEIEATIMPPVYRYKVWVLCNDCNKVSEVDFHVIGHKCSHCNSYNTRSTSRPADLSGSSSPSTSDSSENNP

SEQ ID NO: 1449 - protein, 135 aa, Salmonella enterica
DNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 1450 - protein, 538 aa, Triticum aestivum
MGYQVVAAQLARLSGALGTSDHASVVSITLFVALLCACIVLGHLLEENRWLNESITALIIGLCTGVVILMTTKGKSSHVLVFSEDLFFIYLLPPIIFNAGFQVKKKQFFRNFMAITLFGAVGTMMSFFTISLAAIAIFSRMNIGTLDVSDFLAIGAIFSATDSVCTLQVLNQDETPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPGSPTDPNVLVE

SEQ ID NO: 1451 - protein, 339 aa, Synechocystis sp. PCC 6803
MLKIGINGFGRIGRLVARIAMANPQVTLVGINDLVPASNLAYLFKYDSTHGSYGGTVVAKEEGIVIDDQFIPCFSQRNPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 1452 - protein, 239 aa, Zea mays
MAAASSAHGLFGLGDGQMQMQIQQQQQAPPPPLVNNPAAPPPKKKRNQPADPDAEVIALSPKTLMATNRFVCEVCNKGFQREQNLQLHRRGHNLPWKLKQKNPKETRRRVYLCPEPTCVHHDPSRALGDLTGIKKHYCRKHGEKKWKCDKCNKRYAVQSDWKAHSKTCGTREYRCDCGTLFSRRDSFITHRAFCDALAQESARVPPMGAGMYGTGGMALGLSGMATSQLQSFQDQTHSS

SEQ ID NO: 1453 - protein, 373 aa, Chlamydomonas reinhardtii
MSLQSSIRADSNCTLPNNPVCVLLPVDFIVAAMASSTSSAMAKWAAQAARGFAAAAPSSGKGRKVAVLGAAGGIGQPLSMLMKMNSQVSSLSLYDIAGTPGVAADVSHINTKAQVKGFDKDGLAEALRGCDLVIIPAGVPRKPGMTRDDLFKINAGIVRDLVTAVGQHCPGAVLNIISNPVNSTVPIAAEQLKKMGVYDKRKVMGVTTLDVVRAKTFYAEKNGLDVASVDVPVVGGHAGVTILPLFSQATPKATMSAEVLDALTKRTQDGGTEVVQAKAGKGSATLSMAYAAALFADSCLRGLNGAPVVECTYVESTVTDAPYFASKVKLSTEGVDKIHDLGPLSDYEKAGLKAMMPELLASIEKGVQFVKGA

SEQ ID NO: 1454 - protein, 362 aa, Schizosaccharomyces pombe
DPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 1455 - protein, 219 aa, Mycobacterium smegmatis
MSADKVTLADLPLRDNLRGKSPYGAPQLQVPVRLNTNENPHPPSKALVDDVAASVREAAAELHRYPDRDAVALRTDLAAYLTAATGVRLGVENLWAANGSNEILQQLLQAFGGPGRTAIGFVPSYSMHPIISDGTQTEWLQASRAEDFGLDIDVAVSAVTERKPDVVFVTSPNNPSGQSVPLDDLRRVLDAMQGGILIVDEAYGEFSSQPSAVALLDDY

SEQ ID NO: 1456 - protein, 659 aa, Gossypium hirsutum
MAAATSNSALPKLSTLTSSFKSSIPISKSSLPFSTTPQKPTPYRSFDVSCSLSHASSNPRSAAASVTQKTAPPHYFISRYADDEPRKGADILVEALEREGVKDVFAYPGGASMEIHQALTRSKIIRNVLPRHEQGGVFAAEGYARSSGISGVCIATSGPGATNLVSGLADAMLDSIPLVAITGQVPRRMIGTDAFQETPIVEVTRSITKHNYLVLDVDDIPRIVSEAFFLASSGRPGPVLIDVPKDIQQQLAVPKWNHSLRLPGYLSRLPKAPAEAHLEQIVRLVSESKKPVLYVGGGCLNSSEELKRFVELTGIPVASTLMGLGAFPISDELSLQMLGMHGTVYANYAVDKSDLLLAFGVRFDDRVTGKLEAFASRAKIVHIDIDSAEIGKNKQPHMSVCSDVKLALQGINKILETTGAKLNLDYSEWRQELNEQKLKFPLSYKTFGEAIPPQYAIQVLDELTGGNAIISTGVGQHQMWAAQFYKYKKPRQWLTSGGLGAMGFGLPAAIGAAVANPEAVVVDIDGDGSFIMNVQELATMRVENLPVKILLLNNQHLGMVVQWEDRFYKANRAHTYLGDPSNESEIFPNMLKFAEACGIPAARVTKKEDLKAAIQKMLDTPGPYLLDVIVPHQEHVLPMIPSGGAFKDVITEGDGRTQY

SEQ ID NO: 1457 - protein, 279 aa, Zea mays
  unsure (1)..(279): unsure at all Xaa locations
SRPAGPGNNLAMQEFMILPVGATTFAEALRMGSEVYHVLKSIIKSKYGQDACNVGDEGGFAPNVQDNREGLILLMDAIEKAGYTGKIKIGMDVAASEFLTKDGNYDLNFKNQPNDGAHILSAQHLGDLYGDFVKDFPIVSIEDPFDQDDWSSWASLQSSVDIQIVGDDLLVTNPKRIADAIDKKACNALLLKVNQIGTVTESIEAALDSKLLVXGVMVSHRSGETEDNFIADLAIGLASGQIKTGAPCRSERLAKYNQLLRIEEELGNVRYAGEAFRSP

SEQ ID NO: 1458 - protein, 492 aa, Solanum melongena
MDLSKYRPSSAYDTPFLTTNAGGPVYNNVSSLTVGPRGPVLLEDYHLIEKLATFDRERIPERVVHARGASAKGFFEVTHDVSHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPINYRHMEGFGVHAYQLINKAGKAHYVKFHWKPTCGVKSMTEEEAIRVGGTNHSHATKDLYDSIAAGNYPEWKLFIQIMDPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRTWEPDRQDRYINKWVESLSDPRVTHEIRSIWISYLSQADKSCGQKVASRLLVKPTM

SEQ ID NO: 1459 - protein, 341 aa, Schizosaccharomyces pombe
MFAKVAFKNFTPLKSIAPRSFSTTSSRAFKVAVLGAGGGIGQPLSMLLKLNDKVSELALFDIRGAPGVAADIGHINTTSNVVGYAPDDKGLEKALNGADVVIIPAGVPRKPGMTRDDLFATNASIVRDLAFAAGETCPEAKYLVVTNPVNSTVPIFKKALERVGVHQPKHLFGVTTLDSVRASRFTSQVTNGKAELLHIPVVGGHSGATIVPLLSQGGVELTGEKRDALIHRIQFGGDEVVKAKAGAGSATLSMAYAGARMASSVLRALAGESGVEECTFVESPLYKDQGIDFFASRVTLGKDGVDTIHPVGKINDYEESLLKVALGELKKSITKGEQFVA

SEQ ID NO: 1460 - protein, 290 aa, Pyrobaculum aerophilum str. IM2
MEIKMAEAGDVALRKYGTAMPQEALRLADAADVIFKGPIGESAYDVTSLIRMRYTLYANIRPVKNLPGVPAVREIDCVFVRENVEDVYVGAEYKVGDVAIALKVITEKGTRRVARMARKYAEMRRRRVTIVHKANVLRVVDGFFRDIALEELKGLEVDQMYVDAAAMELVRNPKRFDVVLTMNQYGDILTDLAAQVAGGIGLAPSGNIGDAKAMFEPVHGAAFDIAGKGVANPIATILSAAMMFEWMGRGDVAEKIRGAVEKSIEAGVKTPDIGGDKSTIEVGKFIASIL

SEQ ID NO: 1461 - protein, 385 aa, Corynebacterium sp. ST-10
MKAIQYTRIGAEPELTEIPKPEPGPGEVLLEVTAAGVCHSDDFIMSLPEEQYTYGLPLTLGHEGAGKVAAVGEGVEGLDIGTNVVVYGPWGCGNCWHCSQGLENYCSRAQELGINPPGLGAPGALAEFMIVDSPRHLVPIGDLDPVKTVPLTDAGLTPYHAIKRSLPKLRGGSYAVVIGTGGLGHVAIQLLRHLSAATVIALDVSADKLELATKVGAHEVVLSDKDAAENVRKITGSQGAALVLDFVGYQPTIDTAMAVAGVGSDVTIVGIGDGQAHAKVGFFQSPYEASVTVPYWGARNELIELIDLAHAGIFDIGGGDLQSRQRCRSVSTTGCRNAQRPCGCGPWSVVPTAVERQRKNTDARPNSIRPGISVRNSVCASCTPR

SEQ ID NO: 1462 - protein, 379 aa, Corynebacterium glutamicum
MYLSGSRCTLKSMTSLEFTVTRTENPTSPDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 1463 - protein, 402 aa, Glycine max
QPQPQPTSLSLSLCFLFFHQLIQNCRGSNCNKLPLPLNLNFSHCSYSFTSLLLPNGNFEQGPKPSQLERGQGSVVTDANASLNTITGCVEEHIKSEKNRVAMYWLCPEGCYASRLGNEASIKQKLKLIKGSFYSITFSAARTCAQEEKLNVSVVPTTEKRDWGIIPIQTMYGSNGWESFTCGFRADFPEAQIVIHNPGKEEDPACGPLIDSVALKVLYPPKRTRANLLKNGNFEEGPYIFPNSSWGALIPPHIEDSHGPLPGWIVESLKAVKYIDSDHFAVPEGKRAIELVAGKESALAQVVITTIGKTYDLTFAVGDANNACESSMMVEAFAGTNTVQVPYQSKGKGGFVRGKLRFKAVSTRTRLRFLSTFYTMKSDNSGSLCGPVIDDVKLLGVRYPTLA

SEQ ID NO: 1464 - protein, 250 aa, Triticum aestivum
MANIIKSALPTHLKPNTGDEQGNERRHGKTRSHMAFENTSTNVAAAQMRNALTNLAETVKDPEQKKLFETEMDNFFALFRRYLNDKAKGNAVDWDRIAPPAQGQVVDYDDLANTESVQFLNKLAVLKLNGGLGTSMGCVGPKSVIEVRDGMSFLDLSVRQIEYLNRTYDVNVPFILMNSFNTNDDTAAIIKKYEGHNVDILTFNQSRYPRVYKDSLLPVPKDNDSPINEWYPLGHGDVFESLYNSGILDK

SEQ ID NO: 1465 - protein, 790 aa, Escherichia coli
MFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLESGNPWEFKRHNTRYKVVFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDGTLGRNWRTDLSLLNELQQHCDFPMVNHAVHQANVENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 1466 - protein, 594 aa, Rhodospirillum rubrum
MSGVPPPFLPIRVLPGPRMIHATPLITILVAGLGIAFIFGAIAHRLKVSPLVGYLLAGIVIGPATPGYVADQNLASELSEIGVILLMFGVGLHFSLKDLLSVRAIAVPGAIVQIAFATVLGIGIAHFAGWGLGGGIVFGLALSVASTVVLLRAMQDRRLIDTLRGRIAVGWLIVEDLAMVMALVLLPAVAGALGVGTANGTPSLSLVDVGISLGVTLAKVAAFIVLMLVVGRRVIPWLLHRMASTGSRELFRLAVLVIALGVAFGSATLFGVSFALGAFFAGMVMNESELSGQAAQDTLPLRDAFAVLFFVSVGMLFNPSSVIESPLLFVATLLVIVFGKSVAAFGLVLMFGHSKATALTIAASLAQIGEFSFILAPLGVSLGLMPQQGQDLILAAAIVSILLNPFLFMLLDRYFLHDASASASAAADPPEPAPSSGAADDEDEAAIAVAKPAPVAPASGHAVVVGSGRVGALIGEMLAEREVRRVVIEESESVIEALRGKGVSCHLGNAADPETLALADTIEARWLFVAIPNAFEAGQVVEQARKSNPDLQIIARAHSDAEVEHLKARGASRVVMAERETARGMIAEALLPRL

SEQ ID NO: 1467 - protein, 486 aa, Oryza sativa
  unsure (1)..(486): unsure at all Xaa locations
MSVQEYLEKHLLSRKIEEAVNAAVRAKAPDPVLFISNHMRRAAPAVITIVRARQILDGRGEPAVEVXLHTNKAVHRASAAAADAPEGAAADAVRDAEKRKLLARAVADAVRVINDKVSEALVGMDPQQQSQIDQAIMDLDKAHHKVNPXKPQIGVNSMLAVSIAACKAGAAEKDVPLYKHIAELVGKSATTLPIPAITVINGGTHAGNSLPIQEIMILPVGAKNFEEAMQMGSETYHHLKDIILEKYGSNSCNIGDDGGFAPNISSITEGLDLVIEAINRAGYNGRIKLAIDVAATDFCMGNKYDMEFKFAEKSGQGFKTADDLIEIYSQLCSEYPLVSIEQPFDKDDWEHSKKFTTLELCQVQVVGDDLLMSDPERIKRAVNEYTCNALVLKANQVGTVTEAIEVVRQAKDAHWGVMVSHRSGDTDDSFIADLAVGAAAGQIKXAGAPCRGECLSKYNQLLRIEEELGSDGVYAGENWRTTASTS

SEQ ID NO: 1468 - protein, 341 aa, Burkholderia fungorum
MTIAGRHAGVPGIRNAVHRAVHRPLLPAPLNCRIEQSIGERMSPRDLLLALVVVVAWGINFVVIKVGLHGVPPMLLGALRFTLAAVPAVFFIKRPNLPWRWLLAYGATISFGQFAFLFSAMYVGMPAGLASLVLQAQAFFTLIFAAIFLHERFRLPNVAGLAIAAAGLAVIGMQGGRAMTLAGFVLTLCAACSWALGNIVTKKVGKVDLVGLVVWGSLIPPLPFFALSYAFEGPQRIAAALAGISAMSIFAIVYLAFIATLLGYGLWSRLLSRYPASQVAPFSLLVPIVGLASASLFLDEQLSSAQIAGALLVMAGLAVNVFGGWVVQRFSPARRATDASD

SEQ ID NO: 1469 - protein, 325 aa, Shewanella oneidensis MR-1
MQTLAQHLTSKAVNESLAQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPQGELTEASFLQSGRNQLAAGYVLYGPSTMLALTTGQGVQLFTLHPETNEFLLTNATMSISPDTSEFAINMSNQRFWEAPMQTYIADLLLGKIGPREKSFNMRWIAAMVGDVHRVLSRGGIFTYPTDNKDPKKPYKLRLMYEANPMAFLVEQAGGKASTGYETILDIQPTQIHQRVAVILGSANEVDACLSYHGIDSRK

SEQ ID NO: 1470 - protein, 502 aa, Corynebacterium glutamicum ATCC 13032
MRPKLSGNTTRHNGAPVPSENISATAGPQGPNVLNDIHLIEKLAHFNRENVPERIPHAKGHGAFGELHITEDVSEYTKADLFQPGKVTPLAVRFSTVAGEQGSPDTWRDVHGFALRFYTEEGNYDIVGNNTPTFFLRDGMKFPDFIHSQKRLNKNGLRDADMQWDFWTRAPESAHQVTYLMGDRGTPKTSRHQDGFGSHTFQWINAEGKPVWVKYHFKTRQGWDCFTDAEAAKVAGENADYQREDLYNAIENGDFPIWDVKVQIMPFEDAENYRWNPFDLTKTWSQKDYPLIPVGYFILNRNPRNFFAQIEQLALDPGNIVPGVGLSPDRMLQARIFAYADQQRYRIGANYRDLPVNRPINEVNTYSREGSMQYIFDAEGEPSYSPNRYDKGAGYLDNGTDSSSNHTSYGQADDIYVNPDPHGTDLVRAAYVKHQDDDDFIQPGILYREVLDEGEKERLADNISNAMQGISEATEPRVYDYWNNVDENLGARVKELYLQKKA

SEQ ID NO: 1471 - protein, 159 aa, Zea mays
  unsure (1)..(159): unsure at all Xaa locations
AAARVRHDRRPQHVCRRSTRRLSLSLPHNPRGGLVLTSGDAVGNANRRGLNTGDQVLHTXSFFRHQLRPAYILVLTNTVIQAKSDSTYFPLSRPAEGHLKRLPRMSYPPRVGSKMTDSRQDRXTHVCLDCAYIYSPTHCCMTNGPTTTDAHTASHLTNG

SEQ ID NO: 1472 - protein, 236 aa, Gossypium hirsutum
MGRGRVELKRIENKINRQVTFAKRRNGLLKKAYELSVLCDAEVALIIFSNRGKLYEFCSSSSMIKILERYQKCNYGAPEPNVSSREAALELSSRQEYLKLKARYDALQRSQRNLLGEDLGPLSSKELESLEKQLDSSLKLIRSTRTQYMLDQLNDLQRKEHLLNEANRTLKQRLVEGYQVNSLQLNPNATEDVGYGRQQVHHQPHGDAFFHPLDCEPTLQIGYQHDPMSVVTAGPV

SEQ ID NO: 1473 - protein, 765 aa, Phycomyces blakesleeanus
MATLLIDNYDSFTYNVYQYLCSQGADVVVYRNDKITVDEIVKLNPVNIVISPGPGHPSHDAGVSRDVISYFAGKLPILGICMGEQCIFEVFGGTVSYAGDILHGKTSTIKHDNRGLFKNVPQDNQVTRYHSLAGMPSTLPEVLEVTATTDDGVIMGVRHKKYTVEGVQFHPESILCEHGHTMISNFLSLRGGNWDENPAAGVLAQKVPAAATEKAAQEASPAISTPPTCSTILSRIYAQRVKDVQAAKEVPGQSQADLQKLLNLHIAPPLRDVVNRLKESSPALMAEVKRASPSKGNIDITVNAAEQALQYALAGASVISVLTEPKWFRGSLNDLRQVREACPLLPNRPCILRKTFLLDTYQILEARLYGADTVLLIVAMMSDEDLRELYQYSVSLGMEPLVEVNNAEEMARANAVGAKLIGVNNRGLHSFDVDMETTSRLAEMVPEGTILCALSGISTRADVETYVSQGVHGLLVGEALMRAWNLKEFVAELLGYKKKDPVPHTPVSRQVQVKICGISSVEAAVEAATAGADLVGLIFAEKSKRQVTVAKAREIVDALHKLPTRSSQLPVKSQKSIDWFDVQTEMVEQRVPWRPLVVGVFVNQSTEYMSQVAVEAALDLIQLHGTESAEIARFLPVPVIKAFHMDASSFHAGQIPYVTQPGNNQLLLLDAKVPSLPMDRQGGLGQKFDWTIAQDIVNVKRPGCSKEQTFPVILAGGLDPSNISEAIQQVRPWAVDVSSGVETDGKKDLKKIRAFVEKAKSINLQ

SEQ ID NO: 1474 - protein, 516 aa, Lycopersicon esculentum
MSVATDVRFALLRNNPAALTGTNLKIVKFCNGELMGKKLKYTKFQLRSNVVKPHICMSLTTDIAGEAKLKDLEAKKEDARTVVAIILGGGGGTRLFPLTKRRAKPAVPIGGAYRLIDVPMSNCINSGINKVYILTQFNSASLNRHIARAYNFGNGVTFGDGYVEVLAATQTPGELGKRWFQGTADAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASMGVYVFKKDILLNLLRWRFPTVNDFGSEIIPASTKEFCVKAYYLFNDYWEDIGTIRSFFEANLALTEHPPRFSFYDATKPIYTSRRNLPPSAIDNSKIVDSIVSHGSFLTNCFVEHSVVGIRSRIGTNVHLKDTVMLGADYYETDAEIASQLAEGKVPLGIGENTRIKECIIDKNARIGKNVVIANSEGVQEADRSSEGFYIRSGITVILKNSTIPDGTVI

SEQ ID NO: 1475 - protein, 380 aa, Schizosaccharomyces pombe
MVQTAALHGPKPMDSSHIKVTNVKELKPLPEWKSLKFGENFTDHMLIMKWNREKGWSTPEIVPFGKLCFHPASSVFHYGFECFEGMKAFRDEKGVPRLFRPIKNAERMLSTGTRISLPSFDPAELAEIIRKFVAHENRWVPDQRGYSLYIRPTFIGTDEALGVHHCDNAMLYVIASPVGPYYSSGFKALSFVAPKKSVRAWPGGTGHYKLGGNYAPSVLPQKEAAKKGYAQILWLYGDEDYITEVGTMNCFTVWINKNGEKEIITAPLDGMILPGVTRDSILEICRERLAPKGWKITEGKYSMKEVAQASKEGRLLEVFGAGTAALVSPVKAINYKGTEYEIPMPEGQEAGPITSEISKWILDIQYGKEPNNPWSVPALP

SEQ ID NO: 1476 - protein, 145 aa, Glycine max
  unsure (1)..(145): unsure at all Xaa locations
YGAFPLSIIPYIWRAXLPDNVFFAAEISACAPLHNPTYLRYVXRALLYELCILYDLLTEDPFLQTFPSHSNFILCAASSSLDAPKLXEDLLHMGLMIPAYDKKXLISYVRVTVSKPDQAHTLMIVPQETLAGRTCDVLPIATCHA

SEQ ID NO: 1477 - protein, 333 aa, Oryza rufipogon
LFCISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKSRFDAPAYRDDRAGSTVPQADYAWRIVLMFGAIPALLTYYWRMKMPETARYTALVAKNDKKAAADMARVLNVELVDEQEKAAAATAAAAEEEAARREQYGLFSREFARRHGHHLLGTTVCWFVLDIAYYSQNLFQKDIFSAIGWIPEAKTMSALDELYHIARAQTLIALCGTVPGYWFTV

SEQ ID NO: 1478 - protein, 321 aa, Streptococcus pyogenes MGAS315
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNIPPLAVGEIEHLITLGIPVVLVSRCFNGMAEPVYAYEGGGAMLQEAGVMFVKELNAPKARLKLLIALNAGLTGQELKDYIEG

SEQ ID NO: 1479 - protein, 414 aa, Azotobacter vinelandii
MTIDFKKTALDYHEFPTPGKIGIELSKPAETAAHLSLAYSPGVAEPVREIARDPENAYRFTAKGNLVAVISNGSAILGLGNLGPLASKPVMEGKALLFKRFAGINAVDIEVTAESPAAFIDTVVRIADTFGGINLEDIKAPDCFEIEQLLIEQCSIPVFHDDQHGTAIVTAAGMLNALEIQGKRLEEARIVCLGAGAAATACMRLLISLGARKDNLYMIDSRGVIHSGRDGLNRYKQEFVNDGGARTLLEAMQGADVFLGLSGANLLPPEALLAMAPRPIVFACSNPDPEIDPELAKATRQDLILATGRSDYPNQVNNVLGFPFIFRGALDVRARRVDEAMKIAAVEALRQLAKEPAPAEVLKAFAIDRLQFGPDYILPKPMDARLLGAVAGAVAKAAVESGVARLPYPAHYPL

SEQ ID NO: 1480 - protein, 310 aa, Carica papaya
MENFPVINMEGLNGEERAATMKKIEDACENWGFFELVNHGIPIELLDTVERLTKGHYRKCMEQRFKEIMASKGLDGIQTEVTDMDWESTFFNCHLPEPNIAEIPDLDDEYRKVMKEFALKLEKIAEELLDLLCENLGLEKGYLKKAFTWSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPGSDAVISPAELLVEKETEEKKTAYPKFVFEDYMKLYAGLKFQAKEPRFDAMKAAAKA

SEQ ID NO: 1481 - protein, 157 aa, Heliobacillus mobilis
MMIKIAPSILSADFSNLGSQVADVEAGGAEYLHIDVMDGHFVPNITIGPLVVASLRPRSQMVFDTHLMIEEPDRYIPDFIKAGSDLVTVHQEACTHLHRTVSLIREKGAKAGVALNPATSWQSLEYVLPMVDLVLVMSVNPWFWRSKVYQRRLAEDH

SEQ ID NO: 1482 - protein, 631 aa, Novosphingobium aromaticivorans
MRPKSILAPKRRALPSWGTSTTSANVGLSPKQKGPSALSTSLAQASSPLSITSRAQAFTASSSKPRARSIFSTLRFWTGWMSQATACANARTLARSRASSGNNGGSGKTSSRYSQIVRLCVSTAPPISSAGTKPCGLSPRYSGARCSPLRKWWNTFCQVRPFRPSAMRTRHEADERQKPWRTMASRAGASFMVRFSGACHLSENRATGATVRSPHPDRHVLCRMHASKRRGECLGLGAMIDPLQRLHPVYAGMPVTIFEHMSGLARELGAINLGQGFPDEAPPPALLEALSRAAAERSHQYPPMAGIPELRRAVAGFYAWTQGLEVGAESVIVTSGATEAVACAILAAVAPGDEVLLFSPAYDAYAPLIRRAGGVPVFVPLSPPHWRYDEAAIVAAVTPRTRALVLNDPLNPTGTVAADTELAMIASLCVRHDLIAICDEVWENVRFDGRRHRSLLALPGMARRTIKIGSAGKIFGATGWKVGWMVAAPDMAAVLARAHQFLTFTTAPMLQWAVAQGLEDPALAAGCTARWAETRGVLIEALGRRGFTVLDTTATWFTCIDLAASGIALDDRTFSDRAVREAGVASIPLSALWEGDAAPEGIVRLCHCKPEAMLLEAMDRLVRWRDGLRAA

SEQ ID NO: 1483 - protein, 187 aa, Zea mays
  unsure (1)..(187): unsure at all Xaa locations
MMFIESFHRKSPHMQDGPMEIEGEYRPDTTELAHEGEDSAXRWVVHPKDVKYNFSTITDVRKVVVKLEQRRGNNSNTLTDGDIDNMKGSSWANKDKAHQDSYCSSLTQGSXITAYSCSVEESYAQLKSLLCIVNRDDIVPAGXGTSSMNLADYMTRAKALDIDLHKLATPYMESMVTLTGVYDPNLI

SEQ ID NO: 1484 - protein, 321 aa, Enterococcus faecalis V583
MDIISYERVIQQLSFSEAIQVMKRCFAELQKGKISQSERHVEVLPDGKNQNLFALMPAYLGKNRFFGAKIITAFPENPQKNLASHLGQILLFDSSTGRPVAMMDANAITWLRTAAVSALATDYLAAPKAKSIALIGAGQQASSHLAALQSVRAIEKVFIYDRTAERARKLIAKQQHNYPECTFIGCSSVQEAVQEAEIICTLTSSQDAFLEEKDVLPNAHINAIGTFTPTSRELTSDLVKNSQVFVDEYAAALKESGDLLIPISEGAFSAEKIVGSLGELVTGKVKLKAEQKGRTIFDAVGLAVEDLCCAEYIYQKIQGEN

SEQ ID NO: 1485 - protein, 264 aa, Borrelia hermsii
  unsure (1)..(264): unsure at all Xaa locations
RFTDPKTLAHLLKYDSTFGVYNKKVESRDGAIVVDGREIKIIAERDPKNLPWGKLGXDVVIESTGVFSSATSDKGGYLDHVEAGAGAKKVILTAPAKDEIKTIXLGVXDHDINXDLKAVSNASCTTNCLAPLAKVLHESFGIEQGLMTTVHAYTNXQRILDLPHSDLRRARAAALSIIPTSTGAAKAVGLVLPELKGKLNGTSMRVPVPTGSIVDLTVQLKKKDVTKEEINSVLKKASETPELNGILGYTEDPXVSSDXKGNSH

SEQ ID NO: 1486 - protein, 134 aa, Zea mays
GAFTGEVSAEMLVNLGVPWVILGHSERRALLGESNEFVGDKVAYALSQGLKVIACVGETLEQREAGSTMDVVAAQTKAIAEVAESTRIIYGGSVTAANCKELAAQPDVDGFLVGGASLKPEFIDIINAATVKSA

SEQ ID NO: 1487 - protein, 655 aa, Clostridium tetani E88
MASTIVKGGIMVETIKITTAQALIKFLNQQYVELDGQEYRFVQGIFTIFGHGNVLGIGQALEEDPGHLEVYQGHNEQGMAQSAIAFAKQSNRKQIYACTSSVGPGAANMVTAAATATANNIPVLLLPGDTFSTRQPDPVLQQVEQTYNLSITTNDAFKAVSKYWDRVNRPEQLMTAMINAMRVLTDPANTGAVTIALPQDVQGEIYDFPEYFFKKRVHRIERTPPSKQAIEDAVELIKRKKKPLIICGGGVRYSEAAESLKRFSEKFNIPFGETQAGKSAIEWSYGLNLGGIGVTGNSAANSIAKDADLIIGVGTRFTDFTTCSKFLFQNDDVEFLTINISSFHANKLDALKVISDAKVGLDTIANELERQGYSSDYEDEIKKAKNEWEKELNRLFNIEYTEKEFVPEIAGHCDKVVEEFYKEFDSCLTQTKVLGELNELLDDDAIVIGASGSLPGDLHKVWCPKRSNTYHMEYGYSCMGYEVSAALGVKLAEEDKEVYSLVGDGAYLMLHSELITSIKEGKKINILLFDNAGFGCINNLQMSNGMGSFATEFRHRNSETGKLDGKLLKIDFAKSAEGYGVKTYKVNTIDKLRYAIEDSKKQKISTLIDIKILPKTMTRGYESWWHVGVSEKSKNPKINKAYESKINHLAKARKY

SEQ ID NO: 1488 - protein, 222 aa, Triticum aestivum
  unsure (1)..(222): unsure at all Xaa locations
MDEEIGAAAAPQGQWKYHKALSLLAFQSFGVVYGDLSTSPLYVFKSALSGLDKYSDEATVFGLLSLIFWTLTLIPLLKYVIIVLGADDNGEGGTFALYSLLCRHAKMSLLPNQQAADEELSTYYQPGVDRTAMSSPFKRFLEKHKKLRTCLLLFVLFGACMVIGDGVLTPTISVLAALSGLQDRGTGGLGNGWVVLIACVXLXGLFALQHRGTHRXAFVFAP

SEQ ID NO: 1489 - protein, 288 aa, Arabidopsis thaliana
MESYKCRVCFKSFVNGKALGGHMRSHMSNSHEEEQRPSQLSYETESDVSSSDPKFAFTSSVLLEDGESESESSRNVINLTRKRSKRTRKLDSFVTKKVKTSQLGYKPESDQEPPHSSASDTTTEEDLAFCLMMLSRDKWKKNKSNKEVVEEIETEEESEGYNKINQATTKGRYKCETCGKVFKSYQALGGHRASHKKNRVSNNKTEQRSETEYDNVVVVAKRIHECPICLRVFASGQALGGHKRSHGVGNLSVNQQRRVHRNESVKQRMIDLNLPAPTEEDEVSVVFQ

SEQ ID NO: 1490 - protein, 478 aa, Xylella fastidiosa Ann-1
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLPAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAALLAAVFPLDVLGELTSMGTLIAFTAVCAGVLILRCTRPDLPRPFRMPAAWLFCSAGVLSCITLLSAMTRHNWMLMSVWTVLGFSLYFSYGYHHSKLHQ

SEQ ID NO: 1491 - protein, 352 aa, Pseudomonas syringae pv. syringae
IKFPDMVRAFKPDPRTNLDNDSRRFDFFSRVPEATRTLTLLYSNEGTPAGYRFMDGNGVHAYKLVNAKGEVHYVKFHWKSLQGLKNLDPKEVAQVQSKDYSHLTNDLVGAIKKGDFPKWDLYVQVLKPEELAKFDFDPLDATKIWPDVPEKKIGQMVLNKNVDNFFQETEQVAMAPANLVPGIEPSETACCRPCVSYADTQMYRLGANGLSLPVNQPKVAVNNGNQDGALNTGHTTSGVNYEPSRLEPRPADDKARYSQLPLSGTTQQAKITREQNFKQAGDLYRSYSAKEKTDLVQSFGESLADTDTESKNIMLSYLYKADPDYGTRVAEVAKGDLSRFSSLAASLKELMI

SEQ ID NO: 1492 - protein, 202 aa, Oryza sativa
MAGIRWPPEDPEIFPSRMVTGGGGGGAGGGPPGPPGEMASDDDRSVAADSWSIKSDYGSTLDDEQRYADAAEVLLASSSSSSAAASGPAAATTASVAANPSGDFRFSDLTGIDHSEGAIEVARNLAIRDGFEHINFLVITSCSRTKDELVQEVESFNQRKLSAMGSEGAQASDTAVFKYIDHVQTYPIVDSSCITTVAFSHS

SEQ ID NO: 1493 - protein, 205 aa, Citrus unshiu
KLGDDEFGYMLANILKENNVDTSGVRYDSTARTALAFVTLRADGEREFLFFRHPSADMLLCESELDKNLIKQGSIFHYGSISLIAEPCRSTQLAAMNLAKESGSILSYDPNLRLPLWPSEEAARKGIMSIWDQADIIKVSDDEITFLTGGDDHNDDNVVLEKLFHPNLKLLIVTEGSKGCRYYTKEFKGRVPGVKTKAVDTTGAG

SEQ ID NO: 1494 - protein, 457 aa, Torenia hybrida
MAKTYGPLMHLKFGLKDAVVASSASVAEQFLKKHDVNFSNRPPNSGAKHIAYNYQDLVFAPYGPRWRLLRKICSVHLFSSKALDDFQHVRHEEICILIRAIASGGHAPVNLGKLLGVCTTNALARVMLGRRVFEGDGGENPHADEFKSMVVEIMVLAGAFNLGDFIPVLDWFDLQGIAGKMKKLHARFDKFLNGILEDRKSNGSNGAEQYVDLLSVLISLQDSNIDGGDEGTKLTDTEIKALLLNLFIAGTDTSSSTVEWAMAELIRNPKLLVQAQEELDRVVGPNRFVTESDLPQLTFLQAVIKETFRLHPSTPLSLPRMAAEDCEINGYYVSEGSTLLVNVWAIARDPNAWANPLDFNPTRFLAGGEKPNVDVKGNDFEVIPFGAGRRICAGMSLGIRMVQLVTASLVHSFDWALLDGLKPEKLDMEEGYGLTLQRASPLIVHPKPRLSAQVYCM

SEQ ID NO: 1495 - protein, 140 aa, Picea mariana
GSSVVVPRNFRLLEELERGEKGIGDGSVSYGMDDSDDIYMRSWTGTIIGPHNSVHDGRIYQLKLFCDKDYPEKAPTVGFCSRVNMTCVNQETGRVEPKHFSMLANWRRDYTMEDILTHLKREMLASHNRKLVQPPEGTFF

SEQ ID NO: 1496 - protein, 246 aa, Triticum aestivum
KAATLRRAATYEAGTAAPKGAPYPGTTESPELRWALIRKVYVVLCLQLLLTAVVAVVFVKVRSIPHFFASSYVGLGLYIFILIFPFIVMCPLHFYRQKHPVNLLLLGVFTVAISFSVGLTCAFTSGKVILEAGILTIVVVLSLTAYTFWAARRGKDFSFLGPFLFACLMILLVFGFIQIFFPLGKLSHMIYGALAALIFIGYIVYDTGNIIKRYKYDEYVWAAVTLYLDIINLFLGLMTLFRAGDS

SEQ ID NO: 1497 - protein, 338 aa, Pisum sativum
MGAKIKIGINGFGRIGRLVARVALKRDDVELVAVNDPFITTDYMTYMFKYDSVHGQWKNDELTVKDSNTLLFGQKPVTVFAHRNPEEIPWASTGADIIVESTGVFTDKDKAAAHLKGGAKKVIISAPSKDAPMFVVGVNENEYKPEFDIISNASCTTNCLAPLAKVINDRFGIVEGLMTTVHSITATQKTVDGPSSKDWRGGRAASFNIIPSSTGAAKAVGKVLPALNGKLTGMSFRVPTVDVSVVDLTVRLEKAATYDEIKAAIKEESEGKLKGILGYTEDDVVSTDFIGDTRSSIFDAKAGIALNDKFVKLVSWYDNELGYSTRVVDLIVHIAKQL

SEQ ID NO: 1498 - protein, 262 aa, Synechocystis sp. WH 8501
MYEQIKALKSGQAIDKPIYNHETGELDPPERIEPNKVVVIEGLHPLFDERVRELVDFGVYLDISDEVKINWKIQRDMAERGHTYEDVLASINARKPDFSAFIEPQKQHADVVIQVLPTQLIEDHESKLLRVRLVQKEGIANFEPAYLFDEGSTIDWRPCGRKLTCAYPGIKMYYGPDNFMGNEVSMLEVDGQFDNLEEMIYIESHLSKTGTKYYGEMTELLLQHKDYPGSTNGTGLFQVLVGLKMRETYEKITAVEQVPAEV

SEQ ID NO: 1499 - protein, 233 aa, Glycine max
  unsure (1)..(233): unsure at all Xaa locations
VAKVGGFPIFKNSKSFSKGVRFKSKTKTLLWCAIAQVFYQAFKKRYGHGTXGIICLVIVAVAIFFCGMSSVTSNSRMAYAFSRDGAMPLSSLWHKVNKQEVPIYAVWLSVFISFCMALTXSLGSIVAFEAMVSIATIGLYIAYAFPIFLRVTLARKHFVSGPFNLGRYGVVVGWVAVLWVLTISVLFSLPVSYPITIKTLNYTPVAVGCLLILVVSYWLISGRRWFKGPITNI

SEQ ID NO: 1500 - protein, 150 aa, Zea mays
  unsure (1)..(150): unsure at all Xaa locations
MFIENFKVESPNVKYTETEIQSVYNYETTELVHENRNGTYQWIVKPKSXVNYQFKNHXHVPKIGGDAWWVGVENNGSTLTGGVIAXNEEGISGATKGKIPQGXFFGSLTQASXIQVGSFQGXEIYAPFQKSGFQGVNLGPIWVWGEGKNP

SEQ ID NO: 1501 - protein, 724 aa, Actinoplanes sp. 50/110
MQRHARHAIAAAVGFPLLPPSLPAHAAGASAVVPYAGNPASLKQDLCYQIATDRFSDGTPANNNPGNVPGMFADKTKLNDRQEWLKYMGGDFAGITQRMEYLKNLGVGAIWISPHVDNINVPANGATGYHGYWPRDFKRLEEHFGTDEEFDALVSAAHASNIKVIMDWTPNGTNPPNQAEDGALYDDGQLVGRYGADSAGHFHHGPAIGDFNDRYQDQYYSLADIADLDQQNPRVDQLLKDDANYWMDRGVDGIRVDAVKHMPLSWQRSFADAVTSHKSAAIFGEWYMGDQSDPLYADQVKFANTSGIAAMDFYTNRSIRDTFAGAGSMKSLDAAITKTNRDYLYEQDLITFLDNQDTRRFGTLNSDPAALHRALAFLLTTRGTPCLFYGTEQYLHNDTGEGSNKGKDPYNRPPMASFDTDTVAYREIRRPLRPAPVEPRGGYGDHQQRWINDDVYVYERRFGDNVLLTAINKGSHEYRLERAGTALPAGTYRDVLGGTFGGSDLTVEDGDGTDRSTVAPVLGAGQVAVWSYRAPVDTEPRIGGVGPVVTRAGATVTVEGTGFGSGGTVAIGGVPATVQQWTADRITATVPVGVPTGAVQVTVGNGSGTSNGYPITTRTGKPVPVQFTVQNPPATAPGESLYLTGDVAELGHWSTSPDQTAGQLLRVPNESRGVLVADLPAGAPVEFKFVKVAADGTVTWEGGANHRYTVPAGGTGTTSLTWQR

SEQ ID NO: 1502 - protein, 251 aa, Candida maltosa
MSVKTKTITILPGDHVGTEIVNEAIKVLEAIEAATPYQKIHFDFKHHLIGGAAIDATGVPLPDDALESAKNSDAVLLGAVGGPKWGTGALRPEQGLLKIRKELNLYANIRPCNFASDSLLELSPLRPEVVKGTNLIIVRELVGGIYFGDREEQEESEDKQTAWDTEKYTVDEVTRITRMAAFMALQHNPPLPIWSLDKANVLASSRLWRRTVDKVISEEFPTLSVQHQLIDSACHDFNSKPNQIEWYNYHF

SEQ ID NO: 1503 - protein, 394 aa, Zea mays subsp. mays
  unsure (1)..(394): unsure at all Xaa locations
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELIYGVRAMAINLPGFAYRGALRARRRLXGALXGVLYXSPAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 1504 - protein, 159 aa, Glycine max
MDFRVMGLESPLFHTLQHMMDMSEDGAGDNKTHNAPTWSYVRDAKAMAATPADVKEYPNSYVFEIDMPGLKSGDIKVQVEDDNLLLICGERKRDEEKEGAKYLRMERRVGKLMRKFVLPENANTDAISAVCQDGVLSVTVQKLPPPEPKKPRTIQVKVA

SEQ ID NO: 1505 - protein, 603 aa, Arabidopsis thaliana
MDTKIGAIDTCKPTTGDIGSPPSNAVATIQDSAPITTTSESTLGRHLSRRLVQAGVTDVFSVPGDFNLTLLDHLIAEPELNNIGCCNELNAGYAADGYARSRGVGACVVTFTVGGLSVLNAIAGAYSENLPVICIVGGPNSNDFGTNRILHHTIGLPDFSQELRCFQTVTCYQAVVNNLEDAHEQIDKAIATALKESKPVYISISCNLAATPHPTFARDPVPFDLTPRMSNTMGLEAAVEATLEFLNKAVKPVMVGGPKLRVAKASEAFLELADASGYPLAVMPSTKGLVPENHPHFIGTYWGAVSTPFCSEIVESADAYIFAGPIFNDYSSVGYSLLLKKEKAIIVHPDRVVVANGPTFGCVLMSDFFRELAKRVKRNETAYENYERIFVPEGKPLKCKPGEPLRVNAMFQHIQKMLSSETAVIAETGDSWFNCQKLKLPKGCGYEFQMQYGSIGWSVGATLGYAQATPEKRVLSFIGDGSFQVTAQDISTMIRNGQKAIIFLINNGGYTIEVEIHDGPYNVIKNWNYTGLVDAIHNGEGKCWTTKVRYEEELVEAIKTATTEKKDSLCFIEVIVHKDDTSKELLEWGSRVSAANGRPPNPQ

SEQ ID NO: 1506 - protein, 757 aa, Oryza sativa
RLRVAEGGGDPWLRTKNGHVGRQVWEFDPAAGDPDELAAVEAARRGFAARRHELKHSSDLLMRMQFAKANPLKLDIPAIKLEEHEAVTGEAVLSSLKRAIARYSTFQAHDGHWPGDYGGPMFLMPGLIITLYVSGALNTALSSEHQKEIRRYLYNHQNEDGGWGLHIEGHSTMFGSALTYVSLRLLGEGPDSGDGAMEKGRKWILDHGGATYITSWGKFWLSVLGVFDWSGNNPVPPEIWLLPYFLPIHPGRMWCHCRMVYLPMCYIYGKRFVGPVTPIILELRKELYEVPYNEVDWDKARNLCAKEDLYYPHPFVQDVLWATLHKFVEPAMLRWPGNKLREKALDTVMQHIHYEDENTRYICIGPVNKVLNMLACWIEDPNSEAFKLHIPRVHDYLWIAEDGMKMQGYNGSQLWDTAFTVQAIVATGLIEEFGPTLKLAHGYIKKTQVIDDCPGDLSQWYRHISKGAWPFSTADHGWPISDCTAEGLKAALLLSKISPDIVGEAVEVNRLYDSVNCLMSYMNDNGGFATYELTRSYAWLELINPAETFGDIVIDYPYVECTSAAIQALTAFKKLYPGHRKSEIDNCISKAASFIEGIQKSDGSWYGSWAVCFTYGTWFGVKGLVAAGRTFKNSPAIRKACDFLLSKELPSGGWGESYLSSQDQVYTNLEGKRPHAVNTGWAMLALIDAGQAERDPIPLHRAAKVLINLQSEDGEFPQQEIIGVFNKNCMISYSEYRNIFPIWALGEYRRRVLAADK

SEQ ID NO: 1507 - protein, 340 aa, Glycine max
  unsure (1)..(340): unsure at all Xaa locations
MGKVKIGINGFGRIGRLVARVALQRDDVELVAVNDPFITTDYMTYMFKYDSVHGHWKHHDVTVKDEKTLLFGDKPVTVFGHRNPEEIPWKSTGADIIVESTGVFTDKDKXAAAHLKGGAKKVIISAPSKDAPMFVVGVNEHEYKPELDIIXNASCTTNCLAPLAKVINDRFGIVEGLMTTVHSITATQKTVDGPSAKDWRGGRAASFNIIPSXSTGAAKAVGKVLPALNGKLTGMAFRVPTVDVSVVDLTVRLEKEASYDEIKNAXKEESEGKLKGIXGYTEDDVVSTDFVGDSRSSIFDAKAGIALNKNFVKLVSWYDNEWGYQXRVIDLLVFVAKKSF

SEQ ID NO: 1508 - protein, 353 aa, Oryza sativa (japonica cultivar-group)
MRHISSLLQGLARSLSVGKERKGGDGDDGKAAAATATAVLRTSGTLWGEGSETFAAVCSRRGEKGINQDCSIVCEGFGCEEGSVLCGIFDGHGQWGHYVAKAVRESLPPALLRRWREAVTLAALIDGGEKRLCECRPDLWRQSYLAACAAVDAELRASRRLDAVHSGCTALSLVKHGDLLVVANVGDSRAVLATASPDDGGGARLAAVQLTVDFKPNLPQERERIMECNGRVQCLADEPGVHRVWRPDREGPGLAMSRAFGDYCVKDYGVISAPEVTHRRITAQDHFVILATDGVWDVVSNEEAVQIVASAPEREKAAKRLVEFAVRAWRRKRRGIAVDDCSAICLFFHSPPS

SEQ ID NO: 1509 - protein, 556 aa, Zea mays
  unsure (1)..(556): unsure at all Xaa locations
MDSVRSWFQKFQPRDKSKRPVVAARHGKDPGKPPMDDAPSSATKQRVAAAKQYIENHYKTQMKSLQDRKERRWMLERKLQDAEVPVEEQNNILKHLEKKETEYMRLQRHKMGVEDFELLTIIGRGAFGEVRLCREKASKNVYAMKKLKKSEMLRRGQVEHVKAERNLLAEVDSAYIVKLYYSFQDEEFLYLIMEYLPGGDMMTLLMRKDTLTEDEARFYIAETVLAIESIHKHNYVHRDIKPDNLLLDSXGHLKLSDFGLCKPLDSSNFPNLNEPDYMSGKVTTPLPDTTRLSNPSAPRRTQQEQLSHWQKNRRMLAYSTVGTPDYIAPEVLLKKGYGTECDWWSLGAIMYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFENFEEIGTQIQSSSKSGPWRKMLPSKDANFVGYTYKNFEIVNDDEVAGIAELKKKSSKSKRPTIKTLFESMDEEEPVQGSFLGMLPPKEGQPSSHSSVPQEKHQPRRK

SEQ ID NO: 1510 - protein, 104 aa, Triticum aestivum
MGGGNDGHGYPPGGQGGYPPAGYPPQQGGYPPQQGGYPPQQGYPPAPGAYPPAPGAYPPAPGAYPPAPGAGGPDGEKGLLSNIKHGKHGKHTRSLTAATVEVDT

SEQ ID NO: 1511 - protein, 360 aa, Oryza sativa (japonica cultivar-group)
MEHEQLLQASTELMNHSLGYIRSMALGCAAKLGVADAIHHAGGRATMDDLRAALSLHPSKLPYFLRRVMRVLVASGVFAHDEEEDDDDIYRVTPVSSLLVTATGGNGGRSLLPFVLLQLSPPIYVTPATSMAEWLTSGEEETPFEMTHGAGLWTVCSRDPELGELFNDAMAADSAFIMDVAIRGAGRQVFDKITSLVDVAGGTGTAARVVAAAFPHIKCTVLDLPHVIDSIPADHRGRDVVKFVAGDMMDFIPRADALLLKFVLHDWSDEDCMKILKRCKEAIPSREAGGKVIVIDVVVGSSTQAMCHGTQLLFDLLISTTLPGMQRGEKEWCKVFKEAGFTDYKISPVLGIRSIIEVFP

SEQ ID NO: 1512 - protein, 331 aa, Vibrio vulnificus CMCP6
MTIKVGINGFGRIGRFVFRAAQERADIEVVGINDLIDVDYMAYMLKYDSTHGRFNGTVEVEGGNLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALTDNFVKVVSWYDNEIGYSNKVLDLIAHISK

SEQ ID NO: 1513 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIXXXXXXXXXXXVRAAIEYAIANDRDSVTLVHKGNIMKFTKGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 1514 - protein, 79 aa, Glycine max
LRWHAVASWTWDAQDETCGICRMAFDGCCPDCKLPGDDCPLIWGVCNHAFHLHCILKWVNSQTSQAHCPMCRREWQFKG

SEQ ID NO: 1515 - protein, 221 aa, Zea mays
  unsure (1)..(221): unsure at all Xaa locations
MACSHIAAAGVSSPAAAAARSPAHSPASAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRGILISPGPGEPQDSGISLQTVLELGPTIPIFGVCMGLQCIGEAFGGKIIRAPSGVMXGKSSPVYYDEELGKALFNGLPKYGLIPFALLSRKQIFSMV

SEQ ID NO: 1516 - protein, 360 aa, Prochlorococcus marinus str. MIT 9313
MSSAPSLHGGNRIDEAQRLGCRPEQLLDASASLVPFPPSRALQGCLRRALTDNTLRDYPDRSHQRLRDVISNWHGVDPLMVLPGNGAAELFTWAARDAASEGVSGLPSPGFADYGRALRCWQACQQALPLPLSWSGEMPQPFPLLSNSDVLWITNPHNPTGQLWSRASLEPLLARYQLVICDEAFLPLVPDGERQSLVSLVVNHPNLVVIRSLTKLFALAGLRLGYAIGTPERLQRWQQWRDPWPLNGLAIAAGIALMADRPAFERWIARVQGWVAQEGLWMQTQLRCLPGIRSYPSAANFLLIRGDVSLVPLRERMAHRRVLLRDCRSFAELGERWLRIGLQQRSANRRILAAFKALLR

SEQ ID NO: 1517 - protein, 330 aa, Zea mays
MSFGAVDMEEESGAAAAAAAVEEIRRLPAEVNWEMLDKSRFFVLGAALFSGVSAALYPAVVVKTHLQVAPPPQAARATAAAILRRDGLRGFYRGLGASLGGTVPARALYMAALEATKSSVGSAAVRLGVSEPAASAAASAAAGVSAAVAAQVVWTPVDVISQRLMVQTPACCRYRGGVDACRKILVADGVRGLYRGFGLSILTYAPSNAVWWSTYVVAQRCLWRAVGPERSESCASLMAVQGASAAVAGGAAALVTMPLDTVKTRLQVMEADAARPTLASTVRGLLREGGWAACYRGLVPRWGSMSLSAATMVTTYEFLKRLSAKDGSLG

SEQ ID NO: 1518 - protein, 419 aa, Neisseria mucosa
FTIPARIVLDDPEEWFENGQAFDGSSIGGWKGIQASDMQLRPDPATAFIDPFYDDTTVVLTCDVIDPADGQGYDRDPRSIARRAEAYLKSTGIGDTAYFGPEPEFFVFDGVEFETDMHKTRYEITSESGAWASGLHMDGQNTGHRPTVKGGYAPVAPIDAGQDLRSAMVNILEELGIEVEVHHAEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 1519 - protein, 865 aa, Emericella nidulans
MATLSSLRHLIQTHPLIDNHAHNLLSQSAACKYAKYPFEQIISEAQGVALANAPSTLSFHRAASQLATLYQSSSSDWDSVRAARDQSVQRDYEGLIRKCLEGTQVLLLDDLLTENDVELFDWHDRFTASATKRIVRIEALAASVLSQIVHGGPVPQDSSDLSAFQTLWESFSRNFSALVSDAIADPAVVGFKSVICYRTGLDVQPTDDRDTERLIRSFARTISQAAVSTPRVEDKPLNDWLVRQTLNLLKAAKVTQPNKPLQLHTGLGDNDINLLKSNPAHLQSLIAQYPEVDFVLLHSSYPYTREAGYLACVYPNVYLDLGEVFPMVSRDAQESILRESLEIVPSTRLLWSTDGHFFPETFWLANRQFRDALEKVFVDYVQNGDYTIEQAMQAAADILFHNSNRLYELNEQPPSAALSSGHQTVSRISSTDLLEKFIRSNPGVKYVWTQFIDYTATVRVRMFPVMEFAKIVRKQRRLGISMATFWMLQDDEVVGGSTTGQFYLIPDLSTLSPNVGIDSKSATVMTWWKSEQGESLEECPRTNLLNINNKLKDEFGIQATCGFEIEVVFLKPTTDPSTGEEDWAPSVTNHSWSQMTRETRRMLPLLEEIAETLASIGIHLQQFHAESAPGQFEFILPPDNPVAAVDTLIKSRQVIANIVEKHGLRATLYPRPYPSAAGTASHAHVSISPSTKEESFLAGVLQHYPAVLAFTLSGDASYDRVKSGIWAGSEWVTWGTQNREAPIRKISPGHWEIKSLDGLANMYLAMAAFLAAGYTGVKENLPLTIKDCPYDAASLPESERAALGITTKLPNTLAKSLAALESDEILRSLLGENLVEDYIIVKRAESKKLSAMDEKARRKWLVERY

SEQ ID NO: 1520 - protein, 200 aa, Mesembryanthemum crystallinum
MAEQGLEGSQPVDPIKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLTEFRKNQQ

SEQ ID NO: 1521 - protein, 133 aa, Triticum aestivum
MIHPKKLAQLAKKWQRKVAARAGGQQADECCSPVADKGHCVVYTADGARFEVPLAYLGTTVFAELLRIAGEEFGFASNAGEQGHAALQCRGYGTMSCAWLGELPPGGKRFLSPNWAMRGKDIDGEPNNNPLLN

SEQ ID NO: 1522 - protein, 457 aa, Oryza sativa (japonica cultivar-group)
MAAAAAAATVEAVGVAGGRRRRSGSVALGDLLRREASAERASASASAGAGGRERERRPSVAAGQACRAKKGEDFALLKPACERLPAGGAPFSAFALFDGHNGSGAAVYAKENILSNVMCCVPADLSGDEWLAALPRALVAGFVKTDKDFQTRGTTVTFVIIDGYVVTVASVGDSRCVLEAEGTIYHLSADHRFDASEEEVGRVTECGGEVGRLNVVGGAEIGPLRCWPGGLCLSRSIGDQDVGEFIIPVPYVKQIKLSSAGGRIIISSDGVWDALTVDTAFSCARGLPPEAAADQIVKEAIASKGLRDDTTCIVIDIIPPEKISPTVQPAKKAGKGLFKNIFYKKATSDSPCHADKDQCTQPDLVEEVFEDGCPSLSRRLDSEYPVRNMFKLFICAICQVELESGQGISIHEGLSKSGKLRPWDGPFLCHSCQEKKEAMEGKRHSRDSSSRNSGSSE

SEQ ID NO: 1523 - protein, 534 aa, Desulfitobacterium hafniense
  unsure (1)..(534): unsure at all Xaa locations
MFGYPGGAVLPIYDALINSPIRHLLPRHEQTAIHAADAFARVSGKVGVCLATSGPGATNLVTGIANAYMDSXTRCDXLTGQVPTSLLGTDSFQEVDITGITLPITKHSYLVKDPRQIPRIVKEAFYIASTGRPGPVLIDLPKNVLAATDVRPAPAELNLKSYKYFTKGNAGQIEEAARVIAQSQRPVLYAGGGVITAGASEILQQVVERANLPVVTTLMGIGSLPTNHPNVLGMVGMHGTVTANYAVDDCDLLIAIGVRFDDRVTSGLGHRFATKAKIIHIDIDPAEIGKVARTKVPIVGNAKLVLEELLSKVSKPEISPWWEQIRLWQEEKLKTDNPNLNPQVIIETLGEIAGEETIVTTDVGQHQMWAAQGYPVPAPRHFITSGGLGTMGFGLPAALGAQVAAPESTVFLVTGDGSFQMSIQELATAVQYQLPVKIILMNNGVLGMVRQLQMVFCDERYSQIQLTANPDFIKIAEAYGIRGIRVTETSEVRNALLEAINHPGPVLMDFIISEDEVVSPMVPPGKGLTEMLGW

SEQ ID NO: 1524 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLIDDYKRTHASTIAVMPVPHDEVSAYGVIAPQGEGKDGLYSVETFVEKPAPEDAPSDLAIIGRYLLTPEIFEILEKQAPGAGNEIQLTDAIDTLNKTQR

SEQ ID NO: 1525 - protein, 493 aa, Zea mays
VRRSGSSSSLATAMDPYKHARRAPSTPVLDHNSAPRVEQRQLLTVGARGPILLEDLVVEKLANFDRERIPERVVHRCGASAKGFFEVTHDITTDVADSAGRTAGMQAVIAVSLNCVALALRYHDGSPETLGPRVASVYTGGNWTVETLPSLIRDGIKSGHVHALKPNPRTHIQDNWRILDFFSHHPESLHMFSFLFDDSGIPADVRPHGGSGVHTYTLVSRAGTVTYVKFHWRPTCGVRSLMDDEAVAVGAQPQPRTKDLTDAIAAGNFPEWTLYIQTMDPEMEDRLQHLDPLDVTKTWPEDVPLEPVGRLVLNRNIDNFFAENEQLAFSPGLIVPGIYYSDDKLLQTRIFSYSDTQRHRLGPNYLLLPANAPKCAHHNNHYDGSMNFMHRTEEVDYFPSRYDAVRNAPRYPIPTAHIAGRREKTVISKENNFKQPGERYRAMDPARQERFITNGSTLEIPGYRARIRNHGHSCFLCEIVIRSQFHTTYEPEA

SEQ ID NO: 1526 - protein, 366 aa, Buchnera aphidicola str. Bp (Baizongia pistaciae)
MKRNYKIAVLPGDGIGPEIMREGYKILRILKSKLSLNIMTQEFDVGGVAIDKYGVALPKKTLQGCRDSHAILFGSIGGPKWEDLPSHLQPERGALLPLRKYFNLFSNLRLARIYSGLEKLSPLKSRISNLGCDILCVRELTGGIYFGDPKGSKVSKSLNCAFDTEVYYQFEIERIAHMAFDLALTRRCKVTSIDKANVLESSMFWRKIVNRISTQYSQVKLSHLYVDNAAMQIIKNPSQFDVLLCSNLFGDILSDECAAITGSIGLLPSASLNDKNFGLYEPAGGSAPDIKGKNIANPIALILSIGMMMRYSFKLYDVADLIDWAVNKTLKLGYRTQDISENNKFINTSSMGDIIAEILANRIHKI

SEQ ID NO: 1527 - protein, 320 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKEFYCVGIQG

SEQ ID NO: 1528 - protein, 212 aa, Shewanella oneidensis MR-1
MNSQQCVIIAIAGASASGKSLIAKTIFDELRRDLGTDQIGVINEDAYYRDQSHLSMDERVLTNYDHPKALDHQLLCTHLQLLKSGEAVDIPCYSYTEHTRMAETVKMTPKKVIILEGILLLTDPKLRELMDASVFMDTPLDICFLRRLTRDVAERGRTMESVISQYKKTVRPMFLQFIEPSKQYADIIVPRGGKNRIATDILKTRIQHLLAK

SEQ ID NO: 1529 - protein, 429 aa, Bacteroides fragilis [sequence omitted]

SEQ ID NO: 1530 - protein, 434 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLSALFLIIILQVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 1531 - protein, 392 aa, Zea mays
CVLQGGGLSEFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 1532 - protein, 138 aa, Oryza sativa (indica cultivar-group)
SDDKALKRHLLRKYSGYLGGLRKELSKKRKKGKLPKEARQKLLTWWELHYRWPYPSEMEKIALAESTGLEQKQINNWFINQRKRHWKPTEEMQFAVMEAYHHQSTDAAAAFYVDVDARLVGATAAAPASAVYTARPDH

SEQ ID NO: 1533 - protein, 302 aa, Leuconostoc mesenteroides subsp. mesenteroides ATCC 8293
MKFAMIGLGKMGLNLVKNAVDNGHEVVAFDLNADFVKEATDYSASVEAASDIDDMLSKLPSPKAVWVMVPAGVPTNSTIDTLIEKMDKGDIIIDGGNSNYKDNLEQNKRTSAAGIKFFDAGTSGGMNGARNGGNFMIGGDDAEAWKIIEPLFKSISEEDGYLYTGRLGSGHYLKMVHNGIEYGMMQAIAEGFEVLEASQFDYDYEAVSKLWNHGSVIRSWLMELAEEQFAKDPHLDAIAGRMHSSGEGKWTVQESLDLDVPAPVIYLSLAMRYRSLQDDTFTGKVVSALRNGFGGHAMDAAK

SEQ ID NO: 1534 - protein, 539 aa, Zea mays subsp. mays
MSIGLTAETVTNKLASAEHPQVVPNSVFIALLCLCLVIGHLLEENRWVNESITAILVGAATGTVILLISKGKSSHILVFDEELFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSVVLFNAVQKIDFEHLTGEVALQVFGNFLYLFSTSTVLGIATGLITAFVLKTLYFGRHSTTRELAIMVLMAYLSFMLAELFSLSGIITVFFCGVLMSHVTWHNVTESSRITSRHVFAMLSFIAETFLFLYVGTDALDFTKWKTSSLSFGKSLGVSSVLLGLVLVGRAAFVFPLSFLSNLSKKHPGEKITIRQQVVIWWAGLMRGAVSIALAFNKFTRAGHTQVRGNAIMITSTIIVVLFSTVVFGLLTKPLINLLIPHRNATSMLSDDSSPKSLHSPLLTSQLISSIEEPTQIPRPTNIRGEFMTMTRTVHRYWRKFDDKFMRPMFGGRGFVPFVPGSPTERSSPDLSKA

SEQ ID NO: 1535 - protein, 145 aa, Triticum aestivum
  unsure (1)..(145): unsure at all Xaa locations
MAGAEVVDSGEKRLNELGYKQELRREMTLFKTLAISFSTMTLFTGITPLYGSSLQYAGPASLVWGWVVVSFFTWFVGIAMAEICSSFPTTGSLYFWAAHLAGPVWGPLASWCCAWLEAIGLIAGXGTQAYAGSQVLQSIILLCSG

SEQ ID NO: 1536 - protein, 507 aa, Shigella flexneri 2a str. 301
MSQQFNPYLCCFRPDTCVNCSRIFSQCLTLCWQEKMVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGAAFLTLLDSIGAAGTFWLYTALNIAFVGITFWLIPETKNVTLEHIERKLMAGEKLRNIGV

SEQ ID NO: 1537 - protein, 472 aa, Gracilariopsis sp.
ESGVIPYAKMGYWDPDYVIKDTDVLALFRVTPQPGVDPVEASAAVAGESSTATWTVVWTDLLTACDLYRAKAYKVEAVPNTTDQYFAFISYDLDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYAMEGVNRAVAATGEVKGHYMNVTAATMEDMYERAEFAKQLGSIIIMIDLVIGYTAIQTMAIWARKNDMILHLHRAGNSTYSRQKSHGMNFRVICKWMRMAGVNHIQEGTVVGKLEGDPLMIRGFYNTLLETNLEINLPQGIFFEQDWASLRKVTPVASGGIHCGQMHQLLDYLGIDVVLQFGGGTIGHPDGIQAGATANRVALESMVMARNEKRDYVAEGPEILRDAAKTCGPLQTALDLWKDITFNYTSTDTADFVETPTANV

SEQ ID NO: 1538 - protein, 543 aa, Glycine max
  unsure (1)..(543): unsure at all Xaa locations
MVESQPKFFIPDSINGVNFDVAAQIKMVWEVMKAPLIVPLLNLAVYISLAMALMLFMERVYMGIVIILVKLFWKKPHQRYKFEPLQDDEELGNSNYPVVLVQIPMFNEKEVYKVSIGAACNLSWPADRLVIQVLDDSTDPTXVKQMVEMECQRWASKGINIVYQIRETRGGYKAGALKEGLKRNYVKHCEYVAIFDADFRPEPDFLRRSIPFLVGNPDIALVQARWRFVNSDECLLTRMQEMSLDYHFTVEQEVGSATHAFFGFNGTAGIWRIAAINEAGGWKDRTTVEDMDLAVRASLRGWKFLYLGDLQAKSELPSTLRAFRFQQHRWSCGPANLFRKMVMEIVRNKKVRFWKKVYVIYSFFFVRKIIAHMVTFFFYCVVIPLTILVPEVHVPIWGAVYIPSVITILNSVGTPRSIHLLFYWILFENVMSLHRTKATFIGLLEYGRANEWVVTEKLGDSVNNNKNKSGDAAKKNNAIKATPKKTRSKFVERLNLLELGFAAFLFVCGCYDYVHGKHNYFIYLFLQTLTFSIVGFGYVGTIV

SEQ ID NO: 1539 - protein, 488 aa, Porphyra tenera
MSQSVESRTRIKSERYESGVIPYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 1540 - protein, 455 aa, Ostiophyllum sonderopeltidis
VVKETDILALFRVSPQPGVDAVEASAAVAGESSTATWTVVWTDLLTACDLYRAKAYKVDSVPNTSDQYFAYIAYDIDLFEEGSIANLTASIIGNVFGFKAFKALRLEDMRLPVAYLKTFQGPATGIISERERMDKFGRPFLGATVKPKLGLSGKNYGRVVYEGLKGGLDFLKDDENINSQPFMRWKERYLDSMEGVNRAIAAAGETKGHYLNVTAATMEEMYERAEFGKQLGSIIVMIDLVIGYTAIQTMAVWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALESMVIARNEGRDYVVEGPRILQDAAKTCGPLQTALDLWKDITFNYTSTDTADFVETPTTNA

SEQ ID NO: 1541 - protein, 330 aa, Neisseria gonorrhoeae
VAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPATKEEINAAMKAASSESYGYNEDQIVSSDVVGIEYGSLFDATQTRVMTVGGKQLVKTVAWYDNEMSYTCQLVRTLEYFAGKI

SEQ ID NO: 1542 - protein, 498 aa, Aspergillus awamori
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASRNAIRNYAISKDTGFVTYKNWPIYKDDTTIPMRKGTDGSQIVTILSNKGASGDSYTLSLSGAGYTAGQQLTEVIGCTTVTVGSDGNVPVPMAGGLPRVLYPTEKLAGSKICYG

SEQ ID NO: 1543 - protein, 427 aa, Arabidopsis thaliana
MQNPRLKQHQQQQQQQAMMQQQALMQQHSLYHPGVLAPPQLEPVPSGNLPPGFDPSTCRSVYVGNIHTQVTEPLLQEIFTSTGPVESSKLIRKDKSSYGFVHYFDRRSAALAILSLNGRHLFGQPIKVNWAYATGQREDTSSHFNIFVGDLSPEVTDATLYQSFSVFSSCSDARVMWDQKTGRSRGFGFVSFRNQQDAQTAINEMNGKWLSSRQIRCNWATKGATSGDDKLSSDGKSVVELTTGSSEDGKETLNEETPENNSQFTTVYVGNLAPEVTQLDLHRYFHALGAGVIEEVRVQRDKGFGFVRYNTHPEAALAIQMGNTQPYLFNRQIKCSWGNKPTPPGTASNPLPPPAPAPVPGLSAADLLNYERQLALSKMASVNALMHPQGQHPLRQAHGINAAGATAAMYDGGFQNVAAAQQLMYYQ

SEQ ID NO: 1544 - protein, 472 aa, Burkholderia fungorum
MSTAYQPRASAAARLERLPFSGYHRTIFIIIAIAFFFDSVDLGTMTFVLGSIRTEFGLSSATAGLVASASFFGMVIGAAIAGLLADRFGRRPVFQWSMVLWGLASYLCSTAQSVEALIFYRVLLGFGMGMEFPIAQTLLSEFVPAASRGRLIALMDGFWPLGFIAAGVVSYFVLPTFGWRTEFALLAIPAVFVLIVRRMVPESPRWLEHRGRFGEADKILAEVEVKVMKAAGLSQLRPPAMLAEPPAAQGTGAFREIWSIAYRRRTIMVWTLWFFALLGFYGLTSWLGALMQQAGFAVTKSVLYTVLISLGGIPGFICAAWLVERWGRKPTCIASLAGSAVMAYVYGQTALHAQTPTLLICAGLAMQFFLFAMWAVLYTYTPELYGTGARATGSGFASAIGRVGSLIGPYVVGVVLPVFGQGGVFSLGAMCFVIAAAAVWILGIETRGLALETLVSEAVETDARGVLSPMRD

SEQ ID NO: 1545 - protein, 189 aa, Agrobacterium tumefaciens str. C58
MRAGYFEDKAIAGDRPFIPLGIAVLTVSDSRTLENDKSGDTLVARLEEAGHRLAARAIVPDDKAAIAETVREWTLSEGVDVVITTGGTGFTGRDVTPEALEPLFEKRMDGFSALFHRISYDKIGTATIQSRATGGVANATFIFVLPGSPGACKDAWDGILKAQLDYRHLPCNFVEIMPRLDEHLKRGKS

SEQ ID NO: 1546 - protein, 527 aa, Oryza sativa (japonica cultivar-group)
MAGGQLNVLSTLDQAKTQWYHFMAIVIAGMGFFTDAYDLFCISLVTKLLGRIYYTDDSKDTPGALPPNVSAAVTGVALCGTLAGQLFFGWLGDKLGRKSVYGFTLILMVVCSVASGLSFGSSAKGVVSTLCFFRFWLGFGIGGDYPLSATIMSEYANKRTRGAFIAAVFAMQGFGILFGAIVALAVSAGFRHAYPAPSYSDNHAASLVPQADYVWRIILMFGTVPAALTYYWRMKMPETARYTALIARNAKQAAADMSKVLHTQIEESADRAETVAVGGESWGLFSRQFLRRHGLHLLATTSTWFLLDIAFYSQNLFQKDIFSKVGWIPPAKTMNALEELYRIARAQALIALCGTIPGYWFTVAFIEIMGRFWIQIMGFAMMTAFMLGLAIPYHHWTTPGHHTGFIVMYGFTFFFANFGPNSTTFIVPAEIYPARLRSTCHGISAAAGKAGAIIGAFGFLYAAQDQHKPEPGYPRGIGIKNALFVLAGTNFLGTIMTLLVPESKGMSLEVISQEVADGDDEEAAYPK

SEQ ID NO: 1547 - protein, 77 aa, Zea mays
MRFLSLQGTSSTLSYDSDLASLVSKSNVLIVEGYLFELPHTIEAIKQACEDAHKNGAIIAVTASDVSCIKRCYNDFR

SEQ ID NO: 1548 - protein, 520 aa, Oryza sativa
SRSVGVTMDAAGADADQARLHQLGYRQELKRGLSLVSNFAFSFSIISVLTGVTTTYGTGLRYGGPVSMTLGWLVVAAFNGCVALSMAEICSAYPTSGGLYYWSAKLAGKEWAPLASWVTGWFNIVGQWACTTSVDFSLAQLLQVIILLATGGANGGGYMASKYVVLAIYSAILILHGLINSLPIRWLSWFGQLGAFWNVAGAFSLTILIPAVAKERVSPEFIFTHFNAENGAGIHDKAYILAAGLLMSQYSLIGYDTSAHIIEETKNADWSGPIGIITSVALSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTSLGSQVAFQAMVSIATLGLLIACALPVFFRVTTARRSFVRGPFHLGKYGVIVGWVGVVWVATVTVLFSLPVAYPVAKETFNYTPVAVGGVLLLSLVAWVLHARFWFQGPVTNVDTYNVP

SEQ ID NO: 1549 - protein, 391 aa, Oryza sativa
  unsure (1)..(391): unsure at all Xaa locations
FFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIATLCFFRFWLGFGIGGDYPLSATIMSEYASKKTRGAFIAAVFAMQGFGILFGAIIALVVSAGFRHAYPAPSYAQNPAASLAPQADYTWRLILMFGTIPAGLTYYWAXMKCPKTARYTALVARNAKQXAADMSKVLHAEIEERPEVVESQVVAGETWGLFSRQFIKRHGMHLLAITSTWFLLDIAFYSQNLFQKNIFSKVGWIPPAKTMNALEELYRISRAQALIALCGTIPGYWFTVAFIDIVGRFXIQIMGFFMMTVFMLALGVPYDHWTHPAHHTGFVVLYALTFFFANFGPN

SEQ ID NO: 1550 - protein, 290 aa, Agrobacterium tumefaciens str. C58
MGFIGGFCHLYIGQEAVVVGMQMSQKEGDQVITAYRDHGHMLALGMSARGVMAELTGRKGGLSKGKGGSMHMFSKEKHFYGGHGIVGAQVSLGTGLAFANRYRGNDNVSVTYFGDGAANQGQVYESFNMAALWKLPIIYIVENNRYAMGTSTARATAQSNYSLRGQSFGIPGVQVDGMDVRAVKAAADQALEHCRSGKGPIILEMLTYRYRGHSMSDPAKYRSKDEVQKMRSEHDPIEQVKARLLDHGWASEDELKAIDKDVRDIVADSADFAQNDPEPDVSELYTDILL

SEQ ID NO: 1551 - protein, 89 aa, Triticum aestivum
  unsure (1)..(89): unsure at all Xaa locations
APTVMAFSATSVAPFHGLKSTAGLPISRRSSSAGLSSATNGGRITCMQVWPIEGIKXFFTLSYLPPLSTEALLKQVHYLIRSKWVPCLE

SEQ ID NO: 1552 - protein, 242 aa, Zea mays
  unsure (1)..(242): unsure at all Xaa locations
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTHMIAAGYCMYGSSCTLVLSTGNGVNGFTLDPSLGEFILTHPNIKIXNKGKIYSVNERNARNWDAPTAKYVERCKFPQDGSSP

SEQ ID NO: 1553 - protein, 474 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKVFQTDVPTVKNINLDFSLGYYIILDMPFCPLIFNIYF

SEQ ID NO: 1554 - protein, 312 aa, Phaseolus vulgaris
MEGEGSRVVALYDGNGAITETKKSPFSVKVGLAQMLRGGVIMDVVNADQARIAEEAGACAVMALERVPADIRAQGGVARMSDPQLIKEIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKSIAAPYDLVMQTKQLGRLPVVHFAAGGVATPADAALMMQLGCDGVFVGSGVFKSGDPAKRARAIVQAVTHYSDPEILAEVSCGLGEAMVGINLSDTNVERFANRSE

SEQ ID NO: 1555 - protein, 429 aa, Candida albicans
MGCGASVPVDDDEIDPFLQDKRINDAIEQSLQLRQQNSKKGVKLLLLGAGESGKSTVLKQLKLLHKGGFTQQERRQYSHVIWCDVIQSMKVLIIQARKLKIKLDCDQPNNSLIPYKQIILRSDPLKQIDASVAGGTDFLNDFVVKYSEENKNKRRLKSTGTTDIWGKDDDSNINSDAINQALELSLNKDSEQFTRLSIAEAIHKLWKLDSGIKKCFDRSNEFQLEGSADYYFDNVVNFADTNYLSTDLDILKGRIKTTGITETDFLIKSFQFKVLDAGGQRSVRKKWIHCFEDITAVLFVLAISEYDQNLFEDERVNRMHESIVLFDSLCNSKWFANTPFILFLNKIDIFENKIKKNPLKNYFPDYDGKPDDTNEAIKFFETNFLKINQTNKPIYVHRTCATDSKSMKFVLSAVTDMIVQQNLKKSGIM

SEQ ID NO: 1556 - protein, 366 aa, Eucalyptus gunnii
MGSTGSETQMTPTQVSDEEANLFAMQLASASVLPMVLKAAIELDLLEIMAKAGPGAFLSPGEVAAQLPTQNPEAPVMLDRIFRLLASYSVLTCTLRNLPDGKVERLYGLAPVCKFLVKNEDGVSIAALNLMNQDKILMESWYYLKDAVLEGGIPFNKAYGMTAFEYHGTDPRFNKIFNRGMSDHSTITMKKILETYKGFEGLETVVDVGGGTGAVLSMIVAKYPSMKGINFDLPHVIEDAPPLPGVKHVGGDMFVSVPKGDAIFMKWICHDWSDDHCAKFLKNCYDALPNIGKVIVAECVLPVYPDTSLATKNVIHIDCIMLAHNPGGKERTQKEFETLAKGAGFQGFQVMCCAFGTHVMEFLKTA

SEQ ID NO: 1557 - protein, 337 aa, Podospora anserina
MTVKVGINGFGRIGRIVFRNAVEHPDVEIVAVNDPFIEPKYAEYMLKYDSTHGVFKGTIQVSGSDLIVNGKTVKFYTERDPSAIPWKDTGAEYIVESTGVFTTTEKASAHLKGGAKRVIISAPSADAPMYVMGVNEKTYDGKAAVISNASCTTNCLAPLAKVVNDKFGIVEGLMTTVHSYTATQKTVDGPSAKDWRGGRGAAQNIIPSSTGAAKAVGKVIPELNGKLTGMAFRVPTSNVSVVDLTCRLEKPASYETIKAALKEASEGELKGILGYTEDEIVSSDLNGNANSSIFDAKAGISLNDNFVKLVSWYDNEWGYSRRVLDLLSYVAKYDASH

SEQ ID NO: 1558 - protein, 157 aa, Griffithsia japonica
ARGKMKWSVEDNVPDMTGKTVLITGSNSGLGYHCADQLLSRGATIVLACRNADKMGAAAVSLQAAHGTPASRILQLQLDVSDLVSVRAAPAALLELGVSALYGLVLNAGVNGRDVVTFTTDGLERVFVTNILGHWLLTGLLLPLMRDVEGSRVVAVS

SEQ ID NO: 1559 - protein, 115 aa, Salmonella enterica
GMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDG

SEQ ID NO: 1560 - protein, 556 aa, Oryza sativa; identical to SEQ ID NO: 1331

SEQ ID NO: 1561 - protein, 380 aa, Synechococcus sp.
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVLITAPGKAEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKSGRLGLVQTLLISSQDSLPLTGGFFVAKREHPRSQDSINPSGPD

SEQ ID NO: 1562 - protein, 389 aa, Oryza sativa
  unsure (1)..(389): unsure at all Xaa locations
MASAASVEEPAAAAXAAAAETKRGPSGASFIREHLRSLAPYQPILPFEVLSARLGRKPEDIIKLDANENPYGPPPEVTKALGNLKFPYVYPDPESRQLRAALAEDSGLESEYILAGCGADELIDLIMRCVLEPGDKIVDCPPTFTMYEFDASVNGALVIKVPRLPDFSLDVAQIVKVVEQEKPKSIFLTSPNNPDGSIINDEDLLKILDLPILVVLDEAYIEFSSLQTRMSWVKKHDNLIVLRTFSKRAGLAGLRVGYGAFPLSIIEYLWRAKQPYNVSVAAEVSACAALQNPTYLEEVKNLLLQERDRLYDLLKEIPFLKPFPSHSNFILCEVTSGKDAKKIKVEDLAKMGVMIRHYDKKELKGYIRISVGKPEHTDALMKGLKALQL

SEQ ID NO: 1563 - protein, 217 aa, Oryza sativa
  unsure (1)..(217): unsure at all Xaa locations
SNFFYTYXVQQRQWPPLHAPHQGPQQRLLLGRPDARLRGHRLLPRLRIRILQQEEEGPVRGRRRRRARHRHLXAGGLANQLRYADGNWGERLIDFKDGRRYAGPFLLYFSYGLLDAMFQSLIYWIIGALANDTQILSRYVGFYKGVQSAGAAVAWQIDTHKTSLISQLIVNWALTTVSYPLLALLVXLAVKEKDSSVSSVEDGKEKDSKLSAPTSFH

SEQ ID NO: 1564 - protein, 573 aa, Saccharomyces bayanus
MLSKSEKHIDLLAGNMSNLSFDGPGTPSSTGLFNVNQNNTNRRMRPTGFNDSPSPIKSSLFPHEDSSNMDIDEVSQSDMDITNSPKKLPPKFYERATSNKTQRVVSVCKMYFLEYYCDMFDYVISRRQRTKQVLEYLQQQSQLPTADQAKLNEEWSSYLQKEHQVLRKRRLKPKNRDFEVITQVGQGGYGQVYLARKKDTKEVCALKILNKKLLFKLNETKHVLTERDILTTTRSEWLVKLLYAFQDLQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEVNYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGSEHSDPFATFY

SEQ ID NO: 1565 - protein, 351 aa, Lolium perenne
MADEEACMFALQLANSAVLPMAIRTSIELGLLETLVGAGGKLLTPEEAVKKLPSKAKHPDAASMIDRMLRVLASYKVVTCEVEEGKDGSLSRRYGATPVCRWLAPNEDGASMAPFALLTQDRVFMEAWCHMKDAILEGGSAFHRAFGTSWFEYAGQDARFNRLFNEAMEHHSVILTKKLLELYKGFDGIGTLVDVAGGVGAVIHAITSKYPSIKGINFDLPHVIADAPPYPGVEHVSGDMFKKMPSGDAILMKWILNCFSDDECATLLKNCYDALPAHAKVINVECILPVNPDATNGAQALIAVDLSLLVYSPGGKERYHRDLEKLAKGAGFTSVTATYIFADFWAMEYTK

SEQ ID NO: 1566 - protein, 404 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYEV

SEQ ID NO: 1567 - protein, 334 aa, Haemophilus somnus 129PT
MTIKIGINGFGRIGRIVFRAAQTRDDIEVVGINDLIDVEYMAYMLKYDSTHGRFDGTVEVKDGNLVVNGKAIRVTSERDPANLKWNELGVDVAVEATGLFLDDATARKHITAGAKKVVLTGPSKDATPMFVNGVNFDAYAGQDIVSNASCTTNCLAPLAKVINDKFGIKDGLMTTVHATTATQKTVDGPSAKDWRGGRGAAQNIIPSSTGAAKAVGKVIPALNGKLTGMAFRVPTPNVSVVDLTVNLEKPATYAEICAEIKRASENEMKGVLGYTEDAVVSTDFNGCSLTSVFDAAAGIALTDTFVKLVSWYDNETGYSNKVLDLVAHVHNYKG

SEQ ID NO: 1568 - protein, 375 aa, Methanosarcina barkeri
MTQYKIPVLPGDGIGPEIIAEGRKVIDAAGERFGFDVEWIEYPQGADHYLETGELISEDTLKELSGYPAIYLGSIGDPRIAPGVLEKGILLTARFYFDEYVNLRPIKLLDGVWTPLKDKTSKDIDFVVVRENTEDFYVGVGGRAKKGASKDLLEVKRTLYSAKFGLDIETDSEEIGYQIGLISKEGTDRVIEYAFDLAENRRKHVSSVDKANVLSDIYGFWREEFNAISAKHPGVTTDFNFVDAVTMWFVKNPEWFDVVVTPNMFGDIITDLGAMIQGGLGLAPGGNINPTGTSMFEPIHGSAPKYKGQNKVNPIATIWAGAMLIEHLGEKEAADTIVNAIQKNILDSKVKTYDMGGKSTTSDVGDDIARIIKGE

SEQ ID NO: 1569 - protein, 638 aa, Zea mays
MATAATAAAALTGATTATPKSRRRAHHLATRRALAAPIRCSALSRATPTAPPATPLRPWGPNEPRKGSDILVEALERCGVRDVFAYPGGASMEIHQALTRSPVIANHLFRHEQGEAFAASAYARSSGRVGVCIATSGPGATNLVSALADALLDSVPMVAITGQVPRRMIGTDAFQETPIVEVTRSITKHNYLVLDVDDIPRVVQEAFFLASSGRPGPVLVDIPKDIQQQMAVPAWDTPMSLPGYIARLPKPPATEFLEQVLRLVGESRRPVLYVGGGCAASGEELCRFVELTGIPVTTTLMGLGNFPSDDPLSLRMLGMHGTVYANYAVDKADLLLAFGVRFDDRVTGKIEAFAGRAKIVHIDIDPAEIGKNKQPHVSICADVKLALQGMNTLLEGSTSKKSFDFGSWHDELDQQKREFPLGYKIFNEEIQPQYAIQVLDELTKGEAIIATGVGQHQMWAAQYYTYKRPRQWLSSAGLGAMGFGLPAAAGAAVANPGVTVVDIDGDGSFLMNIQELAMIRIENLPVKVFVLNNQHLGMVVQWEDRFYKANRAHTFLGNPENESEIYPDFVAIAKGFNIPAVRVTKKSEVHAAIKKMLEAPGPYLLDIIVPHQEHVLPMIPSGGAFKDMILDGDGRTVY

SEQ ID NO: 1570 - protein, 164 aa, Yersinia enterocolitica
ESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRF

SEQ ID NO: 1571 - protein, 220 aa, Spinacia oleracea
RNLLSVAYKNVVGARRASWRIISSIEQKEESRGNEDHVSVIRDYRSRIEKELSDNCDGILKLLDTKLVPAASSGDSKVFYLKMKGDYHRYLAEFKTGAQRKEAAESTLTAYKAAQDIANAELAPTHPIRLGLALNFSVFYYEILNSPDRACNLAKQAFVEAIAELDTLGEDSYKDSTLIMQLLRDNLTLWTSDMQDEAADEITEEAAKQQKAVNNNKIAY

SEQ ID NO: 1572 - protein, 491 aa, Synechococcus sp. PCC 7942
MPRGVAPAFAGRKPKGWAWASTAVPDFQGGFKRLINRFQGSKLWLACVPLAATIAVFWGVAANAQGSADPVPSAQFLVNNLWLMVATVLVIFMNAGFAMVETGLCRQKNAVNVLAKNLIVFTLAATAYWFIGYSLMYGSPVVDGFLYFGKGGPLGFFFDPTVSAETIKNDGLISSLDFLFQAAFAGTAATIVSGSVAERIKFVDFIIFSLILTAVIYPIAGSWQWNVGSGWLNKAGFIDFAGSTVVHSVGGWAALIGAITLGPRMGKFQDGRPGALPGHNLAIATLGALILWIGWYGFNGGSVLAFNTAVPYVAVTTTLGGAAGGISATITSWSTSGKPDLSMVINGILAGLVGVTAGCDGFGMGGSFIVGLIAGVLVVFSVYTFENLKIDDPVGACSVHLVCGIWGTLAVGLFNLEKGLFYGGGFGQLGSQILGIISYGVWTVVASVIIWNILKALLGLRVSLKKSYKAWILANTGWKPTLALPRMHLTP

SEQ ID NO: 1573 - protein, 412 aa, Neurospora crassa
MAQVVSDFIYWLGNCMVCFPGSPTLKINNRSFKILRLLGEGGFSYVYLVQDTSTSELLALKKIRCPFGQESVAQAMHEVEAYKIFGNTPGIIHHVDYSIATERGSEGQDKTVYVLLPYYRRGNLQDMINANLVNHTRFPEKRLMMLFLGVCKALRGMHKYKGGAGGDTSGESMEVPGAAGKRKSKTRQAAVGGADEDDETEQQVPLIEEEGRLPGSGETRSYAHRDIKPGNIMISDSGRDPILMDLGSIAVSPLPITSRSLAIATQDTAAEHSTMPYRAPELFDVKTGTIIDTKVDIWSLGCTLYACLVGKSPFEMRSDETGGSLSICVLSGDWRFPDEGPGQTKGKGKAGAGGGAGGDSTATNKDDENYISEPIRDVVRRCLRVEPAERPDIDELIELVERVVEELPEDTA

SEQ ID NO: 1574 - protein, 494 aa, Salmonella typhimurium LT2
MSDVTLLAEVTTFLRQRHGQFIAGERQAGNGTNFSVTNPATGKIIADVVSATPAQAEEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 1575 - protein, 118 aa, Glycine max
  unsure (1)..(118): unsure at all Xaa locations
QSSRSESEVDLTCSDGTFARAAAPRKTSNAISVVPAMRDGGSDYLGKGVSKAVDNVNTIIAPALDGKDLTEKTPIHNSLLAYAFTPVYXSTLNPVKLGANAILAVSLAVCKAGATVLK

SEQ ID NO: 1576 - protein, 463 aa, Zea mays
MALTTASTVSSPSRIIRRFSSSQDSRPPSSLLHLAPRRGTGNSPRACSWHRLVVRRMGWAARALLGGLSDAGASESDEEEEHALRVGQREGEIDDAVELSATAVGPERWDVLGLGQAMVRATLVDFSGMVDDEFLDRLGIEKGTRKVINHEERGRVLRAMDGCSYKAAAGGSLSNSLVALARLGSSQSAGYPELNIVMGGSVGSDPLGSFYRAKLRRANVHFLSKPVKDGTTGTVIVLTTPDAQRTMLAYQGTSSTLSYDSDLASLVSKSNVLIVEGYLFELPHTIEAIKQACEDAHKNGAIIAVTASDVSCIKRCYNDFRDIVRNYADILFANANEARALCELPSTDSPMSATRYLSHSVPLVSVTDGMHGSYIGVKGEAIYIPPPQCVAVDTCGAGDAYASGILYGVLRGASDLKGIGLLASRVAAVVVGQQGTRLRVQDADRLAGSFEHHLDSLEFCSDV

SEQ ID NO: 1577 - protein, 150 aa, Betula pendula
GVKCLLDDEAIRVGGANHGHATKDLYVSIGAGNYPEWKLYIQIIDPDHEDKFDFDPLDVTKIWPEDILPLQPVGRLVLNKNIDNFFAENEQLVFCPSIVVPGVYYSDDKLLQTRIFSYSDTQRHRLGPNYLQLPANAPKCAHHNNHHEGF

SEQ ID NO: 1578 - protein, 412 aa, Bradyrhizobium japonicum USDA 110
MPGSIGLFQHGDLSSSRCAAAGLLARIQQWLLAPRHKSAGTKNAEAEIADGAPKFAGETEEMMRAQVLRAYDEKLSNDLWVGEEKVPDPKLTKSTDVIVRIGGAGVCRTDLHIVEGVWKPHMDPSGDKLLPLIMGHENAGWIEEVGKEVEGLKKGDPVIVHPKISGGTCLACRRGFDMHGPGTFPGLDCNGGYAEFLCTSERNIVPLPRTLAPKDVAPYADAGLTAYRAVKKATRHLLPGESCVVIGAGGLGHIGIQCLKAMCAADIIVVDKSEASLKLAEKSGADHLVKADGNEVEAVLGLTGGNGAEAVIDFVGEKGTTSKGLAMTRPMGSYYVVGYGEDIRVPTVDMVITEKNIIGNLVGTWAELTELMALADRDLVELATTEYRLADANKALHDLNAGEIHGRAVLIP

SEQ ID NO: 1579 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 1580 - protein, 351 aa, Bradyrhizobium japonicum USDA 110
MDGIISGLLPNVISPRCSPSVQGALQGRGAFPAGNHLEIAPNSRAILRHHAKGRPVMAEIKKAIEYSPSWTFFEGKWHDGNVPIMGPRTHAAWLGSVVFDGARAFEGVAPDLDRHIARANQSAINFGLKPVVDPGTWLTLANEGIARFATNAELYIRPMYWAENGSGGGVLFDPETTNWCLCIYEAPMPKPVGNAITLSPFRRPTAECAPVEAKAACLYPNNSRALAEAASRGFQNALMLDMLGNVAEFGNSNVFMARDGVVFTPVPNGTFLNGITRQRVIGLLRADGVTVVEKTLRYADFLAADEIFSTGNFAKVAPVIRIDERELKPGPLYTKARKLYWDFAHAVKLAA

SEQ ID NO: 1581 - protein, 303 aa, Streptomyces atroolivaceus
MSTLRDILASGTPTFSFEFFPPRTEAGSRMLWQAIRRLEALSPTFVSVTYGAGGSSRDRTVEVTKRIAAQTTLRPVAHLTAVGHSVAELRHIIGQYADAGVRDVLVLRGDPPGDPNAPWTPHPQGFTHAHELVRLVRNLGGFSVGVAAFPERHPRSADWDSDISHFVAKCRAGADYAITQMFFDVEDYLRLRDRVAAAGCDTPIIPEIMPATDVRQIRRFAELSNARFPAALADRLEAAAGDPAEGHRIGVEYATSMAERLLAEGAPGLHYITLNRSTATLEIHENIQSIRTSRSTHALAAAR

SEQ ID NO: 1582 - protein, 429 aa, Corynebacterium efficiens YS-314
MMRVSCSPTAPCPPSVGDQIMSTASITDHLTRVLSLCTPAPPVTLPVTEAVGCVLATDAHAVLPVPPFSNSAMDGFLVRASDLADGSDLTLPVTGDVPAGGEAITPAPGTAVRIMTGAPITDPHGLVVIPVEDTSAEPGPQDLPETVTIHSYRGRSHIRPRGDNVDTGDVLARDGDTVDAGLLAGLISAGVREVSVFPTPAVTVLSSGDELVDARSAPTTEQIPDSNRPMVAQLLRELGITCVTELHTGDDPAEFTAALRRAGEHSDLIITTGGVAAGAFDVVKAVMNTGEMWFGHVDMQPGKTQGAGTWGGVPVLCLPGNPVAAYVSFLMFVIPAVSKLRGRDAPATLDSRPRVTATARSPFPTAKAKNLIVPVRLTWDADGAGAAPFTRAGRGSHFVASLNGVGGFALIPPGATGLQPGGQVTVYLT

SEQ ID NO: 1583 - protein, 738 aa, Saccharomyces cerevisiae
MHKERPLNKASMIRSPVDEIYMEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 1584 - protein, 503 aa, Azotobacter vinelandii
MPRAAPTPCASCAWATSSIERRGLRCNRANLRTGRATSTSAPRMPNNRSCSPRARPFRPLHRTRHTMSKPSTSIQHVAAREILDSRGNPTVEAVVTLAGGATGVASVPSGASTGSREALELRDGALRYKGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGEYRLAGEGKTFDSRGFADYLAGLCERYPIVSIEDGLDESDWVGWAYLTEKLGQKVQLVGDDLFVTNPKILREGIERGIGNSILIKFNQIGSLSETLEAIRLAQQAGYTAVISHRSGETEDTTIADLAVATRAGQIKTGSLCRSDRVGKYNQLLRIEEALQGKAPYDATALLKRRCCSR

SEQ ID NO: 1585 - protein, 488 aa, Bacillus subtilis subsp. subtilis str. 168
MSVITEQNTYLNFINGEWVKSQSGDMVKVENPADVNDIVGYVQNSTAEDVERAVTAANEAKTAWRKLTGAERGQYLYKTADIMEQRLEEIAACATREMGKTLPEAKGETARGIAILRYYAGEGMRKTGDVIPSTDKDALMFTTRVPLGVVGVISPWNFPVAIPIWKMAPALVYGNTVVIKPATETAVTCAKIIACFEEAGLPAGVINLVTGPGSVVGQGLAEHDGVNAVTFTGSNQVGKIIGQAALARGAKYQLEMGGKNPVIVADDADLEAAAEAVITGAFRSTGQKCTATSRVIVQSGIYERFKEKLLQRTKDITIGDSLKEDVWMGPIASKNQLDNCLSYIEKGKQEGASLLIGGEKLENGKYQNGYYVQPAIFDNVTSEMTIAQEEIFGPVIALIKVDSIEEALNIANDVKFGLSASIFTENIGRMLSFIDEIDAGLVRINAESAGVELQAPFGGMKQSSSHSREQGEAAKDFFTAIKTVFVKP

SEQ ID NO: 1586 - protein, 178 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 1587 - protein, 237 aa, Pinus taeda
MGSLESEKTVTGYAARDSSGHLSPYTYNLRNKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFGMTEPGKKCGILGLGGVGHMGVKIAKAFGLHVTVISSSDKKKEEAMEVLGADAYLVSKDTEK

SEQ ID NO: 1588 - protein, 163 aa, Zea mays
MELQICSAELECQVPRNFRLLEELERGEKGIGDGTVSYGMDDADDIFMRSWTGTIIGPPNTVHEGRIYQLKLFCDTDYPDKPPTVRFQTRINMTCVNQETGLVEPSLFPMLGKWEREHTMEDILTSLKREMSTPQNRRLYQPHEGNEDQRVEQKGVSLRCVIM

SEQ ID NO: 1589 - protein, 328 aa, Pseudomonas aeruginosa UCBPP-PA14
MLPVKNLFVLYTGGTIGMLQTPQGLAPAGGFEARMRDHLQSLGDAPDLRWRFAELQPPLDSANMTQGNWLAMRDAIVAALDAGHDGVLLLHGTDTLAYSAAALSFLLLDLPIPVLLTGSMLPAGAPGSDAWDNLVGALRVLQEGHARGVQVYFNDALLHGARVSKLRSDAFDAFAELPRPRHAEPAPVPAALGYRQPRREVNLAVLPLYPGLRAAHLRGLLDSGVEALLLECYGSGTGPSDDEELLATLREAHARGVLLAAVSQCAYGQVEFGVYAAGSRLRDAGLLSAGGMTREAALGKLFGLLGAGLGRDEAQRWFALDLCGENAD

SEQ ID NO: 1590 - protein, 323 aa, Photobacterium profundum
MKRIAIIGECMIELNGAPFGTMQQAYGGDSLNTAVYMARTAGQSVEIDYISALGTDTISNGMISRWQQEGINTDYVLRDKTRQPGLYLIQLDDQGERTFLYWRNQSAARYLVRHPNFAQVELHLQTVDMVYVSGISLAVLPAEDRQQLVTLLGQLSSNGVEIAFDSNYRPALWESADEARKCYKQILSFTNLALVTDDDEETLWGDTSSQATLGRLQSTGVKKAVLKMGPKGCLYTDFTTDKPELIGTTPVETVIDTTSAGDSFNAGFLSGYLTDKTPREAALQGHQLAGTVIQHKGAIIPCYATEAMDFNIHSTASTTTTKL

SEQ ID NO: 1591 - protein, 213 aa, Zea mays
MDAADARPSAPSAAAAAVAGASVADEPRDARVVRELLRSMGLGEGEYEPRVVHQFLDLAYRYVGDVLGDAQVYADHAGKAQIDADDVRLAIQAKVLLELARSRNRMPLPKSIAPPGSIPLPPEQDTLLAQNYQLLPPLKPPPQFEETEDENEESNPSLTPNPANSNPTFSQDQRSNEQQHTPQHGQRVSFQLNAVAAAAAKRPRMTVDQLNIG

SEQ ID NO: 1592 - protein, 306 aa, Mycobacterium tuberculosis H37Rv
MSRPEVLTPFTAIVPAAGLGTRFLPATKTVPKELLPVVDTPGIELVAAEAAAAGAERLVIVTSEGKDGVVAHFVEDLVLEGTLEARGKIAMLAKVRRAPALIKVESVVQAEPLGLGHAIGCVEPTLSPDEDAVAVLLPDDLVLPTGVLETMSKVRASRGGTVLCAIEVAREEISAYGVFDVEPVPDGDYTDDPNVLKVRGMVEKPKAETAPSRYAAAGRYVLDRAIFDALRRIDQGAGGEVQLTDAIALLIAEGHPVHVVVHQGSRHDLGNPGGYLKAAVDFALDRDDYGPDLRRWLVARLGLTEQ

SEQ ID NO: 1593 - protein, 220 aa, Arabidopsis thaliana
FQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKGLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 1594 - protein, 494 aa, Ammi majus
MKMLEQNPQYLYFFSLFLVTIFLYKWLTLKKTPLKNLPPSPPQYPIIGNLHQIGPDPQASLRDLAQKYGPLMFLKFGTVPVLVVSSADAAREALKTHDLVFADRPYSSVANKIFYNGKDMVFARYTEYWRQVKSICVTQLLSNKRVNSFHYVREEEVDLLVQNLENSHSKVANLTELLIEVTGNVVCRVSVGSGDKVDSYKILILEIMDMLGYSRSIEDFFPLLGWVDWLTGLRGKVAEAAKGVDTFLEGVLKEHLSTTGSKYNDFVSILLEIQEADAGSSMDNECIKSLIWDMLGAGTETISTALEWTLAALIKNPDAMFKLQNEVREIGKGKSKISEADLVKMNYLQAVMKESMRLYFTAPLLVPREARQDIKFMGYDISSGTQVLINAWAIARDPLLWDKPEEFRPERFLNSPIDYKGFHYEFLPFGAGRRGCPGIQFAMCINELVVANLVHKFNFELPDGKRLEDLDMTAASGITLRKKSPLLVVARPHV

SEQ ID NO: 1595 - protein, 572 aa, Escherichia coli K12
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAQQISHFAADDAIFTCDVGTPTVWAARYLKMNGKRRLLGSFNHGSMANAMPQALGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIELAKTNWLR

SEQ ID NO: 1596 - protein, 445 aa, Ahnfeltia plicata
  unsure (1)..(445): unsure at all Xaa locations
FRVTPQPGVDPVEASAAIAGESSTATWTVVWTDLLTACDLYRAKAYKVDAVPKTPDQYFAYIAYDIDLFEEGSIANLTASIIGNVFGFKAVKALRLEDMRMPVAYLKTFQGPATGIIVERERMDKFGRPFLGPTVKPKLGLSGKNYGRVVYEGLKGALDFLKDDENINSQPFMRWKERYLYSIEGVNXXXAASGEIKGXYXNVTAATMEEMYERAEFANQLGSIIIMVDLVIGYTAIQSMAIRARRHDMILHLHRAGNSTYSRQKDHGMNFRVICKWMRMAGVDHIHAGTVVGKLEGDPLMIRGFYNTLLLPKLEVNLPQGIFFEQDWAALRKVTPVASGGIHCGQMHQLLDYLGIDVVLQFGGGTIGHPDGIQAGATANRVALESMVVARNEGRDYVSEGPQILRDAAKTCGPLQTALDLWKDISFNYTSTDTADFVETPTANV

SEQ ID NO: 1597 - protein, 271 aa, Trichodesmium erythraeum IMS101
GESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISN

SEQ ID NO: 1598 - protein, 457 aa, Lactobacillus brevis
MRKVSTGFVYFFGALGGLLFGYDTGVISGAILFIQKQMNLGSWQQGWVVSAVLLGAILGAAIIGPSSDRFGRRKLLLLSAIIFFVGALGSAFSPEFWTLIISRIILGMAVGAASALIPTYLAELAPSDKRGTVSSLFQLMVMTGILLAYITNYSFSGFYTGWRWMLGFAAIPAALLFLGGLILPESPRFLVKSGHLDEARHVLDTMNKHDQVAVNKEINDIQESAKIVSGGWSELFGKMVRPSLIIGIGLAIFQQVMGCNTVLYYAPTIFTDVGFGVSAALLAHIGIGIFNVIVTAIAVAIMDKIDRKKIVNIGAVGMGISLFVMSIGMKFSGGSQTAAIISVIALTVYIAFFSATWGPVMWVMIGEVFPLNIRGLGNSFASVINWTANMIVSLTFPSLLDFFGTGSLFIGYGILCFASIWFVQKKVFETRNRSLEDIEATLRAKTGEDAAELSTTK

SEQ ID NO: 1599 - protein, 387 aa, Zea mays
MADQANQPTVLHKLGGQFHLSSSFSEGVRARNICPSFSPYERRFATRNYMTQSLWGPSMSVSGGINVPVMPTPLFANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGSLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 1600 - protein, 195 aa, Zea mays
MGFPAGYSELVLPKQLLHLLLLLGYVRRFLLWAFDAVGLGDLLDLGDDHQAPQPQPQHRRAEFRAAMPAMVIEEALPVARFDELEARVVVGGDCAVCLGGIGGGDEVRRLGNCRHAFHRACLDRWMEHDQRTCPLCRAPLIPGAALWPADASDLDFSYPGAPLTPVVPSPTLTPVPSPTLLRPHELLLLAGLGGY

SEQ ID NO: 1601 - protein, 297 aa, Candidatus Carsonella ruddii
MNLLNYLYKNKKISIDSADLNLIKNYKFNSITSNPTLILKSFLNKTYNLLLNFFFYKNNKKILLDSDIQISLYDKILIFIVGNLIPFINDKISIEIPARISFNYNLIIIYSKKIIFLCNKYGININKVLIKIPGTDSGIKAAKKLKEIGIETNITLIFDINQVKKCLDFGVYIISPFIGRISDSIYCKYDSGVNFVKNIYTYKNNNNYKIKIMAASFRNINQIINLTFCDCLTISPIYFLELLKFNLKLLFKNKIKKTLKINFFNKYSSKLIIEGIKSFDKDHKKLINIISTIINNL

SEQ ID NO: 1602 - protein, 411 aa, Trichodesmium erythraeum IMS101
MLEVNQAESIILSLVQPLDADKDVETIDLLNSSGRILANPVVSKLDFPHWDNSAMDGYALKFADVKDCSPENSISLEIVEEILAGSKPQKQIQPGQTARIFTGACMPIGADTIVIQEVTQREGNRVLILEAPEPQAFVRYRGSFYKAGTPVLNPRIYLGAAEIAVLAALQCTQINVYRRVKVGIFSTGNELVKPDQPLKYGQIVDSNEYALTIALEKMGVEVIKFGILPDEPEILQKTIAEAILNTDFLLSTGGVSVGDYDYIEEIITELGAEIHVHSVAVKPGKPLTVASFPNTKCLYFGLPGNPVSALVSFWRFVQPALKKLAGANEAEWGPEFVRARLLQDLNSKNKRETYLWGQLNLGNDGYEFKLAVGSHYSGNLINLAGATGLAVVPLNENFIPAGESVRVLKIN

SEQ ID NO: 1603 - protein, 272 aa, Triticum aestivum
  unsure (1)..(272): unsure at all Xaa locations
MAMAAAASPSKILIPPHRASAATAAASTSCDSLRLLCAPRGRRQRPRGLVARPAPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADIYLLXVAIGIEERCXLXFGFMKIDXEGXIIEFXEKTKGXQLEXH

SEQ ID NO: 1604 - protein, 351 aa, Pseudomonas aeruginosa PAO1
MSKFWSPFVKDLVPYVPGEQPKLSRLVKLNTNENPYGPSPQALAAMQAELNDDLRLYPDPNGERLKQAVAAHYGVQANQVFVGNGSDEVLAHIFHGLFQHDLPLLFPDVTYSFYPVYCGLYGIAHEKIALDERFRIRVEDYARPNGGIIFPNPNAPTGCLLPLDAIEAMLKASPDSVVVVDEAYVDFGGESAIALVDRYPNLLVTQTLSKSRSLAGLRVGLAVGHADLVEALERIKNSFNSYPLDRLAIAGAAAAFEDDAYFRRTCQAVIDSREALSASLQALGFEVLPSAANFVFARHPRHDAGQIASTLREQGVIVRHFKQARIDQFLRITIGSPEQNQALLDALHFLK

SEQ ID NO: 1605 - protein, 500 aa, Oryza sativa
MATARVSLILLVVVLAASACAEGLRLPRDAKFPAAQAERLIRSLNLLPKEAGPTGAGDVPSVAPGELLERRVTLPGLPQGVGDLGHHAGYYRLPNTHDARMFYFLFESRGKKEDPVVIWLTGGPGCSSELAVFYENGPFTISNNMSLAWNKFGWDTISNIIFVDQPTGTGFSYSSDDRDTRHDETGVSNDLYSFLQVFFKKHPEFAKNDFFITGESYAGHYIPAFASRVHQGNKANEGIHINLKGFAIGNGLTDPAIQYKAYTDYALDMNLIKKSDYDRINKFIPPCEFAIKLCGTNGKASCMAAYMVCNSIFSSIMKLVGTKNYYDVRKECEGKLCYDFSNLEKFFGDKAVKEAIGVGDLEFVSCSTTVYQAMLTDWMRNLEVGIPALLEDGINVLIYAGEYDLICNWLGNSRWVHSMEWSGQKDFVSSHESPFVVDGAEAGVLKSHGPLSFLKVHNAGHMVPMDQPKASLEMLRRFTQGKLKEEWLAELPEQPMYAAM

SEQ ID NO: 1606 - protein, 371 aa, Oryza sativa (indica cultivar-group)
MNPQEFQFFQGVEQEMLLLSHGGGGAAAAASDDVLAYHVGVLRDKVQQLEPLVGMVVVSPAAPHGQLRRDAAAMAASSACSVLQEITAAASAVAHRLEQASAASSASFRRGVAFADDAHAAGGEQMFAAGAHGGGQGGDDEAGASLFHHHGPPAVGAPTVFRAGATTTAAASSSGGGDDDGDGDGEVDVVELEASYLLARYTHYCQVCGKGFKRDANLRMHMRAHGDEYKTAAALTSTGAGMRAAARRCSYSCPAEGCRWNRRHPRFQALKSVVCAKNHYRRSHCPKMYVCGRCGGKQFAVLSDLRTHEKHCGELRWLCSCGTFFSRKDKLMGHVALFAAGHAPVPVAPEASPSTTTTGTTTDRSHRNTCG

SEQ ID NO: 1607 - protein, 268 aa, Emericella nidulans
MDSLTTHPATAQQARAFTSPSSLSFPGGTAFPGGADLTPPSDKDANMATNGQSANGNVNGQQQGANAANGNGVMPATPAATPGASAPGSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMMKPKIVLLIFVSGKIVLTGAKVREEIYQAFELIYPVLSDFRKV

SEQ ID NO: 1608 - protein, 407 aa, Oryza sativa (japonica cultivar-group)
MATDSSSSAAADKNTVFRKLRAKSDNKMCFDCNAKNPTWASVTYGVFLCIDCSAVHRSLGVHVSFVRSTNLDSWTPEQLKMMVYGGNNRAQAFFKQHGWTDGGKIEAKYTSRAADLYRQLLAKDVAKNSTEDGNNSWPSSPVAASQPTNQADAIPDLKLAEASKEVANEKTEPEVIRSPRAPTHSFKKPIVAKKPGNKTGGLGARKLTSKPNESLYEQKPEELAPALPPVTENSTAKSKSHTSRFEYVENTPSAGSNSEENQVIGHVAPPKSSNFFGEFGMDSGYHKKSAPGPSKVQIEESSEARQKFSNAKSISSSQFFGDQASFEKEAQVSLQKFSGSSAISSADLFGHPTNSSNVDLSASDLINRLSFQASQDLSSIKNMAGETGKKLTSLASNIMSDLQDRIL

SEQ ID NO: 1609 - protein, 180 aa, Oryza sativa
  unsure (1)..(180): unsure at all Xaa locations
ISVLAGGDDPELFCARFSDSPRNPTVEVDVRCSHGTFARAAVPSGASTGVYEALELRDGGSDYLGKGVSKAADNVNPVIAPALIGKDXLRHSAELDHSMVQQLDGTQNEWGWCKQKLGANAILAVSLAICKAGAIIKKIPLYQHIANLAGNKQLVLPVPAFNVINGGSHAGNMLAMQAVI

SEQ ID NO: 1610 - protein, 336 aa, Euglena gracilis
MAQTIPDQTALPDTTNWQLSDLTLKETLGTGTFGRVRLCLHKSSGNYYAIKCLKKSEVLRMKQVEHILAEASILGSIRHPFIVNMLKTFQDDKRLYIVLEYVVGGELFSHLRKAGKFPNDVAKFYAAEVILAFEYIHSMDILYRDLKPENLLLDVGGHIKITDFGFAKKVPERTFTLCGTPEYLAPEIIQSKGHGKAVDWWALGILTYEMLVGYPPFFDESPFRIYEKILEGKVQFPKWVDGRAKDLIKGLLTTDHTKRLGTLKRGVTDIKKHKWFYGVDWDMLLARKIPAPIPVKVTTPGDSRYFDRYPESKEDKSQPLTPAQQELFKGFGPYST

SEQ ID NO: 1611 - protein, 497 aa, Micrococcus luteus
VPHATGSTRENGAPAVSDRESLTVGSEGPIVLHDVHLLETHQHFDRMNIPERRPHAKGSGAFGVFEVTEDVSSYTKALVFEPGVETEVLLRFSTVAGENGSPDTWRDTRGFALRFYTSEGNYDLVGNNTPIFFLRDPMKFTHFIRSQKRLPNSGLRDATMEWDFWTNNPESAHQVTYLMGPRGLPRTWREMDGYGSHTYLWVNAEGAKHWVKYHFISQEGVHNLSNDEATQIAGENADFHRQDLFEVIAKGVFPKWNLYIQAIPYSQGKTYRFNPFDLTKTISQANYPRIKVGVNTLNRNPKNFFAEIESAAFSPSNTVPGIGLSPDRMLLGRAFAYHDAQLYRVGAHVNQLPVNSPDDATHNYAFEGEMWEDHTGNRSTYVPNSDGNSWSNEVGPTNNGWEAVGVLTREAEALRANDNNFGEAGTLTREVFSNEERNNFVQTVAGALKGVRSNVEAEAFVYWKLVNATNGERIQNTVKRKSGNGIPGVEAGGEARM

SEQ ID NO: 1612 - protein, 673 aa, Arabidopsis thaliana
MAPNSVAVTMEKPDNFSLLEINGSDPSSFPDKRKSISPKQFSWFLLLKAHRLISCLSWLVSSVKKRIAFSAKNINEEEDPKSRGKQMYRFIKACLVISIIALSIEIVAHFKKWNLDLINRPSWEVYGLVEWSYMAWLSFRSDYIAPLVISLSRFCTVLFLIQSLDRLVLCLGCFWIKFKKIEPKLTEESIDLEDPSSFPMVLIQIPMCNEREVYEQSIGAASQLDWPKDRILIQVLDDSDDPNLQLLIKEEVSVWAEKGVNIIYRHRLIRTGYKAGNLKSAMTCDYVKDYEFVTIFDADFTPNPDFLKKTVPHFKGNPELGLVQARWSFVNKDENLLTRLQNINLCFHFEVEQQVNGVFLNFFGFNGTAGVWRIKALEESGGWLERTTVEDMDIAVRAHLNGWKFIYLNDVEVTCELPESYEAYKKQQHRWHSGPMQLFRLCLPSIIKSKISVWKKANLIFLFFLLRKLILPFYSFTLFCIILPLTMFIPEAELPLWIICYVPIFISLLNILPSPKSFPFLVPYLLFENTMSITKFNAMISGLFQFGSAYEWVVTKKTGRSSESDLLAFAEKEEKLHRRNSESGLELLSKLKEQETNLVGQETVKKSLGGLMRPKNKKKTNMVFKKELGLAFLLLTAAARSFLSAHGLHFYFLLFQGLSFLVVGLDLIGEQIS

SEQ ID NO: 1613 - protein, 433 aa, Triticum aestivum
  unsure (1)..(433): unsure at all Xaa locations
MAPEVKVPLLEGRGATPAQTLGNIVVSIVGTGVLGLPYAFRTAGWLAGALGVAGAGAATFYCMLLLLDCRDKLREQETEEDGLGDEQSRHGDGGNYTYGDLGERGFGPVGRHFTEAIIVLGQTGGTVAYLVFIGQNISSVLPALSPATVVLALLXPAEVALSFVRSLSALAPFSILADACTVLAVAAVVKEDVQLLAKRGRPFAGRSAFAGLWGVPFACGVXVFCFEGFCLTLALEASMSNRGRFRPVLFQAIVGVTVVYIGFGVCGYLAYGDATRDIVTLNLPDNWSTAAVKVVLCVGLALTFAVMMYPIHEIVEARLLAPGGWVRRRCGGVVQRAALHLSRVAVVAALAAIACFVPAFGDFVAFVGSTVCALLSFVLPALFHLRFVGPTASPWARAVDYFLLLAGLVFAGHGMYTVLAPIYNLKMVITFPP

SEQ ID NO: 1614 - protein, 282 aa, Lycopersicon esculentum
MTGGKEIIDKIKEKVGLSSSDTGRGKSKMSKNITHGYHMVEGKSHHTMEDYVFAQFKQVDENELGLFAIFDGHLSHEIPEYLRSHLFNNILNEPNFWAEPESAIRKAYRITDTTILDKAADLGKGGSTAVTAILINGQKLVVANVGDSRAVIYKNGVAKQLSIDHEPGREREIIEGKGGFVSNFPGDVPRVDGQLAVARAFGDKSLKMHLSSEPDVVVELIDDDTEFLILASDGVWKVLSNQEAADCIKDIKDARSAAKHLNEHALARGSTDDISCVVVRFQ

SEQ ID NO: 1615 - protein, 159 aa, Escherichia coli
GTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 1616 - protein, 488 aa, Heterosigma akashiwo
MSNNVYERNRIKNDRYESGVIPYAKMGYWDANYSVKDTDLLALFRLTPQPGVDPVEAAAAVAGESSTATWTVVWTDLLTACDVYRAKAYRVDPVPSAADQYFAYIAYECDLFEEGSLANMTASIIGNVFGFKAVAALRLEDMRIPYAYLKTFQGPATGIIVERERLDTFGRPLLGATVKPKLGLSGKNYGRVVYEGLRGGLDFLKDDENINSQPFMRWRERFLYCMEGINRASAASGEVKGSYLNVTAATMEEMYERADYAKAVGSVIVMIDLVIGYTAIQSMAIWARKNDMILHLHRAGNSTYARQKNHGINFRVICKWMRMAGVDHIHAGTVVGKLEGDPLMVKGFYDVLRETELSINLPQGIFFEMDWASLRKCCPVASGGIHCGQMHQLVYYLGDDVVLQFGGGTIGHPDGIQAGATANRVALEAMILARNEGRDYVSEGPEILRDIAKLCGPLKTALDLWKGITFNYTSTDTADFVETATSNP

SEQ ID NO: 1617 - protein, 293 aa, Tropheryma whipplei TW08/27
MLPKRAYPVQDSNVHSQEKKIIAGNWKMNINHSQAVSYLQELNWRLIDNGHDFDACEIAVFPPFTDLRSVQTLVASDDIQISYGAQDVSAFSDGAHTGQISAQFLKDLDCKYVLIGHSEQRCLPCYPGNNSAINELNNKHDGLIANKLLRSFAAGICPILCIGDISPGDHFDATLSRFRSVLSHLKAISDKKHSIGYALGSKTHFLDSDQLHMLVAYEPSSAINSGNCANSGDIVRMAAAIKDIVNVRVLYGGGVNLFNASAVFNEDLLDGILVGRASLNASDFASLIKTCCL

SEQ ID NO: 1618 - protein, 392 aa, Escherichia coli
KITLQNGKLNVPENPIIPYIEGDGIGVNVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 1619 - protein, 438 aa, Glycine max
FGSRMGADDFEPLTMIGKGAFGEVRVCREKATGHVYAMKKLKKSEMLRRGQVEHVKAERNLLAEVDSNCIVKLYYSFQDEEYLYLIMEYLPGGDMMTLLMRKDILTENEARFYVGETVLAIESIHKHNYIHRDIKPDNLLLDRNGHMKLSDFGLCKPLDCSNLQEKDFSIGSNRSGALQSDGRPVAPKRSQQEQLQHWQKNRRMLAYSTVGTPDYIAPEVLLKKGYGMECDWWSLGAIMYEMLVGYPPFYSDEPMLTCRKIVNWRNYLKFPEEVKISAEAKDLISRLLCNVDQRLGTKGADEIKAHPWFKGIEWDKLYQIKAAFIPEVNDELDTQNFEKFEEADNQTQPSSKSGPWRKMLSSKDVNFVGYTYKNYEIVNDDQLPEIAELKKKSTKPKRPSIKTLFDDESATAANQPTQGSFLKLLPTQPEVPEKSESQ

SEQ ID NO: 1620 - protein, 798 aa, Aspergillus oryzae
MPGAASIVAVLAALLPTALGQANQSYVDYNIEANPDLFSECLETGGTSFPDCESGPLSKTLVCDTSAKPHDRAAALVSLLTFEELVNNTANTGHGAPRIGLPAYQVWNEALHGVAHADFSDAGDFSWSTSFPQPISTMAALNRTLIHQIATIISTQGRAFMNAGRYGLDVYSPNINTFRHPVWGRGQETPGEDAYCLASTYAYEYITGIQGGVDANPLKLIATAKHYAGYDIENWDNHSRLGNDMQITQQDLAEYYTPQFLVASRDAKVHSVMCSYNAVNGVPSCSNSFFLQTLLRDTFDFVEDGYVSGDCGAVYNVFNPHGYATNESSAAADSIRAGTDIDCGVSYPRHFQESFHDQEVSRQDLERGVIRLYASLIRAGYFDGKTSPYRNITWSDVVSTNAQNLSYEAAAQSIVLLKNDGILPLTSTSSSTKTIALIGPWANATTQMLGNYYGPAPYLISPLQAFQDSEYKITYTIGTNTTTDPDSTSQSTALTTAKEADLIIFAGGIDNTLETEAQDRSNITWPSNQLSLITKLADLGKPLIVLQMGGGQVDSSALKNNKNVNALIWGGYPGQSGGQALADIITGKRAPAARLVTTQYPAEYAEVFPAIDMNLRPNGSNPGQTYMWYTGTPVYEFGHGLFYTNFTASASAGSGTKNRTSFNIDEVLGRPHPGYKLVEQMPLLNFTVDVKNTGDRVSDYTAMAFVNTTAGPAPHPNKWLVGFDRLSAVEPGSAKTMVIPVTVDSLARTDEEGNRVLYPGRYEVALNNEREVVLGFTLTGEKAVLFKWPKEEQLIAPQ

SEQ ID NO: 1621 - protein, 305 aa, Bacillus subtilis subsp. subtilis str. 168
MKQLPKTRTALLLAFLVIMWGVNWPLSKAALAYSPPLLFAGIRTLIGGLLLVIVALPRIHKLRLKETWPIYLVSALLNITLFYGLQTIGLNYLPAGLFSAIVFFQPVLMGVFSWLWLGESMFVMKVIGLILGFAGVAVISAAGFGGHISVIGVLLALGSAVSWALGTVYMKKTGSRVDSIWMVALQLTIGSVFLLISGFWTESFSAIQWTAPFITSLLFISVFVIALGWLVFFTLVGSGEASKVASYTFLIPLISIVASSIFLHEPLTLSLLAGLLLIVTSICLVNTKSKAQKAAAIGINEKAAQ

SEQ ID NO: 1622 - protein, 148 aa, Triticum aestivum
  unsure (1)..(148): unsure at all Xaa locations
MSAAALRARLNXMSLQMFATDTVDEYFQYLQSVDEDGSSAPGLVAEVINLFIGDANSILNGIASLLNQTMVDFNKVDDLVHQLKGCSCSVGAKKVNLSCMHFHQFIEARSKEGCLMALALLTNEFCDVRDKFQTMMQLEQQIAACGPK

SEQ ID NO: 1623 - protein, 335 aa, Xanthomonas campestris pv. campestris str. ATCC 33913
MTQTITVIRGDGIGPEIMDATLFVLDALQAGLTYEYADAGLVALEKHGDLLPESTLASITKNKVALKSPLTTPVGEGFSSINVAMRRKFDLYANVRPAKSFPNTKSRFADGVDLITVRENTEGAYLSEGQEVSADGEVAVSGARVTRKGSERIVRYAFDLARATGRKKVTAVHKANIIKSTSGLFLKVARDVATQYPEIEFQEMIVDNTCMQLVMRPEQFDIIVTTNLFGDIISDLCAGLVGGLGLAPGANIGVDAAIFEAVHGSAPDIAGQGKANPCALLLGAAQMLDHIGQPQNAERLREAIVATLEAKDSLTPDLGGTGNTMGFAKAIASRL

SEQ ID NO: 1624 - protein, 178 aa, Aquifex aeolicus VF5
MSEKKAVIGVVTISDRASKGIYEDISGKAIIDYLKDVIITPFEVEYRVIPDERDLIEKTLIELADEKGCSLILTTGGTGPAPRDVTPEATEAVCEKMLPGFGELMRQVSLKQVPTAILSRQTAGIRGSCLIVNLPGKPQSIKVCLDAVMPAIPYCIDLIGGAYIDTDPNKVKAFRPKK

SEQ ID NO: 1625 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYHLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 1626 - protein, 467 aa, Novosphingobium aromaticivorans
MADYKLLIGGNLVDGDMTMDVINPATGEPFCTVPRASAAQADAAIAAAKAAVPGWSAVPWAGRQAKLIELADAIAARKDEIARVLTMEQGKPLAEALGELAWTDGYLRHYATLELPDRVIQDDESGYIAVRHRPLGVVVGIIAWNFPLLVACWKIGPAVLAGNAIVLKPAPTTPVCALILGEICRDVFPAGVVNIITDANDLGPHLTAHPDVAKVGFTGSTATGKRIAASGADTLKRVTLELGGNDPAIVLEDVDVRETAQAIFGNAFLNNGQVCLAVKRAYVHSDIYDAMCGELARLAQAAVVDDGLQQGTQIGPIQNAMQFEKVKGFLDAAREEGTIVAGGEVMERAGYFIRPTIVRDVTDGDRIVDEEQFGPILPLIRFDDVEDVIARANASDYGLGGSVWSKDVARAADIASRIESGQVWVNQHIAIGPHIPMAGFKSSGLGVEQSVEGLAEYTQTQVVNIKR

SEQ ID NO: 1627 - protein, 302 aa, Panicum miliaceum
MADAKQQQAVAPSAAWMMVKPFVNGGASGMLATCVIQPIDMVKVKIQLGEGSAATVTKKMLANEGIGSFYKGLSAGLLRQATYTTARLGSFRVLTNKAVEANEGKPLPLLQKAVIGLTAGAIGASVGSPADLALIRMQADSTLPAAQRRNYKNAFHALYRIVADEGVLALWKGAGPTVVRAMSLNMGMLASYDQSVELFRDKLGAGELSTMLGASAVSGFCASACSLPFDYVKTQIQKMQPDANGKYPYTGSLDCVMKTLKSGGPFKFYTGFPVYCVRIGPHVMLTWIFLNQIQKFEKDMGL

SEQ ID NO: 1628 - protein, 421 aa, Zea mays
MALLGEYSSQELLQGQLQLWHQSLGFFKSLALAVAMDLRIADAIHRLGGAATLPQILAEAGIKIDPRNNKLRDLRRVMRALTVSGIFTVVQRPASSSDGGGRRGAEAEGPVYKLTAASRLLVVGEKESSTTATTRQLPPPPPSLTVYVQLLLETCRGSAFSRAVREWFQFQQPPQDDEQHQQPAGRLSSPFALACGGQTIWERAERDAHAFPFDDAMASDTAFLMPIVLRECGDEVFGRGLTSLVDVAGGLGGAAATIAAAFPDLSCTVLDLPHVVAKAAAGTADSNVVQYVAGDMFQCIPPADAVLLKWILHDWSDDECVRILKNCKQAIPPRAAGGKVIIIDMVVAGSGSGSGSADDEPSESDLRHVETQILFDLLMMCVNGVERDEQEWKKIFSEAGFQDYRIMPLLGVRSIIELYPN

SEQ ID NO: 1629 - protein, 993 aa, Streptomyces lividans
MRWLGRPLTVAVAVAAVLSAVPAPPAASPAADPAAAAAEPGNTATVFYYTKTKNWDRYNLHYAPDGGSWTEVPGVAMEAACTDWVKRTVPLGSAEGLRATFNNGSGTWDNNGGENYALGTGALTVKDGVVAHSDPCAGGQDPGPTPGDGNRATVYYSTRTLGWTTANIHYRPAGGSWTAVPGVGMRAACAGWWKKDVDLGAATSLTAAFNNGNGVWDNNKGADYTLPAGVTTVADNTVTADADDPCAEEVPDTAAPTVPAGVSARADGVSVVLTWEPSTDDTGVAKYQVTRSGGTGGEVVSDVGSTVFSDTGLEERTTYTYTVRATDAAGNVSAASAAAIATTGRRPPAPAAGRPLATDPRKDPIYFVLTARFNDGDATNNRGGSQHEKSGNAANDDPMFRGDFKGLVNKLDYIKGLGFSAVWITPVVLNRSDYDYHGYHGYDFYKVDPRLESAGASYQDLIDAAHAKGMKIYQDVVYNHSSRWGARGLFTPTVYGVRDSQWSWYYDEKQPGFEYDGLTVEPKSGKSYYNGDLWSTAEPTGNTCVNWGRPTGAKSPEGYTLYDCQWPSPTSGMFPKALYHNCWIGNWEGEDSRSCWLHEDLADFNTENPQVQNYLIGAYDKYIDMGVDGFRVDTAVHIPRTTWNRRFLPAIQERVAQQHGAEAAKNFFVFGEVAAFVNDKWNRGSVTHSAQFYTWKERKEYSADDAKAALEMYEYEQQQGTGNQPTSANAFLEGNSYHVPDHSRFSGMNVIDMRMHMNFGDASNAFHNGKDSDDSYNDATYNVVYVDSHDYGPNKSSERFSGGTDAWAENMSLMWTFRGIPTLYYGSEIEFQKGRKIDCGPTCPLATTGRAYYGDHLAGDVTASDFSRVDSATGAVATTLAQPLVKHVQRLNQIRRAVPALQMGQYSTDGVTGDMAFKRRYTDGGTDSFALVTVSGGAAYDGIPNGTYRDAVTGDTRTVTDGRLTVAAPGKGNLRVYVLNGPGKIGADGPYLK

SEQ ID NO: 1630 - protein, 506 aa, Crocus sativus
MVSTGCSGNGAKGTNGGIVVPEIKFTKLFINGEFVDSVSGSTFETRDPRNGDVIANIAEGDKEDVDLAVKAAREAFDHGKWPRMSGYERGRIMMKFADLIEAFIEELAALDTLDAGKLLSMGKAVDIPAAVHIIRYYAGAADKIHGYTLKLSSELQGYTLKEPIGVVGVIIPWNFPTTMFFLKVSPALAAGCTMVVKPAEQTPLSALYYAHLAKLAGVPDGVINVVPGFGPTAGAALSSHMDVDSVAFTGSAEIGRAIMESAAKSNLKNVSPELGGKSPMIVFDDADVDMAVSLNSLAVFFNKGEVCVAGSRVYVQEGIYDEFVKRAVEAARSWKVGDPFDQSRNMGPQVDKDQFESVLKYIEHGKSEGATLLTGGKPAADKGYYIEPTIFVDVTEDMKIAQEEIFGPVMSLMKFKTVEEGIDCANNTKYGLAAGILSQDLDLINTVSRSIKAGIIWVNCYFGFDLDCPYGGYKMSGNCRESGMDALDNYLQTKSVVMPLHNSPWL

SEQ ID NO: 1631 - protein, 477 aa, Tetrasporopsis fuscescens
KSDRYESGVIPYAKMGYWDANYNIKDTDLLTLFRITPQPGVDPIEAAAAVAGESSTATWTVVWTDLLTACDIYRAKAYRVDPVPGTTDQFFAYVAYECDLFEEGSLANMTASIIGNVFGFKAVKALRLEDMRIPIAYLKTFQGPATGLIVERERMDKFGRPLLGATVKPKLGLSGKNYGRVVYEGLRGGLDFLKDDENINSQPFMRWRERFLYCMEGINRAVAASGEVKGSYLNCTAGTMEEMYERAEYAKAIGSIIVMIDLVIGYTAIQSMAIWARKADMILHLHRAGNSTYARQKNHGINFRVICKWMRMAGVDHIHAGTVVGKLEGDPLMVKGFYQTLLLTKLDINLPQGLFFDMDWAALRKCVPVASGGIHCGQMHQLIKYLGDDCVLQFGGGTIGHPDGIQAGATANRVALECMVLARNEGRDYFNEGPEILRDAAKLCGPLKTALDLWKDISFDYTSTDTADFVEVATESK

SEQ ID NO: 1632 - protein, 306 aa, Eremothecium gossypii
MTAVNYTKEKKVGEGTYAVVYLGHRQTDGRQIAIKEIKTSQFKDGLDMSAIREVKYLQEIRHANVIELVDLFMAQENLNLVLEFLPADLEMLIKDSSLLFTQADIKSWLLMTLRGVHHCHRSFILHRDLKPNNLLLAPDGQLKIADFGLARTLAAPHEFMTSNVVTRWYRAPELLFGARHYTAAVDLWSVGVIFAELMLRIPYLPGRDDVDQIDVTFRALGTPTDKDWPEVSSFSAYNKIQVYPPPSRSELRSRFIAATENALDLMCGMLTMDPHKRWDTTRCLLSQYFVELPEATPPTELPKLNK

SEQ ID NO: 1633 - protein, 449 aa, Lactobacillus gasseri
MDEKEKLKLKRSLKSRHVTMIAIGGAIGTGLFLGSGTAIQSAGPSIILSYLIVGIISFFMMRALGELILAEPDQHSFIESVKKYLGNRMEFVAGWTYWLCWLSLAMADLTATGIYLKYWFKDLPQWVGPLVIVVLLMLVNMVNVGLFGELESWFSMIKVLAILALIVTGLILLVMHSKIDSRTVSLSNLINYGGFFPTGSWGFLKSFQMVVFAFVGIEIVGLTAGETANPDKDIPKAINTLPVRIGLFYVGSMIAIMAVYPWNKIVTTTSPFVQVFGAIGIPAAAGILNFVVLTAAMSATNSAIFSTSRSLYALSRGNNAPKRFGKLSRKAVPNNALTFSSLILFIVVILNYIMPAQVFDIISSVSTINFIMVWIIIMWTHLKYRAENKGKLGSFRMPGFPITSWVTIIFYLVILIILALIPATRLPLLISIIFILALALSYTLLERKN

SEQ ID NO: 1634 - protein, 542 aa, Catharanthus roseus
MAKEQLQVLNALDVAKTQWYHFTAIVIAGMGFFTDAYDLFCISLVTKLLGRIYYHVDGAVKPGTLPPNVSAAVNGVAFCGTLAGQLFFGWLGDKMGRKRVYGMTLMLMVIASIASGLSFGDKPKAVMATLCFFRFWLGFGIGGDYPLSATIMSEYANKKTRGAFIAAVFAMQGFGILAGGMVAIIVSASFKAGFPAPAYQDGAVASTVPEADYVWRIILMFGAIPAALTYYWRMKMPETARYTALVAKNAKQAANDMSKVLQVELEAEQEKVEKFAQEPANTFGLFTKEFLKRHGLHLLGTATTWFLLDIAFYSQNLFQKDIFSAIGWIPPAQTMNAIEEVFRIARAQTLIALCSTVPGYWFTVFLIDRIGRFIIQWMGFFFMTVFMFALAIPYNHWTHKDNRIGFVIMYSLTFFFANFGPNATTFVVPAEIFPARLRSTCHGISAAAGKAGAIIGAFGFLYAAQPSDPSKTDKGYPPGIGVKNALIVLGCVNFLGMVFTFLVPEAKGKSLEEVSKENEEEVENGTELRQQSGHDTRTVPVL

SEQ ID NO: 1635 - protein, 480 aa, Heterodoxia denticulata
  unsure (1)..(480): unsure at all Xaa locations
QAIKNDRYESGVIPYAKMGYWDPEYVIKETDVLALFRVSPQPGVDPVEASAAVAGESSTATWTVVWTDLLTACDLYRAKAYKVDAVPNTTDQYFAYVSYDIDLFEEGSIANLTXXXXXXXXXXXXXXXXXXXXXXXPVAYLKTFQGPATGIVVERERMDKFGRPFLGATVKPKLGLSGKNYGRVVYEGLKGGLDFLKDDENINSQPFMRWKERFLYSMEAVNRSIAGTGEVKGHYMNVTAATMEEMYERAEFAKQLGTVIIMIDLVIGYTAIQTMGIWARRNDLILHLHRAGNSTYSRQKIHGMNFRVICKWMRMAGVDHIHAGTVVGKLEGDPLMIKGFYDTLLLPNLEVNLPLGIFFKQDWASLRKVTPVASGGIHCGQMHQLLDYLGEDVVLQFGGGTIGHPDGIQAGATANRVALESMVIARNEGRPFVEEGPQILRDAAKTCGPLQTALDLWKDITFNYTSTDTADFVETPTANV

SEQ ID NO: 1636 - protein, 99 aa, Zea mays
  unsure (1)..(99): unsure at all Xaa locations
MLRCWVIMDGVTADEARLSEEVGAGAAMALEWVRAGVRAHGSVGRMLDPALIRSIKGAVSMPVMGKARIGRCSEVXILEGGDVEFMDKSVEVTPVEDAQ

SEQ ID NO: 1637 - protein, 463 aa, Magnetospirillum magnetotacticum
MLKAIKDNDVKYVDFRFTDPRGKWQHVTFDVSLVDEEIFQDGTMFDGSSIAGWKAINESDMLLMPDPSTACMDPFFSASTMSIVCDVLEPSTGEPYARDPRSTAKLAEAYLRSTGIGDEIFVGPEAEFFVFDDVKFGADPYHTGFQLDSTELPTNGFTDYEGGNLGHRIQTKGGYFPVPPQDSAQDMRGEMLAAMQSMGVKVEKHHHEVASAQHELGMKFDKLTTLADHMQIYKYCIHNVAQSYGKSATFMPKPVYGDNGSGMHVHQSIWKDGKPLFAGDKYADLSQECLWYIGGIIKHAKALNAFTNPSTNSYKRLVPGYEAPVLLAYSARNRSASCRIPWTTNPKAKRVEVRFPDPMANPYLAFSALLMAGLDGIINKIDPGPAMDKDLYDLPPRELKKIPTVCGSLREALQNLDKDRAFLKAGGVFSDDQIDSFIELKMTEVLRYEMTPHPIEFVNYYSL

SEQ ID NO: 1638 - protein, 224 aa, Gossypium hirsutum
MAFVSEEEKTEDYLFKIVLDGDSAVGKSNLLARFARNEFYPDSKSTIGVELQTQKLDINGKEVKAQIWDTAGQERFRAVTSAYYRGAVGALLVYDISRRQTFDSIGRWLNELQTHSDMNVVTILVGNKSDLRDAREVSTAEGKALAEAQGLFFMETSALDSSNVAAAFQTVVKEIYNILSRKVMMSHELKKQDAPLDGKTVVLQGDENQERATESPKSGGCCSS

SEQ ID NO: 1639 - protein, 327 aa, Erwinia chrysanthemi
MTTKNIAIIGECMIELSRKARISIRGFGGDTLNTAVYISRQVKPDALDVHYVTALGTDSFSSEMMASWQKEGVKTDLIQRLDNKLPGLYFIETDATGERTFYYWRNDAAARYWLESPDADTISQQLAQFDYIYLSGISLAILNQASRARLLTVLRACRANGGKVIFDNNYRPRLWQSKEETRQAYSDMLACTDIAFLTLDDEDMLWGELPVDEVLKRTHGAGVMEVVIKRGADACLVSIQGEALLEVPAIKLPKEKVVDTTAAGDSFSAGYLSVRLNGGSAQDAAKRGHLTASTVIQYRGAIIRWKRCLPEQRYSAEETKNAASVPY

SEQ ID NO: 1640 - protein, 526 aa, Triticum aestivum
  unsure (1)..(526): unsure at all Xaa locations
MSSMQFSSVLPLEGKACVSPVRREGSGSERLKVGDSSSIRHDRVXRRMCNGGTGPSXTGARCLLTSDASPADTLVRRTSFRRNYGDPNELAAVILGGGTGTQLFPLTSTRAAPAVPIGGWYRLIDMPMSXCFNSGINKIFVMTKGPSLAFNWASLKRHIHRTXLGXGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRXNVVISNKEGKTPPGEGYYIRSGIVVIQKNATIKDGTVV

SEQ ID NO: 1641 - protein, 336 aa, Oryza sativa
  unsure (1)..(336): unsure at all Xaa locations
MEGSTSQDHVIGIPVSNTAYGIEEPDFAAEETTTPDHAGFVVGSFQFNNDANSPTTTTTTTDRASKYGRKGDKIAQGIKEHVTLGPKLSETXKGKLTLGARILQAGGVXEKVFRQWXFSVDKNEKLLRASQCYLSTTAGPIAGMLFVSTERVAFRSDRPLAVSAPGGDKVRVPYKVTIPLRKVKAAKPSENKHKPEQKYIEVVTNDGFEFWFMGFVSYHRSLHHLEQAVRAGAAMTRTKAASARRTHVVAELALDRIGLFVSYACVCACVHLCHSSLVMLRWVRICVCVGLIDHNMSLCVGSPWLACWWIDRSACSFAIASSRLDIGGLIRACDGM

SEQ ID NO: 1642 - protein, 131 aa, Zea mays
  unsure (1)..(131): unsure at all Xaa locations
IHYSDDXLLQTRIFSYADTQRHRLGPNYLMLPVNAPXCAHHNXHHDGFMNFMHRNEKVNYFPFEXDPXRHAEEGPIXPPVVLQGCPEKCITSKRXTFQKAGEKKLVSSKPVREXRFIPEWVEPLKETSAGP

SEQ ID NO: 1643 - protein, 589 aa, Phytophthora infestans
MSSSSRKFFVGGNWKCNGSLGQAQELVGMLNTAKIPVNVEVVVAPSQVHAATVKASLRSYVRVSGQDVWKQGNGAFTGETSAEMLKDLGAEYTLVGHSERREKGETNEVVAKKAAYALEKGLGVIACIGETKDHREANQTVAYITEQLDAYAAEINDWTNVVIAYEPIWAIGTGLTASPEQAQEAHASIRAWLKEKVSPEAAEQTRVIYGGSVGAKNAPELSQKEDIDGFLVGGASLKPDFLQIINAQNPTANVGGAVNVAINGFGRIGRLVLRASAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYDNEWGYSSRVLDLIEHMVKNE

SEQ ID NO: 1644 - protein, 317 aa, Listeria monocytogenes
MYKNYLQRTLVLVLCFILCFFTFPLGGKAYSLNNWNKPIKNSVTTKQWMSALPDTTSLAALSIPGTHDTMSYNGDMTWTLTKPLAQTQTMSLYQQLEAGIRYIDIRAKDNLKIYHGPIFLNASLSGVLETITQFLKKNPKETIIMRLKDEQNSNDSFDYRIQPLINIYKDYFYTTPRTDTSNKIPTLKDVRGKILLLSENHTKKPLVINSNKFGMQFGASNQVIQDDYNGPSVKTKFKEIVQTAYQASKADNKLFLNHISATSLTFTPRQYAAALNNKVEQFVLNLTSEKVRGLGILIMDFPEKQTIKNIIKNNKFN

SEQ ID NO: 1645 - protein, 544 aa, Olea europaea
MQVSTHAVKGNLCLGLQNLRPLPSSRELRENNLGFAVSELRMTKRSSCFGIGLDSIAMGARGNWPKSVYGSLAKARSVRAQAYEGDVEDVAPAKIQVKSSGTVLPYVGVACLGAILFGYHLGVVNGALEYLAKDLGIAENAVLQGWVVSTLLAGATVGSFTGGSLADKFGRTKTFLLDAIPLAVGAFLCATAQNIETMIIGRLLAGIGIGISSAIVPLYISEISPTEIRGTLGSVNQLFICIGILAALVAGLPLAGNPLWWRTMFGVAIIPSILLALGMAFSPESPRWLYQQGKISEAEVSIRKLNGKERVAEVMSDLDAAAQGSSEPEAGWFDLFSSRYWKVVSVGAALFLFQQLAGINAVVYYSTSVFRSAGITSDVAASALVGAANVFGTTIASSLMDKQGRKSLLLTSFAGMAVSMLLLSLTFTWKTLAPYAGTLAVLGTVLYVLSFSLGAGPVPALLLPEIFASRIRAKAVALSLGMHWISNFVIGLYFLSVVTKFGISTVYLGFASVCLLAVMYIAGNVVETKGRSLEEIERALTAAP

SEQ ID NO: 1646 - protein, 373 aa, Candida maltosa
MSVKTKTITILPGDHVGTEIVNEAIKVLEAIEAATPYQKIHFDFKHHLIGGAAIDATGVPLPDDALESAKNSDAVLLGAVGGPKWGTGALRPEQGLLKIRKELNLYANIRPCNFASDSLLELSPLRPEVVKGTNLIIVRELVGGIYFGDREEQEESADKQTAWDTEKYTVDEVTRITRMAAFMALQHTPPLPIWSLDKANVLASSRLWRRTVDKVISEEFPTLSVQHQLIDSAAMILIQNPTKLNGIIITSNMFGDIISDEASVIPGSLGLLPSASLASLPDTNTAFGLYEPCHGSAPDLPANKVNPIATILSAASMLRLSLDCVKEAEALEEAVKQVLDKGIRTADLRGTSSTTEVGDAIVEAVTKILKEKA

SEQ ID NO: 1647 - protein, 311 aa, Shewanella oneidensis MR-1
MKVAVLGAAGGIGQALALLLKTQLPAGSKLSLYDIAPVTPGVAVDLSHIPTAVEIKGFAGEDPTPALVGADVVLISAGVARKPGMDRSDLFNINAGIVRNLIEKVAVTCPKALVGIITNPVNTTVAIAAEVMKKAGVYDKNRLFGVTTLDVIRSETFIAELKGLNVADVKINVIGGHSGVTILPLLSQVEGVTFSDEEVASLTKRIQNAGTEVVEAKAGGGSATLSMGQAACRFGMSLVRGLQGEANVVECAYVDGGSEHAEFFAQPVLLGKNGIEKVLPYGEVSAFEANARDSMLDTLKGDIKLGVDFVK

SEQ ID NO: 1648 - protein, 85 aa, Triticum aestivum
MHIKDMLAESQRTGQPSFSFEYFPPKTAQGVQNLYDRMDRMYNFGPKFIDITWGAGGRIAELTCEMVTQAQAIYGLEGGPGTNSN

SEQ ID NO: 1649 - protein, 504 aa, Glycine max
TRPRFLKVSLSFMLLFLISISPSFSSPTDHPTSNDLRFSSTAEKLIRGLNLFPKDPINTLKKNDPLFVSGSIVEKRFTFPTLAASSESSIEELGHHAGYYRLPRSKAARMFYFFFESRSSKNDPVVIWLTGGPGCSSELALFYENGPFQLTKNLSLVWNDYGWDKASNIIFVDQPTGTGFSYTSDESDIRHDEEGVSNDLYDFLQAFFKEHPQFTKNDFYITGESYAGHYIPALASRVHQGNKAKEGIHINLKGFAIGNGLTNPEIQYQAYTDYALDRGLIKKAEYNSINKLIPPCKQAIEACGTEGGETCVSSLYVCNKIFNRIMTIADDVNYYDIRKKCVGVLCYDFSVMEDFLNEKTVRDALGVGDLDFVSCSSTVYSAMMQDWMRNLEVGIPTLLEEGIKVLVYAGEEDLICNWLGNSRWVQAMEWSGQKQFGASGTVPFLVDGAEAGTLKSHGPLAFLKVYEAGHMVPMDQPKAALEMLRSWMQGKLTMTKSGDNVSPK

SEQ ID NO: 1650 - protein, 757 aa, Oryza sativa; identical to SEQ ID NO: 1506

SEQ ID NO: 1651 - protein, 459 aa, Porphyra yezoensis
DADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPFMIKGFYNTLLESDTDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 1652 - protein, 330 aa, Burkholderia fungorum
MREGHNQYPPMAGAAPLRQAISDKIANLYGRRYDATTEITVTAGATQALLTAILCSVHPGDEVVVVEPTYDSYLPSIELAGGKPVFVTLEAPDYAIPFDRLAAAITPKTRLLLINTPHNPTGTVWREQDMRKLEEIVRGTNVLILSDEVYEHMVYDGAPHESVARYPELAQRSFVVSSFGKTYHVTGWKVGYVAAPAALTVEFRKVHQFNVFTVNTPMQIGLADYMKDPAPYLDLPAFYQKKRDFFRAGLANSRFRLLPCTGTYFQCVDYSAISDLPEAEFAQWLTGEIGVAAIPVSAFYHEAHESGVVRFCFAKQESTLATALERLARL

SEQ ID NO: 1653 - protein, 395 aa, Zea mays
MAPNEAASITTPSEPESVGGSEMSSEDMAAASPLLSSSSPSPSPSAAPVLESIEELDRKYAPYARRDAYGPMGLGPVSAAEAARLAFAAVVLVPLRVVAGVLVLVVYYLVCRVCTLRVEEDREGGEGDGYARLDGWRRAGAVRCGRALARAMLFVFGFYWIREYDSRLPNAEDGHVDQSKEIERPGAIVSNHVSYVDILYHMSASFPSFVAKRSVARLPLVGLISKCLGCIFVQRESKTPDFKGVSGAVSERIHRAHQQKNAPMMLLFPEGTTTNGDYLLPFKTGAFLAKAPVQPVILRYPYKRFNAAWDSMSGARHVFLLLCQFVNYLEVVRLPVYYPSEQEKDDPKLYANNVRKLMAVEGNLILSDLGLAEKRVYHAALNGNSLARALHQKDD

SEQ ID NO: 1654 - protein, 101 aa, Oryza sativa
MSSPAGEDEKKPAGGEGGGAHINLKVKGQDGNEVFFRIKRSTQLKKLMNAYCDRQSVDIKSIAFLFDGRRLNAEQTPDQLEMEDGDEIDAMLHQTGGSLPA

SEQ ID NO: 1655 - protein, 63 aa, Pleurochrysis carterae
MRGILVDWLVEVHLKFKLMIETLYLTVNLIDRYLEKEKITRNKLQLVGVTAMFLASKYEEIYP

SEQ ID NO: 1656 - protein, 162 aa, Glycine max
  unsure (1)..(162): unsure at all Xaa locations
ASSMISSPAITTINHTNTNIITPFTNLKSITNFPTKKTNNNITSITSNNKRIQYIPIXPPINKKKFKTLSYLPDLDNTQLAEKIXYLLRKEXNSLLXFHLNHNFIYHNHNRSPKYYNERYXTIYKLPIFGYTNTSQVLKXLEQAKTTYPNNCIHIMIFNNTQ

SEQ ID NO: 1657 - protein, 323 aa, Arabidopsis thaliana
MPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 1658 - protein, 450 aa, Oryza sativa
MGQGTPGGMGKQGGLPGDRKPGDGGAGDKKDRKFEPPAAPSRVGRKQRKQKGPEAAARLPAVAPLSKCRLRLLKLERVKDYLLMEEEFVVSQERLRPSEDKTEEDRSKVDDLRGTPMSVGSLEEIIDESHAIVSSSVGPEYYVGILSFVDKDQLEPGCAILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMFKKKEGVPEGLYM

SEQ ID NO: 1659 - protein, 254 aa, Listeria monocytogenes EGD-e
MRKPLVGINMKNYINTRAQTSEWLEATIPLLGNFSDVDTFIFPSMGTLETTANLLAGTSFGFGPQNMAPEKSGPLTGEFSVESIIDLSANYVEIGHAERKNLFHEKTSEIAKKIQLALDEKITPVVCVGEGIRANDTNELKNALKKQIEALFDTIQVTQFKNVVLAYEPEWAIGKANSADTDYIESAHQALREIIRELGGDETLVRIIYGGSVSKENAAEIVRQKNVDGLFVGRFGHKPQNFADIVSIVSKTKG

SEQ ID NO: 1660 - protein, 311 aa, Rhodospirillum rubrum
NGFGRIGRLAFRRIQDVEGIEVVAVNDLTDDEMLAHLLKYDTMQGRFTGEVEVVDGGFRVNGKEVKSYEEPDASKLPWGDLDIDVVLECTGFYTDKEKAEAHINAGAKKVLISAPAKGDVKTIVFNTNHNDLDGSETVVSGASCTTNSLAPVAKVLSDEFGLVEGLMTTIHAYTGDQMTQDGPHRKGDKRRARAAAQNIVPNSTGAAKAIGKVIPEIDGKLDGGAQRVPVATGSLTEVTVVLEKDVTVEDVNKAMKNASNESFGYTEDEIVSSDVVGMTYGSLFDATQTRVMSVGDRQLVKVAAWYDNEWG

SEQ ID NO: 1661 - protein, 498 aa, Schizosaccharomyces pombe
MSTSSKLSTNIKDLSLFDLEEFPARSYIGGKWVTAASGKTFDVENPGLNETLAPVTDMSVEETRKAIKVAHEAFLSYRNSDIKERYAILRRWYDLIMENADDLATMMTLENGKALGDAKGEVVYAAKFIDWFAGEALRISGDSSMSSNPQNRIITIKQPVGVVGIITPWNFPAAMITRKVGAALAAGCTVVIRPAAETPFTALALAKLAERAGVPAGVLNMVTANSPSEHGIELTTNPLIRKVSFTGSTNVGKILAKQSSSTLKKLSLELGGNAPFIVFEDADLEKAADALMACKFRGSGQTCVCANRIYVHSSVYDAFVDLVTERVSKFKLGYGLDAGVTHGPLISEKAISKVKQHVEDAVQKGGVVVTGGKVASNLGPMYFEPTVIINAKQGMLISEEETFGPVGALFKFDTEDEVVAWANDSPVGLAGYLFSKDISRVFRVGEALQVGMVGCNTGLVSDVLSPFGGVKESGFGREGSKYGISEYLDIKSLTISTL

SEQ ID NO: 1662 - protein, 375 aa, Arabidopsis thaliana
MPLSLQSPPCATLSASIRKGRWKTLAAGFSVTPLPAVNFSLRRSIPRILASASSSSSPASSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAASQAGASVIQIFVGRLRDWARNHSGDTEIESAIKSGEDPGLALVKRSYNYIHKYGYKSKLMAAAVRNKQDLFSLLGVDYVIAPLKVLQSLKDSPAIPDDEKYSFVRKLTPETATYYHFTNKELVKWDQLSLASSMGPASV

SEQ ID NO: 1663 - protein, 357 aa, Zea mays
MERFGLDGGGGGGELPPGFRFHPTDEELITYYLLRKAVDGSFCGRAIAEIDLNKCEPWELPDKAKMGEKEWYFYSLRDRKYPTGLRTNRATVAGYWKATGKDREIRSGRTGALVGMKKTLVFYRGRAPKGQKTHWVMHEYRLEGAYAYHFLPSSTRDEWVIARVFQKPGEVPPAARKHRLGALSSTTGTAAGDSCFSDSTSASIGGASSSSTPGPLFASAAAAVANAGAADGDTSSYCGGAANHGNLVTGRELVPCFSTATINGPLVAAALGIGQPYNAAPLPFEQQPPPPAFLPSLRSLQDNLQLPPFLSAGGLGGGGALHWLPAGGMEVKVEGRSAPPQMAVGPGQLDGAFGWSF

SEQ ID NO: 1664 - protein, 269 aa, Zea mays
MPRGTERAMLVLGCFPVARRPSLSYEEGSTSAASMSAASTASPPTSTASTSSPAFLDDDDALYPDDAEPEPDAGRLSTAIASRRFFLATPGLSNSIVDSVEHPAACHACDSASNTRSLRRASTSASPASAAASSSSSSPSSSSSSSSSSASATKAHLHDNDGMQPPVRKVLVSTDAPRADFRKSMLEMVEALELDPRRRDADLARLHDLLLCYIALNERDALRDILGAFADLMCLLNVDGGNNNDATFAAVVVDGGEKRNADEQADADR

SEQ ID NO: 1665 - protein, 480 aa, Aspergillus niger
MPSLGGLLKKRRTKDSQTLSKELEAGSAQTQTSPNAAEDHHNHNHHQHHHHLFHHHHQPQPATNSGSAANTPPQPQDSVPQQSNRSSGAEKSSDGQVASMQSAVTQASPSAHHTSGLPQPNANAASIQNIINPSQQGAMHSASSGHTQSHHAGRSDARTTKGKYSLDDFSLQRTLGTGSFGRVHLVQSKHNHRFYAVKVLKKAQVVKMKQIEHTNDERRMLNRVRHPFLITLWGTWQDSRNLYMVMDFVEGGELFSLLRKSQRFPNPVAKFYAAEVTLALEYLHTQNIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSDDVKNHPWFAEVTWDRLARKDIDAPYVPPIRGGQGDASQYDRYPEETEQYGMAGEDPHGHLFPDF

SEQ ID NO: 1666 - protein, 143 aa, Oryza sativa
MGVHLLKRQQSSASAGGSSAGGGMPPKGCMAVRVVGPGGVGGGGGGAEGERFVVPVGYLKHPLFVGLLKEAEEEFGFEQKGAITIPCGVDHFRRVQGHHPPPEAPPRAAPMGAGGAGPPAASSPGHGSSGHHNNFHIAACFRA

SEQ ID NO: 1667 - protein, 231 aa, Triticum aestivum
MATTPRLASLLLLLALCAAAAGALRLPPDASFPGAQAERLIRALNLLPGASSGRGLGAGAEDVAPGQLLERRVTLPGLPEGVGDLGHHAGYYRLPNTHDARMFYFFFESRGKKEDPVVIWLTGGPGCSSELAVFYENGPFTIANNMSLVWNKFGWDKISNIIFVDQPTGTGFSYSSDDRDTRHDEAGVSNDLYDFLQVFFKKHPEFVKNDFFITGESYAGHYIPAFASRVH

SEQ ID NO: 1668 - protein, 303 aa, Mycobacterium tuberculosis CDC1551
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTELVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 1669 - protein, 115 aa, Prochlorococcus marinus subsp. marinus str. CCMP1375
MAGFGLPNFGQITEAFKKAQQIQQDAQKLQEELDDMELEGTNEDGRVTVWLSGNQQPIRVKVENSILKEEEEIVEAAILEAMQKAHEISTSNMKSRMQELTGGLNLNLPGINDDN

SEQ ID NO: 1670 - protein, 281 aa, Picea mariana
AAGSGYWKATGADKPITAKGGKKRVGVKKALVFYVGKAPNGSKTNWLMHEYRVTNVSRPVKKKNSLILDDWVLCRIYNRRISAEKLALQQKESFNDVPMETIDEKEMENQLTSTSIEHSGIEQSNPSFDHLSKLGSSPTCYNSAPLCVSPMNSNICLQNLDFFQNSTTPFSDSTLKAPVQNTTFNPISSSINHQWTNCNSTDLMSGLHNDSSCSKPSSFSEPISEKEEVQSSFRLENFSQEQQQSLFNFGLEGLQNTFTHLDQITLPGAYQDWFYPNEPFH

SEQ ID NO: 1671 - protein, 666 aa, Streptococcus pyogenes MGAS315
MSDSHLTAFDKASKAGFIIALGIVYGDIGTSPLYTMQSLVENQGGVNQVSESFILGSISLIIWTLTLITTIKYVLIALKADNHHEGGIFSLFTLVRKMSPWLIVPAMIGGATLLSDGALTPAVTVTSAIEGLKAVPGLSHIYQNQTNVIITTLVILIVLFGIQRFGTGFIGKIFGPVMFIWFSFLGVSGFFNMLGHLEIFKAINPYYALHLLFSPENHRGIFILGSIFLATTGAEALYSDLGHVGRGNIYVSWPFVKMCIVLSYCGQAAWILANKHSGIELNPFFASVPSQLRVYLVSLATLAAIIASQALISGSFTLVSEAMRLKIFPLFRVTYPGANLGQLYIPVINWILFAVTSCTVLAFRTSAHMEAAYGLAITITMLMTTILLKYYLIKKGTRPILAHLVMAFFALVEFIFFLASAIKFMHGGYAVVILALAIVFVMFIWHAGTRIVFKYVKSLNLNDYKEQIKQLRDDVCFDLYQTNVVYLSNRMQDHMIDRSILYSILDKRPKRAQVYWFVNVQVTDEPYTAKYKVDMMGTDYMVRVNLYLGFRMPQTVPRYLRTIVQDLMESGRLPKQEQEYTITPGRDVGDFRFVLIEERVSNARQLSNFERFIMQTKASIKHVTASPMRWFGLQYSEVTLEVVPLILSDILKLPIKELVPVEDSEA

SEQ ID NO: 1672 - protein, 522 aa, Glycine max
  unsure (1)..(522): unsure at all Xaa locations
MAGGGFTSGGGAGDFEAKITPIVIISCIMAATGGLMFGYDVGVSGGVTSMPPFLKKFFPTVYRKTVEEKGLDSNYCKYDNQGLQLFTSSLYLAGLTSTFFASYTTRRLGRRLTMLIAGVFFICGVVLNAAAQDLAMLIVGRILLGCGVGFANQAVPVFLSEIAPSRIRGXLNILFQLNVTIGILFANLVNYGTNKIKGGWGWRLSLGLAGIPAVLLTLGALFVVDTPNSLIERGRLEEGKTVLKKIRGTDNIELEFQELLEASRVAKEVKHPFRNLLKRRNRPQLVISVALQIFQQFTGINAIMFYAPVLFNTLGFKNDASLYSAVITGAVNVLSTVVSIYSVDKVGRRILLLEAGVQMFLSQVVIAIILGIKVTDHSDDLSKGIAILVVVMVCTFVSSFAWSWGPLGWLIPSETFPLETRSAGQSVTVCVNLLFTFVIAQAFLSMLCHFKFGIFLFFSGWVLVMSVFVLFLLPETKNVPIEEMTERVWKQHWFWKRFIDDAADEKVAHVSNGNGFDPTSRL

SEQ ID NO: 1673 - protein, 263 aa, Oryza sativa
  unsure (1)..(263): unsure at all Xaa locations
MEAKLSAASRRVAPSPIQQLSHLAQRAGAVNLAEGFPDFPAPAHVKAAAAAAIAADLNQYRHVQGICDALAETMKRDHGLRVDPLTDFAVCCGQSEAFAAAIFAIIDQGDEVLLFDPAFETYQTCIELARGVPVYVPLDPPSWTLNEDKFLKSFTNRTKAVVLNSPHNPTGKVFSREELLIIAQACQKMDCFAITDEVYEYITYDENELVPNSXTRLPGMQERTIITXSSLSKTYSVTGWRIGWACAPANICLINKKHPCHAN

SEQ ID NO: 1674 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 1675 - protein, 804 aa, Aspergillus niger
MAHSMSRPVAATAAALLALALPQALAQANTSYVDYNVEANPDLYPLCIETIPLSFPDCQNGPLRSHLICDESATPYDRAASLISLFTLDELIANTGNTGLGVSRLGLPAYQVWSEALHGLDRANFSDSGSYNWATSFPQPILTTAALNRTLIHQIASIISTQGRAFNNAGRYGLDVYAPNINTFRHPVWGRGQETPGEDVSLAAVYAYEYITGIQGPDPDSNLKLAATAKHYAGYDIENWHNHSRLGNDMNITQQDLSEYYTPQFHVAARDAKVHSVMCAYNAVDGVPACADSYFLQTLLRDTFGFVDHGYVSSDCDAAYNIYNPHGYASSQAAAAAEAILAGTDIDCGTTYQWHLNESITAGDLSRDDIEKGVIRLYTTLVQAGYFDSNTTKANNPYRDLTWSDVLETDAWNISYQAATQGIVLLKNSNNVLPLTEKAYPPSNTTVALIGPWANATTQLLGNYYGNAPYMISPRAAFEEAGYKVNFAEGTGISSTSTSGFAAALSAARSADVIIYAGGIDNTLEAEALDRESIAWPGNQLDLIQKLASSAGSKPLIVLQMGGGQVDSSSLKNNTNVTALLWGGYPGQSGGFALRDIITGKKNPAGRLVTTQYPASYAEEFPATDMNLRPEGDNPGQTYKWYTGEAVYEFGHGLFYTTFAESSSNTTTKEVKLNIQDILSQTHEELASITQLPVLNFTANIKNTGKLESDYTAMVFANTSDAGPAPYPVKWLVGWDRLGDVKVGETRELRVPVEVGSFARVNEDGDWVLFPGTFELALNLERKVRVKVVLEGEEEVVLKWPGKE

SEQ ID NO: 1676 - protein, 520 aa, Neurospora crassa
MNGIKDLGLGFSKASTRLHFFSLLLALGSFVWGYNVGVLASVLAHPGFRETIPGYGPYKRGLITSINYLGTWLSYIFFSRPATDLLGRRYAAMVGMSVLCVGQALQAAASGSVALSMVIFGRVVSGLGTGIVSTSVPLYQSEIAPAKQRGRLVVLNHVGFVAGLASGFWVGYAITFWNSSHGYLSGWRLSVSLSFIPALIFFVGLPFLHESPRWLVEHGRPDEALKALQFYREGSFTPSQIQSELTDIKRNVCAYQATSLKKWTSLFTNPSLFTRLWRAALLHFMAQMCGATAMKYYLPDLFRVLGLSPRVSLLAGGIESTLKIGCTVLEMFVIDKVGRRMTLAVGAGIMAFALLINGALPLAYPNNTNRASDYTCVVFIFIYSLGYSMGFGPAAWVYGSEMFPTAARARGLSFAASGGAVGSIIVSQLWPIGIAELGSKIYFFFMAVNLACVPIIFLLYPETKGRPLEDMEVLFGGYEGGTPSTTSLLLADEREDGNEEDEENETLGRPLLGDGRGMAR

SEQ ID NO: 1677 - protein, 164 aa, Cucurbita pepo
DRGEMMSMVYNWPADQVDVIVVTDGSRILGLGDLGVHGIGIAIGKLDLYVAAAGINPQRVLPVMIDVGTNNEKLLKDPLYLGLQQNRLDGDEYLAIIDEFMEAVFTRWPHVIVQFEDFQSKWAFKLLQRYRNTYRMFNDDVQGTAGVAIAGLLGAVRAQGRPMI

SEQ ID NO: 1678 - protein, 542 aa, Fusobacterium nucleatum subsp. vincentii ATCC 49256
MAKKSYEVLNDPFLNKGTAFTKEERKELELTGLLPPQIQTIEEQAEQVYAQYKSKEPLINKRRFLMEIFDTNRTLFYYLFSQHVVEFMPIVYDPVIAENIENYSELFVNPQNAVYLSIDSPETIEESLRNATKDREIRLIVATDAEGILGIGDWGTNGVDISVGKLMVYTAAAGIDPKSVLPVVLDAGTNRETLLEDKLYLGNRHKRVYGDEYYDFVDRFVQTAEKLFPRLYLHFEDFGRSNAANVLHKYWKTYPVFNDDIQGTGIITLAGILGALKISGEKLTDQRYMCFGAGTAGAGIADRIYQEMLQQGLSENEARSRFYLVDKQGLLFDDMNDLTPEQKPFARKRTEFNNANELTNLEAAVKAVRPTILVGTSTQPNTFTETIVKEMASYTARPIIFPLSNPTKLAEATAENLIKWTEGKALVATGIPADPVEYNGVTYEIGQANNALIYPALGLGAIASTAKLMTNEMISKAAHSLGGIVDTTKPGAATLPPVSKLTEFSQRVAEAVGQCALDQKLNREDITDIKEAIEKIKWTPKY

SEQ ID NO: 1679 - protein, 119 aa, Dechloromonas sp. RCB
MIATTNLNGDYISDALAAQVGGIGIAPGANISDRYACFEATHGTAPKYAGLDKVNPGSLILSAEMMLRHLGWGDAANLVLKAMEAAIGDKQVTYDFARQMEGANELSCSEFGDAMIARM

SEQ ID NO: 1680 - protein, 561 aa, Corynebacterium efficiens YS-314
MCPLSQRLIRCHLAHNTDPWWGTVTLRSSLLSPPAVARDPLCGRLICDFPSEGDTMTVYANPGTEGSIVNYEKRYDNYIGGQWVPPVEGQYMDNITPVTGEVFCEVARSTAADVEAALDAAHKAAPAWGRTSVAERALILHRIADRMEEHLEEIAVAETWENGKAVRETLAADIPLAIDHFRYFAGAIRAQEDRSSQIDHNTVAYHYNEPIGVVGQIIPWNFPILMATWKIAPALAAGNAIVMKPAEQTPASILYLMNIVGDLIPDGVLNIVNGLGEEAGTALSSSDRIGKIAFTGSTQVGKIINRAASDKIIPVTLELGGKSPSIFFADVMAQDDAFREKAVEGFAMFALNQGEVCTCPSRALVHESIADEFLELGVKRVQNIKLGNPLDTETMMGAQASQEQMDKISSYLKIGPDEGAETLTGGKVNKIDGLDNGYYIEPTVFRGTNDMRIFREEIFGPVLSVATFSDFDEAIQIANDTNYGLGAGVWSRDQNTVYRAGRAIQAGRVWVNQYHNYPAHSAFGGYKESGIGRENHLMMLAHYQQTKNLLVSYDPNPTGLF

SEQ ID NO: 1681 - protein, 631 aa, Solanum tuberosum
MESLVDGISSLPNVHNSFAAVECNTSLASKISHPPLMKQSENKESSISYPIAMDLGSNTAHTQTGSVTGSKHFEANEDTVNQLAEGCSGEQVLALETESSIKDLHYVSKNSTSNDDLNAAAAKGLPSESGITYCPSPQNSFYSATQYTEAKQSFSNTEVSECASSTVDKSGESGDVSNSCDLVESRKTSFYRGSTGSDVSDESSSSSFNSTTVYKPHKANDTRWDAIQVIRAREGTLGFNHFRLLKRLGCGDIGSVFLAELIGTRCFFAMKVMDKAALESRKKLVRAQTEREILQSLDHPFLPTLYSHFETDKFSCLVMEFCPGGDLHALRQKQPGKFFPEHAARFYVAEVLLALEYLHMLGIIYRDLKPENVLVREDGHIMLSDFDLSLRCAVSPTLVRSSNSSLESKSSSYCVQPACIEPSCVIQPACIQPSCFTPRFLSKTKKEKKSKQKTETYNQVNRPLPELLAEPTSARSMSFVGTHEYLAPEIIKGEGHGSAVDWWTFGIFLYELLFGQTPFKGAGNRATLFNVVGQPLKFPETPSVSFAARDLIRGLLVKEPQHRLAYRRGATEIKQHPFFQNVNWALIRCTSPPDVPKPSSMTYNMPRTPPAGKTPGVDVKPSGNYFEIDFF

SEQ ID NO: 1682 - protein, 569 aa, Glycine max
  unsure (1)..(569): unsure at all Xaa locations
MWKLVRYAAASNLARSRRFSAAIPGPCIVHKRGADILHDPWFNKDTGFPLTERDRLGLRGLLPPRVISFEQQYDRFMNSFRSLENNTQGQPDKVVSLAKWRILNRLHDRNETLYYRVLIDNIKEFAPIIYTPTVGLVCQNYSGLFRRPRGMYFSAKDKGEMMSMIYNWPAHEVDMIVLTDGSRILGLGDLGVQGIGIPIGKLDVYVAAAGINPQRILPVMLDVGTNNQKLLEDHLGLRQPRLEGEEYLSIVDEFMEAVHARWPKAIVQFEDFQMKWAFETLKRYQKRFCMFNDDIQGTAGVALAGILGTVRAQGRPLTDFVNQKIVVVGAGXGLVTTERNSLDPAAAPFAKNPRDIEGLTEGASIIEVVKKIRPHVLLGLSGVGGIFNEEVLKAMRESVSTKPAIFAMSNPTMNAECTSIDAFKHAGENIVFASGSPFENVDLGNGKVGHVNQANNXMYLFPGIGLGTLLSGAHLITDGMLQAASECLASYMAEEDILKGILYPSVDSIRDVTAEVGAAVLRAAVEEELAEGHGDVGPKELSHMSKDEAVEYVRSNMWYPVYSPLVHEK

SEQ ID NO: 1683 - protein, 332 aa, Escherichia coli K12
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 1684 - protein, 487 aa, Streptomyces avermitilis MA-4680
MTQAPQKAPYTTNNVGIPVESDEHSLTVGPDGPILLQDHYLIEKMAQFNRERVPERVVHAKGSGAYGFFEVTNDVSQFTKADLFQPGKRTEMLARFSTVAGEQGSPDTWRDPRGFALKFYTEHGNYDMVGNNTPVFFVRDTIKFQDFIRSQKRHPVTGLRSNDMQWDFWTLSPESAHQVTWLMGDRGIPKTYRHMNGYSSHTYMWINGAGERFWVKYHFKTDQGIDFLTQAEADELAGSDADKHRRDLFESIESGNAPTWTLKVQIMPFEDAADYRFNPFDLTKVWPHGDYPLIDVGRMVLNKNPEDYFIHIEQAAFEPSNLVPGIGPSPDKMLLGRLFSYPDTHRYRIGPNYAQLPPNRPHAPVNSYAKDGPMRYVPSNAARPYAPNSYGGPAADYGQFGDPASWETAGELVREATKPHREDDDWGQPGTMVRQVLDDAARDRLVSNVSGHLKADVSRPVLDRAVQYWRNIDKEIGDRIASNVNGG

SEQ ID NO: 1685 - protein, 1230 aa, Candida albicans
MSILSENNPTPTSITDPNKSSHLHNPELNSGTRVASGPGPGPEAESTPLAPPTEVMNTTSANTSSLSLGSPMHEKIKQFDQDEVDTGETNDRTIESGSGDIDDSQQSHNNNNNNNNNNNESNPESSEGDDEKTQGMPPRMPGTFNVKGLHQGDDSDNEKQYTELTKSINKRTSKDSYSPGTLESPGTLNALETNNVSPAVIEEEQHTSSLEDLSLSLQHQNENARLSAPRSAPPQVPTSKTSSFHDMSSVISSSTSVHKIPSNPTSTRGSHLSSYKSTLDPGKPAQAAAPPPPEIDIDNLLTKSELDSETDTLSSATNSPNLLRNDTLQGIPTRDDENIDDSPRQLSQNTSATSRNTSGTSTSTVVKNSRSGTSKSTSTSTAHNQTAAITPIIPSHNKFHQQVINTNATNSLSSLEPLGVGINSNSSPKSGKKRKSGSKVRGVFSSMFGKNKSTSSSSSSNSGSNSHSQEVNIKISTPFNAKHLAHVGIDDNGSYTGLPIEWERLLSASGITKKEQQQHPQAVMDIVAFYQDTSENPDDAAFKKFHFDNNKSSSSGWSNENTPPATPGGSNSGSGSGGGGAPSSPHRTPPSSIIEKNNVEQKVITPSQSMPTKTESKQSENQHPHEDNATQYTPRTPTSHVQEGQFIPSRPAPKPPSTPLSSMSVSHKTPSSQSLPRSDSQSDIRSSTPKSHQDVSPSKIKIRSISSKSLKSMRSRKSGDKFTHIAPAPPPPSLPSIPKSKSHSASLSSQLRPATNGSTTAPIPASAAFGGENNALPKQRINEFKAHRAPPPPPSAPPAPPVPPAPPANLLSEQTSEIPQQRTAPSQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSSHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINSKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 1686 - protein, 543 aa, Lupinus albus
MAREHIHVLNALDVAKTQWYHFTAIIIAGMGFFTDAYDLFCISLVTKLLGRIYYHVDGAGKPGTLPPNVSAAVNGVAFCGTLSGQLFFGWLGDKMGRKKVYGMTLMIMVICSIGSGLSFGHSPNSVLATLCFFRFWLGFGIGGDYPLSATIMSEYSNKKTRGSFIAAVFAMQGFGILGGGIFAIIISAAFKARFDAPAYEVDPVGSTVPQADYIWRIIVMVGALPAALTYYWRMKMPETARYTALVAKNAQQAAADMSKVLQVEIQSETNKEEAQGKPSFGLFSKEFLRRHGLHLLGTAGTWFLLDIAFYSQNLFQKDIFSAIGWIPPAKTMNALDEVYRIARAQTLIALCSTVPGYWFTVALIDRIGRFAIQLMGFFFMTVFMFALAIPYDHWTHKDNRIGFVVIYSLTFFFANFGPNATTFVVPAEIFPARFRSTCHGISSASGKLGAIVGAFGFLYLAQNKDKSKTDAGYPAGIGVKNSLIVLGVVNILGFCFTFLVPEPNGKSLEEMSGENEEEEPTKEGSYNNNNNNNNNNNRTVPYV

SEQ ID NO: 1687 - protein, 143 aa, Desulfovibrio vulgaris subsp. vulgaris (strain Hildenborough)
MKPSREELKKRLTPLQYDVTQEEGTEPPFRNEYWDEKREGLYVDIVSGEPLFSSRDKYDSGTGWPSFTRPVDPQGIVERVDRKLFTTRTEVRSRNGDSHLGHVFPDGPQPTGLRYCINSAALRFVPVEDLEQQGYGHLLHLFQ

SEQ ID NO: 1688 - protein, 228 aa, Glycine max
MTGCCFPVTFHRSGSRRVSFRLVRSSSSGSSKHRGRESHKGPLVVCFGEMMINLVPTVARVSLADATAYKKFPSGATANVAVGICRLGGSAAFIGKVGNDEFGHLLSDILKQNGVDNSGLLFDDHARTALGFYALKSNGEPEFMFYRNPSSDVLLRPDEIDMDLIKKATIFHYGSVSLIKEPCRSAHLAAMNAAKVSGCFLSYAPNLALPLWPSKEAARQGIMSVWNY

SEQ ID NO: 1689 - protein, 340 aa, Yersinia pestis CO92
MEITDMPTDDSNNGIIDYVSTGHLPDPETVVKLVQEAHKRFSTDTAGVVSNVYPALERIPADLFGICMVGTNGKIHSAGDVDYEFTIMSVSKPFVFALVCQAIGAKTAREKLGVNSTGMAFNSVTAIERASDGRTNPMVNSGAIATTSLVPGATSDEQWKFIYDGLCRFAGRELTLNEEVYQSACETNFRNRGIANVLQGYGRLGCDPIIATDLYTRQCSLNVSARDLAVMGATLADGGVNPLTRERVVDNDICHYALAVMVTAGLYETSGDWLYDIGLPGKSGIGGGIVTVSPGKGGLGTFAPLLDSAGNSIKGQLAARFLSRSLGMDMFVSEPYTEKN

SEQ ID NO: 1690 - protein, 206 aa, Kluyveromyces lactis
MNSEYDYLFKLLLIGNSGVGKSCLLLRFSDDTYTNDYISTIGVDFKIKTVELDGKTVKLQIWDTAGQERFRTITSSYYRGSHGIIIVYDVTDRESFNGVKMWLQEIDRIATSTVLKLLVGNKCDLKDKRVVEYDVAKEFADANKMPFLETSALDSTNVEDAFLTMARQIKESMSQQNLNETTQKKEDKGNVNLKGQSLTNTGGGCC

SEQ ID NO: 1691 - protein, 104 aa, Amaranthus blitoides
NVFAYPGGASMEIHQALTRSNIIRNVLPRHEQGGVFAAEGYARATGRVGVCIATSGPGATNLVSGLADALLDSVPLVAITGQVSRRMIGTDAFQETPIVEVTRS

SEQ ID NO: 1692 - protein, 251 aa, Desulfovibrio vulgaris subsp. vulgaris (strain Hildenborough)
MKKLIAANWKMYKTIDEARATGRELVSAVAGSLPADREVLVCPPFTALHALHDTFKDVEGFAIGGQDVYPATEGAYTGEIAPGMLLDAGCGWVLTGHSERRHILGEDDETVARKTAFSLKAGLRVVLCIGEKLDEREAGRLEDVLAHQLQVGLADVDATYVPQSLVVAYEPVWAIGTGKVAGPAEVVEAHALVRSLLEARYGRDGAAIRILYGGSVKPDNAAELLSLDNVDGLLVGGASLQAVSFSRIILA

SEQ ID NO: 1693 - protein, 525 aa, Triticum aestivum/Thinopyrum intermedium alien addition line
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDYPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEENVQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGHHTGFVVLYGLTFFFANFGPNSTTFIVPAEIFPARLRSTCHGISAATGKAGAIIGAFGFLYASQDQKKPETGYSRGIGMRNALFVLAGTNFLGLLFSLLVPESKGKSLEELSKENVGDDDTIVPTGV

SEQ ID NO: 1694 - protein, 333 aa, Synechococcus sp. PCC 7942
MSKPDRVVLIGVAGDSGCGKSTFLNRLADLFGTELMTVICLDDYHSLDRKGRKEAGVTALDPRANNFDLMYEQVKALKNGETIMKPIYNHETGLIDPPEKIEPNRIIVIEGLHPLYDERVRELLDFSVYLDIDDEVKIAWKIQRDMAERGHSYEDVLASIEARRPDFKAYIEPQRGHADIVIRVMPTQLIPNDTERKVLRVQLIQREGRDGFEPAYLFDEGSTIQWTPCGRKLTCSYPGIRLAYGPDTYYGHEVSVLEVDGQFENLEEMIYVEGHLSKTDTQYYGELTHLLLQHKDYPGSNNGTGLFQVLTGLKMRAAYERLTSQAAPVAASV

SEQ ID NO: 1695 - protein, 69 aa, Glycine max
  unsure (1)..(69): unsure at all Xaa locations
MXTXVSIKGXQIXDXRGNPXVEVDXXCSDGTFARAAVPSGASTGIIEALELRXGGSDYXGKGVSXAVDN

SEQ ID NO: 1696 - protein, 164 aa, Glycine max
  unsure (1)..(164): unsure at all Xaa locations
VYRASVCMVGPFTGLKSMAGLPTKKTNYDITFIALNCGILQCMRVCPPDGKKKFETLCYLPHLDDAQXAKEVQYLLRKGWIPCLQFQLDHGFVYREHNRSPRYYDGRYXTMWDLPXFGCTDAYQXVKELQEAXTXYPNCFIRIIRFDHLSPSPCINFIAFKSPS

SEQ ID NO: 1697 - protein, 501 aa, Cytophaga sp. KUC-1
MSNTIQRPEFKAKYDNYINGKFTAPVKGEYFDVLSPIDGKVFTKAAHSGKEDLELAVDAAYEAFKTWGKTSVTERSILLNKIAQKIEDNLEYIATVETIDNGKPIRETLAADIPLAIDHFRYFAGVIRAEESSIAELDSQTVSIALSEPLGVVAQIIPWNFPILMAVWKIAPALAAGNTIVLKPAESTPISILVLMELIGDILPPGVLNIVNGFGAELGRPLVTNKKVAKAAFTGSTTTGRLVMQYATENIIPVTLELGGKSPNIFFPSVADHDDDFFDKAIEGAVLFALNQGEICTCPSRLLIHEDIYEKFIARVIERTEAIIAGNPLDKSTMIGAQTSLVQKEKIMSYIKLGKEEGAELLTGGDENHLGGDLEGGYYIKPTLFKGHNKMRIFQEEIFGPVLAVTTFKTTEEAIEIANDTMYGLGAGVWTRDAHEIYQVPRAIQSGRVWINQYHSYPAGAPFGGYKQSGIGRENHKMMLGQYRQTKNMLISYDKKKLGFF

SEQ ID NO: 1698 - protein, 213 aa, Nostoc sp. PCC 7120
MTKPDPNRVLRRLPLVVGGLGAILLLINRLLTPELTNSQARGDVLGVILSAVLILTGLIWQQVQPRSPDSVELIGEEGFALAADLPEAVKTELAWASHLLLTNTVTRSLVVYYQGKVLLRRGILAPKAEVTPGAIVKRVLEKQQPVYLVALYVYPGRIEFDYLPENTQGVICQPIGNEGVLILGANAPRSYTKQDENWIAGIADKLAVTLKSI

SEQ ID NO: 1699 - protein, 501 aa, Zea mays
MGIQGNKAATHEHDFLSLYAAAAAKDAPLLLHDSKAPPPSQGNFLLKTHDFLQPLDQKPGAPPEPSPLPASAAESRHQPQQQVVVANQHALPLPGGVGTFSISPAPVSVALPAAVVKSEPPFVLWGQPALRRDAPPAGHQQQWALPFAGAGQVRPPPQQAPPDRKGRGGAGGGVMESGSRSSGGAGFDDDDGLTTRREVSSSLQDLTVRVDRKGGSCSDGGTDQRPNTPRSKHSATEQRRRSKINDRFQILRELLPHSDQKRDKATFLLEVIEYIRFLQEKVQKYEATFPEWNQENPTMLPWSKGQIPGDSPPDPSHFVRNGSSPGSNFTGKLDDNHNIVTSAAASGAQDQAETDHMASGCYRSAETTANFTNNAMSQSQPQWTGPSPVDDSAVNSETLNNQQLVIDEGTIRVSSNYSQELLNSLTHALQSSGVDLSQANISVQINMGKRAAKRPAAGVSSNSKEPADPASSNELGHQLTLSGAGADCLSHATKRHKRSNS

SEQ ID NO: 1700 - protein, 304 aa, Streptococcus pyogenes MGAS8232
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFDILERQTPGAGNEVQLTDAIDTLNKTQRVFAREFKGNRYDVGDKFGFMKTSIDYALEHPQVKEDLKNYIIKLGKALEKSKVPTHSK

SEQ ID NO: 1701 - protein, 99 aa, Zea mays
MPGAGEEDKKPAEGRVHIHLNVQGHDGNDELFPINTATQLNKLMNPYCDRHAVDMNAMAFLTDGRRLPAEHTPDELDMEDMDNIHCVLHHTESSGPNTT

SEQ ID NO: 1702 - protein, 382 aa, Acetabularia acetabulum
MNDMDFAALFNQHEGNNPDNLQPNAPPYMLSPQQNAAATMPKSHCSGDNTLMLSDMGEQVIMHPLYPDLVKAIMDCRKVGGMDESRHHIQIRTEQVLEDLHRKREQYQITGRMPALDPELDQFLRQYIQVLDELHAELLNINREADNILHMFTTQIAEVINMPMDPRSMHARNAFNAQSNIDMTWFEIRNEQEQRVLLKQKYRQELLALKEEFSKRKKRGKLPTHSIEVLKSWWKEHIAWPYPTDSAKRSLASQTNLTSIQINNWFINQRKRHWHKLFPEGVPNSQEEALRSLKARGMLGMDSSGPMRLMSMDIESQETQEVEQETEDIQTPNEFQFQSAFLNEHEQMMDEAGFTSRPNVQLPDAISQFQSQLGQIRKDSDE

SEQ ID NO: 1703 - protein, 354 aa, Pneumocystis carinii
MGCCFSATYNQDTLRSKEIESYLRQEQEHACHEAKILLLGAGESGETTILKQMKLIHLSGFTLKEREYYRTIIFSNMLQSMRLIIEAMEEFDICFERRENEQYLDLLLQERELTNRENLPPEYYRPFISLWKDAGVTRAVNRGNEYALHDNCFYFYENIHRLFERKYIPTDQDILRCRLKTTGITETCFKVSRLTYRMIDVGGQRSERRKWIHCFENVTAVLFLVAISGYDQCLTEDIGANQMQEALVLFDSICNSQWFINTSIILFLNKIDLFKVKLHVSLISNYFPDFNNENQTDYRACCLFFRQKFLRLNRNHQKTIYTHFTNATDTTLLKNVMISVTDIIFNRNLQNLML

SEQ ID NO: 1704 - protein, 751 aa, Methanosarcina mazei Goe1
MTEEINLRVAEAYHKDVGRGIARIDTRLMQEMGLVSGDIIEISGRSKTYAIVWPNVERGQENRIRIDGNLRSNAKVGIDDRVTIQKVQAKHAQRVTLAPSQPVRLVGGAHYILRIIEGRPLNKGQQIRVETVNNPLTFVVASTRPAGPVVVTKDTEIIIKEKSIEEIKAPEGISYEDIGGLRREIQLVREMIELPMRHPELFQKLGVEPPKGVLLHGPPGTGKTMIAKAVASETDANFITISGPEIVSKYYGESEQKLREIFEEAEKDAPSIIFIDEIDSIAPKRGEVTGEMERRVVAQLLSLMDGLKSRGEVVVIAATNRPNSIDEALRRGGRFDREIEIGIPDRNGRKQILLIHTRGMPLEDEVSLSEIADVTHGFVGADLSSLCKEAAMHALRRITPEIDIEEEIPQEIIDNLVVTKENFREALKNIEPSAMREVYIEVPHVGWDDIGGLEKAKQELIESVEWPLKYPEMFKAVSIKPPRGVLLFGPPGTGKTLLAKAVANESEANFISIKGPELLSKYVGESERAIRETFRKAKQAAPTVIFFDEIDSIAPQRSSVSDTHVSERVVSQILTELDGIEELKDVIIVAATNRPDMVDPALLRPGRFDRLIYIKPPGKEGREKIFEIHAKEKPLAEDVKLSELAEMTEGYVGADIEGICREAAMLALREIVTPGADRKNIQEKAAEVRLSKRHFEKAIRRVKPTTSRETLSAYEKSAELFARYATEFEEESSEEKDQEIKVEEKDQETRV

SEQ ID NO: 1705 - protein, 215 aa, Neurospora crassa
MSSVVNEGEKPQEAAQEQQEEQQQQQQQQEQQNAGDDVNDDEEEISAMKRRVAEMEEEAAKLREMQASLDQQHHELTENKEDIDSRSIFVGNVDYSASPEEIQAHFQSCGSINRVTILLDKFTGQPKGYAYVEFTEPSLVAQALVLNESVFKGRNIKVVPKRTNIPGMSRGGRGGRGSFRGGGRGGYFGGRGGFPPRGGYRGGYRGRGRGGYAPY

SEQ ID NO: 1706 - protein, 281 aa, Triticum aestivum
MASLLRTAAALAPPPSSARETRRPSCAASLACSRRAPASPLRAPPLPGPWRLGPDEAARTATQFLCRYMRRDGHEGDGRTQGQDEPSMFGPDDDDGAKIPTQVETLVRGTAIVDAPEYKPLPDLDYLQELLAIQQQGPRSIGFFGTRNMGYMHQQLIEILSYAMVITKNHIFTSGASGTNAAVIRGALRAEKPELLTVILPQSLKKQPPESQELLSKVQNLIEKPQYDHLPLIEASRLCNMDIISKVQQVICFAFHDSRLLMETCQEAKNMRKIVTLFYLD

SEQ ID NO: 1707 - protein, 382 aa, Pyrocystis lunula
LFLLLLRPPPEHASNSTSPGPLPPSSPCTHSDLTPATAMAAGSDTKAAINGFGRIGRNVLRCWLKKETKPFDVVAINVGSMGAKAAAHLLKYDTVLGTLQANVSFTDDEITIDGKSFKVVSGRDPAAMPWKDMGVEVIIESTGAFNSLEGGSKHLEAGAKKIVLTAPGKNCPTYVVGVNEGDYDAENDTVVSNASCTTDGMASVCKVLDESFGVEYGMMTTTHSYTGDQMILDGRHRDLRRARAGACNIVPTSTGAAKAVAEVLPKYKGKLNGIALRVPTPNVSIVDLVVKVSKKCTKEEVNAAVKAAADGPMKGIINFEEQPLVSSDFMQTDYSNSVDVALTMVMGEDLVKVVMWYDNEWGYSQRVLDLTAIVAAKLPVAA

SEQ ID NO: 1708 - protein, 431 aa, Escherichia coli
MVSLEKNDHLMLARQLPLKSVALILAGGRGTRLKDLTNKRAKPTVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 1709 - protein, 494 aa, Neurospora crassa
MAPKLKDPSLFKKDVCYVNGEWVKAHSGKTFEVNATGKLIGTCPEFDAQDTKKAIDAAETAFETFRHKTGRERSKLLRKWYDLMVENHDDLTTLITLENGKPLADAKGEVTYAANFFEWFSEEAPRIYGDTIPSSVPGNRVWTIKEPVGVCGLITPWNFPAAMITRKVGPALAVGCTVVCKAPGETPFTALAIAELAHRAGIPPGVVNVITALENTPEVGSTLTTDPVVRKISFTGSTAVGKLLMKQCSGTLKKLSLELGGNAPFIVFDDADVDAAVTGAIASKFRSSGQTCVCANRIYVQRGIYDEFSQKFAEQVKNNFRVGNGFEEGVTHGPLIHHRAIEKVEQHVRDAEKKGAKVVVGGHRLESLGPNFYEPTVITGMTPDMAMASEETFGPVAGLFPFDTEDEVVKLANATQVGLAGYFFSRDIHRCVRVAEHLEVGMVGINTGLISDPASPFGGVKESGFGREGSLYGIGEYQVTKMVTVGGMGQPLQK

SEQ ID NO: 1710 - protein, 272 aa, Arabidopsis thaliana
SSKWDEVKADVLKALEDYGCFEAFFDKLSVELNRSVFEAMEDLFELPIPTKQRNVSSKPFHGYLCHNLYESLGIDDANVLEKVNDFTQQLWPDHGNKSISETIHLFSEQLVELDLMVRRMIMESFGIENYIDEHLNSTYYLTRLMKYTSPPDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 1711 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWMKVKNPNTGKEIVIKDVIADAFLQQILLRPAEYDVIRCMNLNGDYISDALAAQVGGIGIAPGTNIGDECALFEPTPGTAPKYAGQDKVNPGSIILSAEMMLRHMGWTEAADLIVKGMEGAINAKTVTYDFERLMDGAKLL

SEQ ID NO: 1712 - protein, 286 aa, Oryza sativa (japonica cultivar-group)
MGQARAHLLASLWAFYLILAISMVTGDLTNDLDILWGNSKVFYDNSGKQTISLTLDRWTTSAFRSKSTYLFSRIDMDIKLVAGDSAGTVTTLYMITEGLWQFHDEIDLEFLGNSTGEPYTLHTNLYARGKGGREKRYKLWFDPTADFHTYTIIWNQRNILILVDDKLIRQIKNNLMYSVPYPTYQPMRVYGSIWNADDWATMGGRVKTDWSQAPFTAYFRNYRAIACPPQQSSPLCGQSSGNWFNQELDVTRKQQLQEVDANYKIYDYCTDTKRFKDNLPKECTIN

SEQ ID NO: 1713 - protein, 137 aa, Pectobacterium carotovorum subsp. carotovorum
GIVRNLVEQIAVTCPKACIGIITNPVNTTVAIAAEVLKKAGVYDKNKLFGVTTLDIIRSNTFVAELKGKQPQDINVPVIGGHSGVTILLCLSQDPGISFSEQEVADLTKRIQNAGTEVVEAKARGGSATLSMARLPA

SEQ ID NO: 1714 - protein, 328 aa, Oryza sativa (japonica cultivar-group)
MPPAKSSKHGFPKLSASSKALVLLPLLLLGFIYLFVYPKEFELQALMMSSCGPTTAAGAYTAAPRRLAGEPPASRKPDFRLLIGVLTRADNYERRHLLRMVYGLQLAAGDLTAHVDVRFVFCRLYKDDQRVLVPLEILRHGDIIVLDECEENLNGGKTYAFFSAAARLYADDPYDYVMKADDDIFLRLPRLLASLGAMPREDAYYGATIPCGSMDPFREYMSGMAYALSWDVVEWVATSDVPRNRTVGPEDRMTGQWLRLGGRGKNRFNAKPAMYDYPLPAPVDKCSHEFIPDTIAVHRLKDNPRWAETLKYFNFTKGLEPSKFYKIN

SEQ ID NO: 1715 - protein, 549 aa, Lotus japonicus
MGHRHLYNTTPLFEGEPDQNWNHMHTDQHYVNLGRTSTAENGSYFYPVENVSIDSTSFPSHWNPATRSNGYASSSLNIEVPPHQSDTSGASNDHFIHSSSAGAFFAVSNNCVPQPPAANYDRPPFQVDGGFIDLTMGSGRGPHKRKSPGIPSVYERGGSSRYFNAGSSTDVPISSESRPEKPNIDSQYMPWDHVPMTSTVRGAGHSIKGESSLRNVRSRSALDLESNLSRTHLPSNHSHNSYSTIPPVDHSSMMDLSGQISTSLTGDWSQMNISPANGRVLLPDAGAYGLESSHFLAGSGATASNASVDVGSFHHEFGTSRNPTGPQSFHNLTQTARGIRSNYSQRSAPTFRASSSTHLGHVTPLDDGLPMVAESYSSRHQRPLSSIGWRNSDRNGRARISSERYRSLANEAGLHGRISPEVFMIVDRASMYGSRNMLDQHRDMRMDIDNMSYEELLALGERIGHVNTGLSEDSFSQCMTETIYCSSEQGQDEGSCVICLEEYKNMDDVGTLKTCGHDYHVNCIKKWLSMKKLCPICKASVMPEDKMNK

SEQ ID NO: 1716 - protein, 84 aa, Oryza sativa
MKVKILQWHSVASWTWDAQDETCGICRMAFDGCCPDCKFPGDDCPLIWGSCNHAFHLHCILKWVNSQTSTPLCPMCRREWQFKG

SEQ ID NO: 1717 - protein, 145 aa, Zea mays
MINAKKIAHLAKKWQRMAAQGRKRLALGAAAKQADECCSYVASKGHCAVYTADGARFEVPLACLSTPVFVELLQMSQEEFGFTGGDGTGRITLPCDAAIMEYAMCLLRRGASAELEQAFLSTMAMSCHCASHMAPYVGATHQIAV

SEQ ID NO: 1718 - protein, 342 aa, Aquifex aeolicus VF5
MAIKVGINGFGRIGRSFFRASWGREEIEIVAINDLTDAKHLAHLLKYDSVHGIFKGSVEAKDDSIVVDGKEIKVFAQKDPSQIPWGDLGVDVVIEATGVFRDRENASKHLQGGAKKVIITAPAKNPDITVVLGVNEEKYNPKEHNIISNASCTTNCLAPCVKVLNEAFGVEKGYMVTVHAYTNDQRLLDLPHKDFRRARAAAINIVPTTTGAAKAIGEVIPELKGKLDGTARRVPVPDGSLIDLTVVVNKAPSSVEEVNEKFREAAQKYRESGKVYLKEILQYCEDPIVSTDIVGNPHSAIFDAPLTQVIDNLVHIAAWYDNEWGYSCRLRDLVIYLAERGL

SEQ ID NO: 1719 - protein, 346 aa, Streptomyces coelicolor A3(2)
MTTVAAYAAPAAKAPLERTTIERREVREHDVLIDIKFAGICHSDIHQAREGWGEAIFPMVPGHEIAGIVSEVGPGVTRFKVGDRVGVGCMVDSCRECENCKAGREQYCTSGNTGTYNAVGRDGEVTYGGYSEKVVVDENFVLGIPEGIALDEAAPLLCAGITTYSPLKRWNAGPGKKVAVVGLGGLGHMAVKLAHALGAEVTVLSQSLRKKDDGLKLGADHYYATSDPATFEELSGTFDLIVSTVSAPLDLGAYLGLLKTEGTLANVGAPEEPVSLNLFALLGGGKSLSGSMIGGIAETQEMLDFCAEHGIGAEIELIAASEINEAYERVLSSDVRYRFVIDTATI

SEQ ID NO: 1720 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 1721 - protein, 408 aa, Bacillus subtilis subsp. subtilis str. 168
MSPMDHLVFEVGTALVLVAIASVIANKIKFSIIPFLIVLGMLVGPHAPKMGIIDLTFIQSSEIIEFFGRMGVLFLLFYLGLEFSVGKLIKSGKSIAVGGTIYILINFSLGLLYGFITGFSFLEVLILAGVITISSSAIVAKVLVDLKRTANPETELILGIIMFEDIFLAVYLSVVSGLILGDATSVGSALLSILIAFGYMLLFFIAARKLPPLLNKLLDIRSNEVFIIVIFAALFFIAGFSETIHVAEAIGALLLGLVFSETEHSDRIEHLVVPFRDFFGAMFFFSFGLSIDPFSLGEAVWLALGAVILTILGNFIAGMVAGRRAGLSHKASSNIGLTIVSRGEFSIIVANLGIAGGLSATLKPFAALYVLILAILGPLVTKESKRIYRLLNKVFKWKPEVQPAKKQG

SEQ ID NO: 1722 - protein, 252 aa, Triticum aestivum
MGRGRVELKRIENKINRQVTFAKRRNGLLKKAYELSVLCDAEVALIIFSNRGKLYEFCSGQSMPKTLERYQKCSYGGPDTAVQNKENELVQSSRNEYLKLKARVENLQRTQRNLLGEDLGSLGIKDLEQLEKQLDSSLRHIRSTRTQHMLDQLTDLQRKEQMLCEANRCLRRKLEESSQQMQGQMWEQHAANLLGYDQLRQSPHQQQATHHGGNGFFHPLDPTTEPTLQIGYTQEQINNACVAASFMPTWLP

SEQ ID NO: 1723 - protein, 483 aa, Pseudomonas fluorescens
MKTKLFINNAWIDSSDQQTFEGKDPVNSEVMTERANATVTDAIKAAQVAEEAFKTWKDVGPSECRRLLLKVADVMESKTPKFIEVMAMEVGASALWAGFNVHASANVFREAASLATQIQGETIPTDKAETLSMTLRQPVGPILSIVPWNGTAVLAARAIAYPLVCGNTVVFKGSEFIPATHALITQCVQEAGMPAGVLNYLNSSPDRSPEIADALISAKEIRRINFTGSTRVGSIIAQKAAQHLKRCLLELGGKSPLIVLDDANIDAAVKAAVFGSFLFQGQICMYTERLVVDEKIADEFVSKFVEKTKRLSAGDLCVTGDCIIGPMVSLNSGYRINGLFKDAIDKGSKVVCGGMVQGAVMPSTILDHVKSDMRIYDEETFGPITVVIRCKGEAEAIRIANDSVYGLSSGVFGRDINRALRVGMSIEYGCVHINGSTVQNEVQAPYGGTKNTGYGRFDGRAVVDEFTELKWLTIEPFEQQYPF

SEQ ID NO: 1724 - protein, 449 aa, Nicotiana tabacum
MDNNSVGVPHNLPRGEMGGKQKNAQADGRNRRALGDIGNLVPAPAAEGKPKAAQISRPVTRSFCAQLLANAQEEKNKKPLAEVVNKDVPAKKKASDKEMKTVGGSPLSKRKAKKSGKTLTSTLTARSKAACGLSNRPKYEIEDIDVADADNHLAAVEYVEDIYNFYKLTEGESRVDDDYMNFQPDLNHKMRAILVDWLIEVHRKFELMPESLYLTITILDRFLSLKTVPRKELQLVGISSMLIACKYEEIWAPEVNDFIHISDNAYAREQILQMEKAILGKLEWYLTVPTPYVFLVRYIKAATPSDNQEMENMTFFFAELGLMNYKITISYRPSMLAASSVYAARSTLNKTPLWTQTLQHHTGYSEDQLMECAKILVSYHLDAAESKLKAIYRKFSSPDRGAVAFFPPARNLLPTTTTDAASLVLEEFYFLVWEAFLGSFYCCDLSSLD

SEQ ID NO: 1725 - protein, 506 aa, Pseudomonas aeruginosa PAO1
MIYAAPGTPGAVVTFKPRYGNYIGGEFVPPVKGQYFTNTSPVNGQPIAEFPRSTAEDIDKALDAAHAAAEAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 1726 - protein, 645 aa, Oryza sativa
  unsure (1)..(645): unsure at all Xaa locations
MSARLLRRVLQERETAPQDPAAAATAAAEVEREEEEEASPPRVAARNPFDLLDEEEEEEEEKGSCSCLLPCLLEDEVYSEQPVSYNEQKHSVNKKPGNAVPETNKKSKKKKKKSKADKQVSTKSRDEKSLDSILEDLSIEKKPMQQRVNQNERASGKEIEIDETTPGTSSILSIDPKHLKAENEMRRIFGSKVVDSLENQRNVPSSSTSRLRGVRRVAHNPRKTLLVTPSSYWPPWDKSMSMDIVETKSGFNYFRYIYDPSVSHVQDLFEVAKSANDLNAIAAILAKYPYHPESLLTFAELFKYSGEHQSSADAVEKCLFALECAWHPLFSPLHSNCQLKYSHDTNKPFFTALFSHMKNLERRGCHRSALEVCKFLLSLDSDDPKGALFCIDYFALRSQQYKWLEQFAEEYQCDNSLWLFPNFSFSLAIARFYVERDATNGEASDHSGRSTPGDLMKQALMLHPLVLRKIVDKAPLKDSSWTQILRNVFFXSAKPGSPSLEHMIXIYVDRHYIMWRFPELQNLLKDAALLVIGSLKQDNXEAQDWACVRKEAFSSDKNEYSHLLVSDFSDTTPSLPPEELRPFMVAPGMAHEMPPAEQELGIEVRPRAPREVAGRNPALVFLESLLPWVDYGDNHHDENDQNNDD

SEQ ID NO: 1727 - protein, 558 aa, Oryza sativa (japonica cultivar-group)
MELSSSLAAVLHSPLFLLAALLLLPVFTLLSFSSAKKPGDGGGWRLPLPPSPRGVPFLGHLPLLGSLPHRKLRSMAEAHGPVMLLWFGRVPTVVASSAASAQEAMRARDAAFASRARVRMAERLIYGRDMVFAPYGEFWRQARRVSVLHLLSPRRIASFRGVREQEVAALLDRVRRRCGVRGGGETVNLSDLLMSYANGVISRAAFGDGAYGLDGDEGGEKLRELFANFEALLGTATVGEFVPWLAWVDKLMGLDAKAARISAELDGLLERVIADHRERRRLSQPDGGDGDGDGDENVDHRDFVDVLLDVSEVEEGAGAGEVLLFDTVAIKAIILDMIAAATDTTFTTLEWAMAELINHPPVMRKLQCEIRAAVGVPGASGGAEVTEDHLGELRLLRAVVKETLRLHAPVPLLVPRETVEDTELLGYRVPARTRVIINVWAIGRDAAAWGDRAEEFVPERWLDGGGEEVEYAAQLGQDFRFVPFGAGRRGCPGAGFAAPSIELALTNLLYHFDWELPPHADGAAAATAARLDMGELFGLSMRMKTTLNLVAKPWSSDV

SEQ ID NO: 1728 - protein, 245 aa, Lycopersicon esculentum
MGRGRVHLKRIENKINRQVTFSKRRSGLLKKAHEISVLCDAEVGLIVFSTKGKLFEYANDSCMERILERYERYSFAEKQLVPTDHTSPVSWTLEHAKLKARLEVLQRNQKHYVGEDLESLSMKELQNLEHQLDSALKHIRSRKNQLMHESISVLQKKDRALQEQNNQLSKKVKEREKEVAQQNQWEINSSSFVLPQQLDSPHLGEAYQSTNVIDNGEVEGGSSSQQQGAANNTVMPQWMLRHLNN

SEQ ID NO: 1729 - protein, 743 aa, Streptomyces coelicolor A3(2)
MTTPTSPPTPPARGRRRAPSRMERAAGRAAALQRPRVLLALLLLLALTCVMLLDGYLRAEVGGDQRVRTGASASDVPDDVLDGGPILSFPGGQATTVSVPDKTIVLTFDDGPDPTWTPQVLDILEKYDVPGTFFLVGSMVSRHPGIVRDMVEQGNEVGVHTFTHVDLSYQSQARVTREIEQTQLALAGAAGITSTLFRAPYSSQTDAIDNYSWPVYESLGADGYTSVFIDTDSDDWKRPGVSKIVEWATPEDDEGASVLFHDAGGERSQTIEALPKYIEKMKAKGYTFTTVSGVMADQQSHQPQQSQQQGGGLQAAHHRATGATLYEGKALIAAVAVAEWTVPALSVGLVVVGVAVMGRFAMMLVLARRHHRQRNRRRFSWGPPVTGPVSVIVPAYNEKECIEATLRSLARSTHPVEIIVVDDGSTDGTADIAESLGLPGVRVVRQANAGKPAALNNGVRHARYDIVVMMDGDTVFEPDTVRHLVQPFADPSVGAVAGNAKVGNRRTLIGAWQHIEYVMGFNLDRRMYDLLRCMPTIPGAIGAFRREAVLQAGGMSDDTLAEDTDITIALHRAGWRVVYEEHARAWTEAPGSLGQLWSQRYRWSYGTMQALWKHRRSLTDKGPSGRFGRVGMPLVVLFQVVTPVFAPLIDVFTVYSMLFVDFRAALLAWLAVLGVQLVCAAYAFRLDREKYRYLLMMPLQQLAYRQMMYLVLIHSCVTALTGGRLRWQKLKRTGEVGTPAGTG

SEQ ID NO: 1730 - protein, 402 aa, Brassica oleracea
MQSSAVFSASPSLPLLKPGRLSLRHPVTASSNLSVSPPNVVSVPPLPRRSWRLASSDSPLRAWSGLPSVSSPSLDTNRFKTAATAVPEEGEGSGKMTKVLELGLLFAMWYLFNIYFNIYNKQVLKALHAPMTVTLVQFAVGSVLITFMWALNLYKRPKISAAQLAAILPLAVVHTLGNLFTNMSLGKVSVSFTHTIKAMEPFFSVVLSAMFLGEVPTPWVIGSIIPIVGGVALASVTEVSFNWAGFLSAMASNLTNQSRNVLSKKVMVKKDDSLDNITLFSIITLMSLFLMAPVTFFSEGIKFTPSYIQSAGVNVQQIYTKSLIAALCFHAYQQVSYMILARVSPVTHSVGNCVKRVVVIVSSVIFFKTPVSPVNAFGTGIALAGVFLYSRVKRIKPKPKTA

SEQ ID NO: 1731 - protein, 466 aa, GIBBERELLA ZEAE PH-1
MATPYNGTSDHADDGYSSGVSDLNIFYETGHLVFLVTSAVLVLLMIPGVGFFYSGLARRKSALTLILLSMVSVAVISFQWFFWGYSLTFSRTGNAFFGDLTQFGLMETLAQPNGSSALPDILFCLYQGMFAAITPALAIGAVADRGRILPAIVFMFLWSTIVYDPIAYWTWNANGWLFNLPSYDFAGGGPVHVASGTCALAYSLMLGKRTGYNRNNGLPYRPHNVTHVVLGTVFLWVGWFGFNGGSALAMNIRAIMACYVTNLAASCGAIAWILLDYRLEKKWSTIGFCSGAISGLVAITPAAGFVKPWAAVIIGICGGVVCNFATKLKFVMNIDDSLDIFAIHGVGGMAGNILTGIFGTKSIAALDGGEYDPIGWVDSHWVQLGYQIAGTLACFAWSFVLTCLLLFILNLIPGLSLRVAPEEEELGTDDGQLGEFAYDYVEMTRHMADSTHPNSDASARTSHEKV

SEQ ID NO: 1732 - protein, 319 aa, Salmonella typhimurium LT2
MKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRMREAGGYVLFDVNLRSKMWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 1733 - protein, 1218 aa, Oryza sativa
MCDVFIEFGVVDSARQYHHRSGRPPVFLGSDATGNGGEDSGPVTQSSSVPRAAGQLLQYFSLTEKGGQSMAIWALFGPIRSLLRITAQSNQPRPLLRPNLKSYFRPNLSPLRIMAQINQPQLLRPNLKSITNYGPDNKHHALLRPNLGLTKKKQSPFVLFCFFENLRGRTETSLDLSLVDRVMTSAAARRRVYINRVHASPKNPPNPRVKTSGLRTVRASSARRRRRRRRRRRGERWTPRWSRRNGCGGNDAPAAVNGFAPPPPPSAAAAAEEGSKQPFVIGVSGGTASGKTTVCDMIIQQLHDHRVVLVNQDSFYRGLTEEESDRVQDYNFDHPDAFDTEQLLECMGQLKSGLSVNIPIYDFKNHRRCSESFRKVNASDVIILEGILVFHDQRVRDLMDMKIFVDTDADIRLARRIRRDTVERGRDVISVLEQYGRFVKPAFDDFVLPSKKYADVIIPRGGDNHVAIDLIVQHIRTKLGQHDLCKIYPNVYVVNTTFQIRGMHTLIRDRDIATPDFVFYSDRLIRLVVEHGLGHLPFTEKQIVTPTGSTYMGVDFCKKLCGVSIIRSGESMENALRACCKGIKIGKILIHRDGDNGQQLIYHKFPLDIAERHVLLMDPVLGTGSVEFIQCSFHSDVCLLVGMRTTEVTAKVSYHNYSTVQRFPRLKIVTSEIETGLNEEYRVIPGLGEYGDRYFVVIELHANETYICMYCKVHAYGPDNCLRIVEAALLAGNAVVSARSRTRFTSIRPNSFDTRPNYGRFGQRHASQPKPNRARGGEGERRRRGVVVSRQHTHSHAGTPPPPHPLLIAAAVAARPHLSRRLHSLAVAGRRRRPPRAVNSRLGREGVLIYRFYISFRQSTKRRFWGREQQQEAKNMACKVRGDMGKLIPVISFFLGAALTAAFVIATMDINWRLSALASWNNNDSPPAVTDEMKALSELTEVLRNASMDDRTVIMTSINRAYAAPGSLLDLFLESFRLGEGTEPLLKHVLIVAMDPAALARCRQVHPHCYLLRRPEGAVDYSDEKRFMSKDYLDMMWGRNLFQQTILQLGFNFLFTDIDIMWFRNPLRHIAITSDIAVANDYYNGDPESLRNRPNGGFLYVRAARRTVDFYRRWRDARRRFPPGTNEQHVLERAQAELSRRADVRMQFLDTAHCGGFCQLSRDMARVCTLHANCCTGLANKVHDLAAVLRDWRNYTAAPPAARRRGGFGWTTPGKCIR

SEQ ID NO: 1734 - protein, 91 aa, Glycine max
FSHQYLRTVQNTLKKVRRAIIPAAGLGTRFLPATKAMPKEMLPIVDKPTIQYIIEEAVESGIEDIIIVTGKGKRAIEDHFDFAPELERNLE

SEQ ID NO: 1735 - protein, 276 aa, Triticum aestivum
  unsure (1)..(276): unsure at all Xaa locations
MYHPHLQQHRRGGESEAASPGDPSSSMSDPTTAAAACHNPPPAPAPASPKSKRGLPGNPAPEAEVVALSPATLMATNRFVCEXICGKGFQRDQNLQLHRRGHNLPWKLKQRGSKEVVRKKVYVCPEPGCVHHDRSRALGDLTGIKKHFCRKHGEKKWKCDKCAKRYAVQSDWKAHSKVCGTREYRCDCGTVFSRRDSFITHRAFCDALTAPTAKAITGGGLPPPTPAHPQQHAMLYSPATILDASKQQATKEPRRRFEPINQSTKGPWQQAIANRR

SEQ ID NO: 1736 - protein, 389 aa, Zea mays
  unsure (1)..(389): unsure at all Xaa locations
MALHAAAPACAVFCRLPSPSPSHVGGRRSLPAVASPRGVVSAAPLRTRAVPTKAIVNSDGIPETSDSPHVVCFGELLIDFVPTVNGVSLAEAPAFKKAPGGAPANVAVGIARLGGSSAFIGKVGDDEFGYMLADILKQNNVNNQGLLFDPHARTAXLAFVSLRSDGEREFMFYRNPSADMLLEEKELDLDLIRKAKIFHHGSISLITEPCKTAHIAAARAAKDAGVLVSYDPNLRLSLWSSPEDARDGILSVWRTADIFKVSEEEVSFLTNGEDPYDDAVVKKLMHSNLKLLLVTEGPDGCRYYSKDFSGRVGGLKVSAVDTTGAGDAFVAGVLSQLATDFSLLQDEGRLREALKFANVCGALTVTQRGAIPALPTRQQVLDALTNFVA

SEQ ID NO: 1737 - protein, 411 aa, Medicago sativa
MASVGVAPTSGFREVLGDGEIGVDDILPEEMSDMKIRDDREMEATVVDGNGTETGHIIVTTIGGRNGQPKQTISYMAERVVGHGSFGVVFQAKCLETGETVAIKKVLQDKRYKNRELQTMRLLDHPNVVSLKHCFFSTTEKDELYLNLVLEYVPETVHRVIKHYSKLNQRMPMIYVKLYTYQIFRALSYIHRCIGVCHRDIKPQNLLVNPHTHQVKLCDFGSAKVLVKGEPNISYICSRYYRAPELIFGATEYTTAIDVWSVGCVLAELLLGQPLFPGERGVDQLVEIIKVLGTPTREEIKCMNPNYTEFKFPQIKAHPWHKIFHKRMPAEAVDLVSRLLQYSPNLRCQALDCLTHPFFDELRDPNARLPTGRFLPPLFNFKPHELKGVPVETLMKLVPEHARKQCPFLGL

SEQ ID NO: 1738 - protein, 118 aa, Nephroselmis olivacea
VELRGGDKAKWMGKGVLKAVENLNSKIAPALIGKDPRNQRELDDLMNSLDGTENKGNFGANAILAVSMAACKAGAAEKGVPLYQHIADLAGNKKLILPVPAFNVINGGSHAGNKLAMQ

SEQ ID NO: 1739 - protein, 158 aa, Synechococcus sp. PCC 7002
MTQTATDVLRLIQEENIQIIDLKFVDLPGIWQHCSFYQDQLDEASFVDGVPFDGSSIRGWKAINESDMAMVPDPTTAWIDPFCKEKTLSLICSIKEPRTGEWYSRDPRSIAQKAVDYLAASGIGDTAYFGPEAEFFVFDDVRFDQTENKGFYYVDSVE

SEQ ID NO: 1740 - protein, 170 aa, Helicobacter pylori
GSGMHTHVSIWKNNENLFGGETYKGLSEFALHFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQ

SEQ ID NO: 1741 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 1742 - protein, 648 aa, Candida albicans
MSNPEKLQSLQMISIDNANTGRRSTLSSTISSFDADRSLYNSTTSSTGSTSSSPYPRSYHPRDLLNSFIDSFKEFDYSTLPPVYNNITDQESQLQLNPANPNFDYSHFTQLERDALITASSPLSKRLKTRHLTWISLGASIGSGLLISSGSSLAHAGPLGLLIVWIFVGSVIFATMSSLAELATAFPVSGSFTTYVTLFVDKSISFAIAWNYALQWLVTFPLQLVAASLAIEYWTIKIHPAIFVTIFYVCIVFINLFGVYGYAEIEMVVSIIKVIAVIGFNILAIIIVTGGVPGQPYIGAKNWQGPQGGLFNTIEPFKQMCHIVSNVAFAYGGVELFGLAAVETASPKKSINRARKQIFYRLMVFYILSIVMIGFAVSYKTPELQDSGAFGTDINASPFVIAIKQAKIKALPSIMNGAVILTVLSVGNASVYASTRVLCAIGALQQGPKFLSFIDRSGRPMGCLIVQFVFGLLAYLICIPGKNVPAQIFDWLLSLSGLSALFTYISMNVCQLRFNCALKHRARIPKDELLYVSPLWCSWYGIFAIIAILALQFWAALFPPGAGKADVESFFKIYLGGPILFLCWLGHKLYSYWYLNVPLTKFWLTVDEIDIDTGRRQIDLETIKQEIAEEKIVMESKPWWYRLYKTFC

SEQ ID NO: 1743 - protein, 466 aa, Nannochloropsis gaditana
SYAEMGYWDANYTIKDTDVLALFRITPQPGVDPIEAAAAIAGESSTATWTVVWTDLLTACDVYRAKAYKVDSVPGTSDQFFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLIGSVIIMIDLVIGYTAIQSMAIWSRKNDMILHLHRAGNSAYARQKNHGINFRVICKWMRMAGVDHIHAGTVVGKLEGDPLMVKGFYNTLLQTSLNINLPQGIFFEQDWASLRKTLPVASGGIHCGQMHQLLNYLGEDCVLQFGGGTIGHPDGIASGATANRVAMECVLLAKYEGKDYINEGPKILRAAAESCAPLRTALDLWKDIAFNYTSTDTADYVETTTKQ

SEQ ID NO: 1744 - protein, 389 aa, Arabidopsis thaliana
MALSRLSSRSNIITRPFSAAFSRLISTDTTPITIETSLPFTAHLCDPPSRSVESSSQELLDFFRTMALMRRMEIAADSLYKAKLIRGFCHLYDGQEAVAIGMEAAITKKDAIITAYRDHCIFLGRGGSLHEVFSELMGRQAGCSKGKGGSMHFYKKESSFYGGHGIVGAQVPLGCGIAFAQKYNKEEAVTFALYGDGAANQGQLFEALNISALWDLPAILVCENNHYGMGTAEWRAAKSPSYYKRGDYVPGLKVDGMDAFAVKQACKFAKQHALEKGPIILEMDTYRYHGHSMSDPGSTYRTRDEISGVRQERDPIERIKKLVLSHDLATEKELKDMEKEIRKEVDDAIAKAKDCPMPEPSDLFTNVYVKGFGTESFGPDRKEVKASLP

SEQ ID NO: 1745 - protein, 196 aa, Brassica napus
MGRKKLEIKRIENKSSRQVTFSKRRNGLIEKARQLSVLCDASVALLVVSASGKLYNFSAGDDLVKIVDRYGKQHADDRKALDLQSEAPKYGSHHELLELVESKLVESNSDVSVDSLVQLENHLETALSVTRARKTELLLKLVDSLKEKEKLLKEENQGLASQMEKNNLAGAEADKMEVSPGQISDINCPVTLPLLY

SEQ ID NO: 1746 - protein, 449 aa, Pseudomonas aeruginosa UCBPP-PA14
MNMNDDLYSTWLPKLLAAGEIDQADIDRACRDVLAAKYDLGLFADPYRRLGKPDDPPFDTNAESRLHRQAAREVAREGLVLLKNRDGLLPLKKQGRIAVIGPLAKSQRDVIGSWSAAGVPRQAVTVYQGLANAVGERATLLYAKGANVSGDQAILDYLNSYNPEVEVDPRSAEAMLEEALRTARDADLVVAVVGESQGMAHEASSRTDLRIPASQRRLLKALKATGKPLVLVLMNGRPLSLGWEQENADAILETWFSGTEGGNAIADVLFGEHNPSGKLTMSFPRSVGQVPVYYNHLNTGRPMDHDNPGKYTSRYFDEANGPLYPFGYGLSYTEFSLSPLRLSSERLARGDTLEARVTLSNSGKRAGATVVQLYLQDPVASLSRPVKELRGFRKVMLEPGESREIVFRLGEADLKFYDSQLRHTAEPGEFKVFVGLDSAQTESRSFTLL

SEQ ID NO: 1747 - protein, 270 aa, Secale cereale
ERIPERVVHARGASAKGFFEVPHDVSQLTCADFLGAPGVQTPVIVRFSTVVHDRGSPETLRDPRGFAVKFYTREGNFDLVGNNMPVFFIRDGMKFPDMVHAFKPSPKTNMQENWRIVDFSSHHPESLHMFTFLFDDVRIPLNYRHMDGFGVNTYTFISSDGKAHLVKFHWKPTCGVKCLLDDDAVTVGGTCHTHATKDLTDSIAAGNYPVWKVFIQTVDADHEDKFDFDPLDVTKTWPEDIIQLQPVGRMVLNKNIDNFFAENEQLAFCS

SEQ ID NO: 1748 - protein, 362 aa, Saccharomyces cerevisiae
MRSLNTLLLSLFVAMSSGAPLLKIREEKNSSLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDPSEIPEVIILYSYQGLNPELIVKAVKDLGAKGIVLAGSGAGSWTATGSIVNEQLYEEYGIPIVHSRRTADGTVPPDDAPEYAIGSGYLNPQKSRILLQLCLYSGYGMDQIRSVFSGVYGG

SEQ ID NO: 1749 - protein, 474 aa, Centroceras clavulatum
RYESGVIPYAKMGYWDPEYVVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQLGTVIVMIDLVIGYTAIQTMGIWARKNDMILHLHRAGNSTYSRQKIHGMNFRVICKWMRMAGVDHIHAGTVVGKLEGDPLMIRGFYNTLLLTHLDVNLSQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 1750 - protein, 262 aa, Candidatus Blochmannia floridanus
MKNLSIIANWKLNGNKNTITNSLINLTTQLTNIPQYIKIAIAPPILYIDMVKNHLTSYNNKTIELCSQNVDIHLSGAFTGDISASMLKDLSVKYVLIGHSERRIYHKENNSLIAQKFSIIKQTELIPILCIGENKEERDSGSTQSICIQQIDSIIKLVGIKAFENTIIAYEPVWAIGSGSSASPRNVQSIHQFIRNYIAQYDKTIANQISIQYGGSITTDNVLEFITQKDIDGVLVGSASLDIRNLIKIINLSSNLIKKTYQ

SEQ ID NO: 1751 - protein, 323 aa, Clostridium thermocellum ATCC 27405
MFDVVAVGELLIDFLPAGTNENGMPLFSSNPGGAPANVLAMLSKLGAKTAFIGKVGKDGFGQFLKATLDNAGIDTSNLLMSSSEMTTLAFVHLNEKGDRSFSFYRKHCADVSLDAGELDKDLLRTCHFLHFGAVSLTDEPSRTATLEAARIAKEAGAIISYDPNYRPALWSNEHEARKYMLKAVEYADLVKVSEEELWLLAESEDFSKGAHKLLAMGPSVVFVTCGEKGSYVFTGSCKANHCGYDVKVVDTTGAGDAFVGAMLWQLRGMSLEEISQICEQKWGELLAFSNAAGTIVATKKGAIPAMPDLDTINTFMRQFLEEK

SEQ ID NO: 1752 - protein, 646 aa, Triticum aestivum
  unsure (1)..(646): unsure at all Xaa locations
GTRRYVGPAQPPSRAPRGPSYGYRGRVMLAFEENGSSKIGVRFDKQIPDGNDLGGLCEEDHGFFCSAELLRPDFSGSEEVERLAMTELIEVISEESKIGSLIVLLKDVEKSFTGITESFSSLRNKLELLPPGVLIIGSHTQMDSRKEKAHPGGFLFTKFASSSQTLFDLFPDSFGXRLHERNKESPKAMKHLNKLFPNKISIQLPQDEALLTSWKQQLDRDVETLKAKSNIGSIRTFLNRSAIECSDLEELFIKDQSLTNENVDKIVGYAVSYHLKHNKVETSKDGELIITSGSLKHGLDMLQSIHSDNKSSKKSLKDVATENEFEKRLLADVIPPNDIGVTFDDIGALENVKETLKELVMLPLQRPELFCKGQLTKPCKGILLFGPPGTGKTMLAKAVATEAGANFINISMSSITSKWFGEGEKYVKAVFSLASKISPSVIFIDEVDSMLGRRENPGEHEAMRKMKNEFMVNWDGLRTKDKERVLVLGATNRPFDLDEAVIRRFPRRLMVNLPDASNREKILKVILAKEELGQDTDLESLANMTDGYSGSDLKNLCVTAAHYPIREILEKEKKEKNVAKSEGRPEPALHGSEDVRPLSLDDFKSAHEQVCASVSSDSANMNELVQWNDLYGEGGSRKKKALSYFM

SEQ ID NO: 1753 - protein, 145 aa, Oryza sativa
MINPKRLVHLAKKWQHMAALGRRRLTITGATKEGNLRCSSAIADKGHCIIYTADGERFGVPLTYLSTTVFGELLRLSEDEFGFTGEEKITLPCEAAVMEYVMCLLRRKPSEEVEQAVVSSVVMPCNYKSSTSMVSVNLSQSLAIF

SEQ ID NO: 1754 - protein, 273 aa, Melanelia stygia
VEHGDVKVAAVNDPFIEPHYAAYMLKYDSQHGQFKGTIEVKGSNLVVNGQTVKFYTEKDPANIPWKDTGAYYIVESTGVFTTTEKAKAHLKGGAKKVVTPAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIF

SEQ ID NO: 1755 - protein, 426 aa, Phalaenopsis sp. SM9108
MAFSVGLTRFIVSSHPKTAKEILSSPAFADRPIKESAYELLFNRAMGFAPFGDYWRNLRRISSTYLFSPRRVSSFEKQRSEIGEGMVRDMKRMMERNGVVEVRRMLHYGSLNNIMLTVFGKKFDFAKDEGLELELILKEGYELLGIFNWGDHLPLLGWLDLQGVRRRCRTLVAKVNVFVKKIIDEHKRRANGVGIDEGEGEDFVDVLLGLEEKDRLSESDMVAVLWEMIFRGTDTVAILLEWTLARMVLHPDIQSKAQVEIDSVVDSSRPVLDSDIQRLPYLQSIVKETLRMHPPGPLLSWARLAIHDVPVDGHMIPAGTTAMVNMWAITHDECNWAEPNKFNPDRFIDEDVNILGSDLRLAPFGSGKRVCPGKTMALAAVHLWLAQLLKSFKLLPSRNGVDLSECLKMSLEMKNPLVCVAVPRFE

SEQ ID NO: 1756 - protein, 442 aa, Ralstonia eutropha
MPQRHLPESRRPAMNRRQSQPFRTGDVMYQHIKVPAGEKITVNQDFSLNVPDNPIIPYIEGDGTGLDITPVMIKVVDAAVAKAYCGKRKIAWMEIYAGEKSTKVYGLDVWLPDETLEVLKDYVVSIKGPLTTPVGGGIRSLNVALRQTGPDVCLRPVRYFKGVPSRCVSSEKTDMVIFRENSEDIYAGIEWAAESEHAKKLIKFLQDEMGVKKIRFPRTSGIGIKPVSREGTERLVRKAIQYAIDNDKPSVTLVHKGNIMKFTEGGFRDWGYELAHKEFGAELVDGGPWCKFKNPKTGKDIVIKDAIADAFLQQILLRPAEYSVIATLNLNGDYVSDALAAQVGGIGIAPGANMSDSVAMFEATHGTAPKYAGKDYVNPGSEILSAEMMLRHMGWTEAADLIISSMEQSILSKKVTYDFARLLEGATQVSCSGFGQVMIDNM

SEQ ID NO: 1757 - protein, 786 aa, Zea mays
  unsure (1)..(786): unsure at all Xaa locations
MQSDQPVISLRPGGGGGPRAGRLFSPAFATSVSGDFLRPHGGGASGISKIGDSHFEPRERVRYTRDQLLELREIVDVSEEILRIKQEIDVELHGEDQSWVRNDSTVQGQAQAQTQAQNRYAETDSRDWRARSAQLTPTNEEKSWDNIREAKEAYASSGRQQEQANRQDQLSSQFASKAQIGSTXALIKADVPWSARXRGNLSEKERVLKTVKGILNKLTPEKFDLLKGQLMEAGKLLLLDILKDVISLIFEKAVFEPTFCPMYAQLCSDLNEKLPTFPSEEPGGKEITFKRVILNNCQEAFEGASNLRAEISKLTGPDQGMERRDKERLVKLRTLGNIRLIGELLKQKMVPEKIVHHIVMELLGSGPDKKTCPEEEDVEAICHFFNTIGKQLDENPKSRRINDTYFIQMKELTMNPQLAPRLRFMVRDVIDLRSNNWVPRREEIKAKKISEIHSEAEKNLGLRPGAASGIRNGRSSPGGALLPGGAFPMNRPGTGGMMPGMPGSRKMPGMPGLDNDNWEVARSKSMPRGDSIRNQGPLLNKPSTVHKTSSINTRLLPQGSGAALIGKSALLGTGAPPSRPLSFTPGPTPAQTTPKPIRAAPAVVPAPDKQASAPKGNTAELQKKTIALLEEYFGIRILDEAHQCIVELQSPDYYPEIVKEAVNLALDKGTNFVDPLVRLLEHLYTKKIFKTQDLESGCLLYGTLLDDIGIDLPKAPAQFGEIIARLTLLGALRFEVMEEILKKMEDTMYRKAVFDAVKKTLEANPSGQTILGSHAAVIDACNSLLE

SEQ ID NO: 1758 - protein, 540 aa, Streptococcus mutans UA159
MYAHDILNDPFLNKGTAFTMEERKKFGLIGLLPPHIQTLKEQAEQTYAQMQTKANNLEKRLFLMEIFNTNRTLFYYLFSQHLEELNPIVYDPTIADTIEGYSDLFVDPQYAGYLDINHPENIEATLKNAAGDRDIRLIVVTDAEGILGIGDWGTNGVDISVGKLMVYTGAAGIDPVTVLPLVIDAGTNREELRNNPNYLGNRHERVRGERYYDFVDQFVQTAERLFPKLYLHWEDFGRSNAANILEKYRKEIPTFNDDIQGTGIVTLGGIFAAMDITGEKLTDQVYLCYGGGTAGAGIASRVLREMVSEGLPEDEAYKRFFMVDKQGLLFDDMDDLTPEQKPFAKKRADFPNADQLTDLLQVVKTVKPTILVGTSTNPGAFTKEVVEAMCENTERPVIFPISNPTKLAEASAQDLITWSDGKAFVATGIPADTVSYKGVDYVIGQANNALIYPGLGLGMLASEASLLTDEMIGAAAHSLSGIIDITKPGAPVLPPFKYVGDVSIKVAEAVAKKAQEQGLARAEETDMAKAVRDFKWYPEY

SEQ ID NO: 1759 - protein, 395 aa, GIBBERELLA ZEAE PH-1
MGERRKLGDVAMDILLFAGMMTAGLYVARNFLNPILSNIADPDKEKHEQARRQAKAHLERMNRNKRDGLDYGDDSSDSRRGPRPEELVLNEYENLVALEMVPPEDISVGFDDIGGLDTIIEELKESIIYPLTMPHLYSHAAPLLSAPSGVLLYGPPGCGKTMLAKAVAHESGASFINLHISTLTEKWYGDSNKIVRAVFSLARKMQPAIIFIDEIDAVLGTRRSGEHEASGMVKAEFMTLWDGLTSSNSSGMPARIMVLGATNRINDIDEAILRRMPKKFPVTLPGTEQRRRILQLVLQDTKTDPEHFNLDYVSRITAGLSGSDIKEACRDAAMVPVREYMRQHRESGKAMSTVDPKQFRGIRSDDFLGREGGQIKMQSTRQTSGVEELIAEDQD

SEQ ID NO: 1760 - protein, 197 aa, Glycine max
MDFSSVRAALDSKSYDKVADVCDNLMLQVAAEGIAYQDDWPYTIHLLSHIYVHDINSARFLWKSIPSSIKESQPEVTAVWKIGQKLWLRDYAGVHEAIRGFDWTQELQTLVAAFSELYTKEMFQLLLSAYSTISIKDTALFLGMNEDDATNYVLQQGWTVDPASQMLIVKKQPVVTEQKLDPSKLQRLTEYVFHLEH

SEQ ID NO: 1761 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 1762 - protein, 220 aa, Crypthecodinium cohnii
MADILEAVIGEPMEPTEPTAEPMQETDLPDNAEDLPEEVAASVTAFTIMAKFNLRCEIDLRQLAFALRHAEYNPRKHSSLTLRLVEPRATAMVRSSGVVSITGVLDLDELKQSAKKVARLVQRSGEGHEKVKFAGFTICSILAKASMGFPIRLDQLAAKWRRNALYEPELYCGCIFRTTRPKCTYLLTSGGKVMISGFRNMEDVHEAVQRIYPILAEFKT

SEQ ID NO: 1763 - protein, 163 aa, Escherichia coli
AGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 1764 - protein, 398 aa, Ralstonia metallidurans
MPYTQRQQRSQDAAPHRTPRTTREQPQGDNHMGTVARFEIGFTRYLSPDGSPEPDLPDFARDPATLLPLYRAMVLTRQFDLKAIAMQRTGQIGTFASALGQEAIGVGVATAMRRDDVLVPSYRDHAAQFVRGVTMTESLLYWGGDERGSAFAAVPYDFGNCVPIGTQVGHAAGVAYTFKLRQAPNVAVCILGDGGTSKGDFYEGMNMAGAWHVPLVIVINNNQWAISMPRAKQTAAATLAQKAIAAGIPGEQIDGNDVIAVRQRVGAAIEHARHGGGPTLIEAVSYRLGDHTTADDASRYRDEASVKEAWRCEPIIRLRDYLARLGAWDAAQEEALIKECQQAVGAAVQAYLALPHPDASAMFDCLYETLPDAMAEQLDTARQYDASGKTDTSGAHHG

SEQ ID NO: 1765 - protein, 237 aa, Glycine max
MEGSKENCVPRIPLIPSSNLQGPRMKPLLHHRLPLGNISQNVNMPHSQVNKLDLSRKCTAHTIQHHFPQETKKQNLLAPNPSCKLDCDIVDIDDDDGDGSDDAVPVFVKHTEAMLDEIDKIEEVEMEDVEEEPVLDIDACDRKDPLAVVEYIDDIYSFYKDIENSSCVSPNYMTSQLDINERMRAILIDWLIEVHYKFELLEETLFLTVNLIDRFLERQAVIRNKLQLGGVTAMLIA

SEQ ID NO: 1766 - protein, 149 aa, Glycine max
  unsure (1)..(149): unsure at all Xaa locations
TKFVQFPLMTSVVHSNYXDCTRWLGDFILSKSVDNEIVLWEPKIKEQGPGEGSIDVLQKYPVPDCDIWFIKFSCDFHFNQLAIGNREGKIYVWEVQASPPVLITRLSSPQCKXAIRQTAVSFDGSTILACGEDGXIXRWDEVEHXAAXN

SEQ ID NO: 1767 - protein, 212 aa, Brassica oleracea var. acephala
VTLLLAAAVCTHGKEHVKDSNGNPVKRGAKYFIQPAKSNGGGLVPAAINLLPFCPLGITQTLLPYQPGLPVRFGYEPVIVGTDYIYTSTTINIKFESDIWPVCNELSKLWAADVSSSTAKEPAIIIGGERTAPNSLFKIEEATGAHTYKLTTSSGTVGTIPGPWLGAPQLIATNDDAKTLFVKFVKVDDDATKATTSTSRVEKLGLRMFPFY

SEQ ID NO: 1768 - protein, 179 aa, Glycine max
  unsure (1)..(179): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELKHSFIYHKHNKSPEYYDRHYXPYXKLPIFNYTNTSQVLKELQEAKTTYPNHFIHIIKFNNXVRQVQYIIFITYKPPSF

SEQ ID NO: 1769 - protein, 308 aa, Zea mays
MAPSRPLMRGIRPPRVFPTRGGRASPYAVALTALLLVSAALLALIAFGVFSLPVSAPNAAATTTAGGETESADTRPARPRARRDLGEGLGERGAQWTEVISWEPRAFVYHNFLSKEECEYLIGLAKPHMVKSTVVDSTTGKSKDSRVRTSSGMFLQRGRDKVIRVIEKRIADYTFIPVDHGEGLQVLHYEVGQKYEPHFDYFLDEFNTKNGGQRMATLLMYLSDVEEGGETIFPDANVNVSSLPWYNELSECAKRGLSVKPKMGDALLFWSMKPDATLDPLSLHGGCPVIRGNKWSSTKWMHIHEYKA

SEQ ID NO: 1770 - protein, 69 aa, Zea mays
LLEQFGNVWHPSRVRKYLTQDDWSPTETKGRPWFGLLALLRKYPEHFVINTRSKGRMTSEFVSLVSLLS

SEQ ID NO: 1771 - protein, 382 aa, Shigella flexneri 2a str. 2457T
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLASEQSAAICEELANFDYLYLSGISLAILSPTSREKLLSLLRECRAKGGKVIFDNNYRPRLWASKEETQQVYQQMLECTDIAFLTLDDEDALWGQQPVEDVIARTHNAGVKEVVVKRGADSCLVSIAGEALVDVPAVKLPKEKVIDTTAAGDSFSAGYLAVRLTGGSAENAAKRGHLTASTVIQYRGAIIPREAMPA

SEQ ID NO: 1772 - protein, 443 aa, Escherichia coli K12
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 1773 - protein, 439 aa, Triticum aestivum
  unsure (1)..(439): unsure at all Xaa locations
MANNGSSSRRGDDGVGVGATPSRWRFFRPTAGTPLAAAGSMSIRSVLNRLNSSVDASGTRPVVPLGHGDPTSSACFRTAPEAEDAVVDALRSRKHNGYSPTVGVPQARSAIAGXCLENLPYELSPDDIYLTSGCVQAIEIMISVLAHPGANILLPSPXFPMYESRTTFSELEVRYFDLVPERGWEADLESVKAIADENTVAMLIINPSNPCGSVYSHDHLAQIAETAGELGILIIADEVYDHLAFGIKPFIPMGVVGKTVPVITLGAISKRWLVPGWRLGWIATCDPNGILKETKIDQSIQNYINITSDPATFIQGAVPXQIIANTKEEYFNKILDLLRNSADLCYGKIKDIRGITCPHKPEGSMFVMAKLDLSCLDGFSDDIDFCCRLAKEESVIVLPGTALGMKDWVRITFAIDLPSLEDGLERLKSFCERHARVEA

SEQ ID NO: 1774 - protein, 230 aa, Synechocystis sp. PCC 6803
MSKNIVVAPSILSADFSRLGEEIKAVDEAGADWIHVDVMDGRFVPNITIGPLIVDAIRPLTKKTLDVHLMIVEPEKYVEDFAKAGADIISVHVEHNASPHLHRTLCQIRELGKKAGAVLNPSTPLDFLEYVLPVCDLILIMSVNPGFGGQSFIPEVLPKIRALRQMCDERGLDPWIEVDGGLKPNNTWQVLEAGANAIVAGSAVFNAPNYAEAIAGVRNSKRPEPQLATV

SEQ ID NO: 1775 - protein, 352 aa, Xanthomonas campestris pv. campestris str. ATCC 33913
MLPVHRVLRHLGLASARRTGGGARMSAAKNQVVCFGEALIDMLALPPAGPDEARTFAQYAGGAPANVAVAVARLGGAAHFVGMLGRDMFGDFLLESLQQAGVVTDGIVRTDEAKTALAFVALDAAGERSFSFYRPPAADLLFRAEHFAADGFAQAAVLHVCSNSMTEPAIARCTLDGMRRARADGAIVSLDLNLRPMLWPQDVDPAPLLWEALALADVVKLSREELDYLAGTLDSDASAVTQKLWQGHARWLLVTDGGGPVHWQTRVDSGQVPAFHVQVRDSTAAGDAFVGGLLFQLAARASTLEQLCADPAAIAEVIRFAAAVGALAVTRKGAFAAMPSVDEVHSLIQEQS

SEQ ID NO: 1776 - protein, 366 aa, Glycine max
MGLRSKLRMSASVVQQGMKEIRRSVTYMPRPGDGAPRGVTLIPGDGIGPLVTHAVEQVMEAMHAPIYFEKYDVHGDMRRVPEEVLDSIRKNKVCLKGGLRTPVGGGVSSLNVQLRKDLDLYASLVNCFNLPGLPTRHHNVDIVVIRENTEGEYSGLEHEVVPGVVESLKVMSKFCSERIAKYAFEYAYLNNRKQVTAVHKANIMKLADGLFLESCRHVATKYPGIKYNEIIVDNCCMQLVSKPEQFDVMVTPNLYGNLVANTAAGIAGGTGVMPGGNVGADHAVFEQGASAGNVGKEKMVEQKKANPVALLLSSAMMLRHLQFPSFADRLETAVKRVISEGNCRTKDLGGDSTTQQVVDAVIANLD

SEQ ID NO: 1777 - protein, 214 aa, Oryza sativa
MAPVRLGAPTSGALLLLVLLLICGGGGGGGVAAGGGGGGGGGKGSSVYPAPVVYPHHSRQISWKPRVFLYQHFLSDDEANHLVSLARTELKRSAVADNLSGKSELSDARTSSGTFIRKSQDPIVAGIEEKIAAWTFLPKENGEDIQVLRYKHGEKYERHYDYFSDNVNTLRGGHRIATVLMYLTDVAEGGETVFPLAEESQNYGHVWEAEDSEK

SEQ ID NO: 1778 - protein, 111 aa, Methanothermobacter thermautotrophicus str. Delta H
MTDLEEIRRKKMLELQQKAQQQAMEAEAQEQMRQQLEMQKKQIMMQILTPEARSRLANLRLTRPDFVEQIELQLIQLAQMGRVRSKITDEQLKELLKRVAGKKREIKISRK

SEQ ID NO: 1779 - protein, 836 aa, Geobacter metallireducens
MKAVIMAGGFGTRIQPLTSSIPKPMIPLLNRPIMLHIVELLKKYEITDLVMLLYHQPAVIKNFFRDGTDFGVKITYVTPLQDMGTAGAVKCAEKFLDERFLVISGDLLTDFNLQKIIDSHEDNKALATITLTSVKDPLQFGVVITDKEKRITQFLEKPGWGEVISDTINTGIYVFEPEIFAHIPEEENYDFSQDLFPKLLEQQKPLFGYTAKGYWRDIGNTDSYREAHHDIFKGKVNVKIDEAKQDLVGKDLRLGSDVNLDEHVTLEGTVVVGDNSQVFESAHIKDTVIGRNCTIEPGVRLNRCVIWDNVYVKKGAKLNDGVLCSNVRVGHGVVMEEGVIVADDTSIGEEAYIKRDVKIWPRKVIEAGATVTGNLIWGEKWKKSLFEGAMVKGLTNMELTPEFVAKLGCAYGTMLPKGSHIISGRDSYRSCRMLKRSFIGGLLSAGINVRDLTMVPMPVLRYKLRTFGEVGGIYFRQAIDDPASTEIVFLDGDGLDFSSSMGKNVERIFFKENFRRAHHTEPGALSEIPQQVTDFYREGFLHTIGKSPLQKKQFKVVIDFNHSSASQLLPGILTQMGCEVISLNAYVDEERGIQAVAERQQSLAQLSKIVATLEASAGFWLDPGTEGVIVVDETGKVYEGAELLPLMVGLALRSGEKGLFAVPVSAPSAIERMVQERGSAVTRTKSADRAMIEATLSSEVVLAGTMDGRFAFPKFQSAFDGMFAIAKTIELVAKGGLSISRVAAEIPQRVFLQTRVPCVWDMKGGIMRKMSEDSLDKEASFIDGIKVHFGEDWALVLPDQYLPYVHIVAEARDAKTAQKLLDEYKKKVEGWKRELQ

SEQ ID NO: 1780 - protein, 161 aa, Zea mays
  unsure (1)..(161): unsure at all Xaa locations
MSQQRTARRLPSLLVDPAQETVRRRCRDPINVENLLPSKIRINLEENVQYVSMRKALKVKRPRFDVSLVYLTRKFMDLVRSAPGGILDLNKVATKLGVRKRRVYDITNVLDGIELVEKKSKNHIRWIGSDLNXFGAAPQQKKLQAELSDLSAMEDALDELI

SEQ ID NO: 1781 - protein, 193 aa, Mitthyridium sp. Wall 3785
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYHAIKAALKEASQGKMKGILGYTEDDVVSSDFTTDSHSSIFDAMAGIALTEYI

SEQ ID NO: 1782 - protein, 864 aa, Cryptococcus neoformans var. grubii
MPRQQSEDEHRICGQAFRSPRSPQGNPLERNSKLEDEEELDLIRRYEDFSTVDWIQDSLHERTFQNKAPRSRVIAQLDRSDGAIGYLWRLIRRTLEEGEAYVVISLVGVIIGVSAALISIITTWLSDIKLGHCTTGWWLSRKFCCLEVSDELEACAEWKNWGGVEPFRWIAYVLFAAAFSFSAAYLVKNFAPYAAGSGISEIKCILGGFIINGFLSVETFFIKGLTLPLAIASGLAVGKEGPSVHVACSVGNVVAKWFNRYERSHLKMREIVTASSAAGVAVAFGSPIGGVLFSIEEMNQTYSNRTMWRSFVCALVATFTLASMDPFRTGKLVIFNVSYDRDWHYFEIPAYVLIGIFGGLYGAFVIKFNVQMAAFRRKHLSGHGIFEAVALASITAIIGYLNGFLRIDMTEMLSVLFRECEGGGDYNGLCQASSQWRMVNSLLLATIIRTVFIIVSYGCKVPAGIFVPSMAVGATFGRMIGILVKAMYNSYPSAPWFAACAPDAPCITPGTYAFLGAAAAMGGITRLTVTVVVIMFELTGALTYILPTMIVLLVTKAVSDQFGGGGISDHMIKFNGYPFLEKEDKEDPTDHAFIEPIANVMKKDLIILEATGVPLNHVVDIVQHTNYQGFPVVKSHEDQTIVGFVRKNELRIALEKTRRVRNLSFNATCTFQCIRAIPEDAHELLERPDILIPNREGRMTANTGTENREDDGGEISHVDFGQYVDDIPLTVAPKMPLEIVMQLFRRMGPRVILVSDQGRLTGLVTVKDVLRHELSEAHHRSRSTHTPITPSHPAYAQSNGWDTEWTVDDERGHGLEIVLEEGLEWTRSKATWAYGAALERWRDIRGQDRRAATFDYELDEGIQG

SEQ ID NO: 1783 - protein, 796 aa, Corynebacterium callunae
MSPEKQPLPAALVGSHVRAAAGTPADLATDRKFWTGLSRAVQERIADDWERTREAYGAARQQHYFSAEFLMGRALLNNLTNLGLVDEAAAATRELGHELTDILEIENDAALGNGGLGRLAACFLDSAVTQDYPVTGYGLLYRFGLFRQSFNEGFQVEKPDPWREEEYPFTIRRASDQLVVCFDDMKTRAIPYDMPITGYGTHNVGTLRLWKAEPWEEFDYDAFNSQRFTDAIIERERVSDICRVLYPNDTTYEGKKLRVRQQYFFTSASLQAMIQDHLAHHKDLSNFAEFHSVQLNDTHPVLAIPELMRLLMDEHDMGWEESWAIVSKTFAYTNHTVLTEALEQWDEQIFQQLFWRVWEIIAEIDRRFRLERAADGLDEETINRMAPIQHGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYKPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 1784 - protein, 184 aa, Arabidopsis thaliana
YPYIAGMGVYVFRKEGLLKLLRSSYPTSNDFGSEIIRARRKLHNVQAFLFNDYWEDIGTIGSFFDANLALTEQPPKFQFYDQKTPFFTSPRFLPPTKVDKCRILDSIVSHGCFLRECSVQHSIVGIRSRLESGVELQDTMMMGADFYQTEAEIASLLAEGKVPVGVGQNTRIKNCIIDINARIG

SEQ ID NO: 1785 - protein, 337 aa, Zea mays; identical to SEQ ID NO: 717

SEQ ID NO: 1786 - protein, 1465 aa, Adiantum capillus-veneris
MATPGGPKTKHSVSVAQTRADARLHAAFEGSGDAGAGGSRAPFDYSKSGMDASSVTSVAPEAITAYLQRMQRGGLTQAFGCMLVVAGQKIVAFSENAPEMLEVAAGLGTDLRMLFTQGSTAALDQAVKEEDLSSVNPLVLQSCGGSAKQFYAMLHRIEDVAGVVIDLEPIENGVVEKKSSAEMAVKPIARVQSLPGGEIGRLCQVVVEEVQEMTGYDRVMAYKFHEDGHGEVVAEVRRPDLEPYLGLHYPSTDVPQASRMMFMKNGVRMIGDCTLPPVRVVQAKELAQPISLAGSTLRAPHGCHAQYMSNMGSAASLTMAVAIDDYDDDSSLSCGSRKLWGLVVCHHPSPRTVSYPLRCACEKLMVAFGVQLNIELDLAAQLRENHILTTQALLCDMLRRIRGAPIGIVSRSPSIMDLVKCDGAALYYGGRFWPLGTTPSEFQIRDLAEWLLGASEEIASTGVTCTDSLAEMGYPGAALLGDAVCGMAAAMITPNSDFLFWFRSHTAKEVYWGGAEHDPQSRDDDSWMQLPRSSFKAFLEIVKRRSLPWEEVEVDAIRSLQLILREDLEQFCAAVGAVKASDGDDEDSLVPSAKKLSLKETEENGGADNSKKLERMHSAAAGGGGGGGRWEKMRLPSSLAQEWMEAIRGTGDGGASGGGGGGPFDWDLISAFQHNSFIVVDALKPDFPIIYASTGFFNLTGYTSREVIGGNCRFLQGPDTNPADVASIREALAQGTGTFCGRLLNYRKDGSSFWNLLTIAPIKDDLGSIVKLIGVQLEVSKYTEGIRANNRRPNGMPQSLIRYDVRHQDKVSAFIAQLVAALTKPDKVETPRLSSAMRFSLTGQTIESLPQPTAIPREGGGRTRRPRSSSFLSLLGMEKEKDIPEEDELQELEVIMLEDASVGRPGSLDDPERTRRGIDLATTLERIGKSFVITDPRLPDNPIIFASDRFLELTEYTREEVLGNNCRFLQGRGTDRKAVQLIRDAVKEQRDVTVQVLNYTKGGRAFWNLFHLQVMRDENGDVQYFIGVQQEMVAPRPVHQPPELPDILPDRVEQEKAEVVRATAQRVDAAARELPDANLVPDHLFAPHSKVVTPLPHSKTNSSSWFAIRRVQRRLSRGERLGLKHFRPIKPLGSGDTGSVHLVELRGTGQVFALKAMDKSMMLQRNKVHRARAEREILAIMDLPFLPTLYASFQTKTHVCLITDYCPGGDLFLLQDKQPTQTLSERTASFYAAEVVVALEYLHCMGVIYRDLKPENVLLQKNGHILLTDFDLSFLTSCRPQLILQGGKGRSRRSKRRRRVTFCAEPRVSSNSFVGTEEYIAPEIISGEPHSSAVDWWALGILLYEMLYGRTPFVGRNRQKTFYNVLNKELIFPTSIPVSLAGRQLIAGLLQRDPTIRLGTLRGASELKKHPFFREINWPLIRWRKFSANQAHNANNVSSLDEGESDSGNAWEANGGSTQSFQDTF

SEQ ID NO: 1787 - protein, 600 aa, Saccharomyces cerevisiae
MKITEKLEQHRQTSGKPTYSFEYFVPKTTQGVQNLYDRMDRMYEASLPQFIDITWNAGGGRLSHLSTDLVATAQSVLGLETCMHLTCTNMPISMIDDALENAYHSGCQNILALRGDPPRDAENWTPVEGGFQYAKDLIKYIKSKYGDHFAIGVAGYPECHPELPNKDVKLDLEYLKQKIDAGGDFIITQMFYDVDNFINWCSQVRAAGMDVPIIPGIMPITTYAAFLRRAQWGQISIPQHFSSRLDPIKDDDELVRDIGTNLIVEMCQKLLDSGYVSHLHIYTMNLEKAPLMILERLNILPTESEFNAHPLAVLPWRKSLNPKRKNEEVRPIFWKRRPYSYVARTSQWAVDEFPNGRFGDSSSPAFGDLDLCGSDLIRQSANKCLELWSTPTSINDVAFLVINYLNGNLKCLPWSDIPINDEINPIKAHLIELNQHSIITINSQPQVNGIRSNDKIHGWGPKDGYVYQKQYLEFMLPKTKLPKLIDTLKNNEFLTYFAIDSQGDLLSNHPDNSKSNAVTWGIFPGREILQPTIVEKISFLAWKEEFYHILNEWKLNMNKYDKPHSAQFIQSLIDDYCLVNIVDNDYISPDDQIHSILLSL

SEQ ID NO: 1788 - protein, 462 aa, Lactobacillus gasseri
MKLNPFRKESLKRYLGTDKHFAKTLGAFDLLTIGIGAVIGTGIFILPGTVAAKEAGPGVTLSFLVAALVCTLASMCYAELSSSIPVAGSAYSYGNILYGEVIGWILGWALILEYMLSVAAVSAGWASYFNSLLHSFGLHTPHHFEGPFDPLNGTYLNLWAVISVLLIGILLSRGMKTSMKFNNAAVLIKIAIIFIFIGVGLFFIKPKNYHPFTPYGTTGVLRGATTVFFAFLGFDVVSSSAAEVKNPKKNMPIGIIGTLIVAALLYMGVSVVLTGMVNYKQLDVANPVAYALKLVNQGWVADLLSIGAIVGMSTMMLTMIYSSSRLIYSIGRDGLLPNFLGKIDKHGLPENALWIVTIVIALMGGLFSLEELTSLVSIGTLLAFTFVSFGVILLRRRKDIPEGNFKVPLYPVIPILSGLACIGMMCFLSVKTYLFAGIWFLFGLFIYCVYGYKHSKISKKNN

SEQ ID NO: 1789 - protein, 201 aa, Zea mays
  unsure (1)..(201): unsure at all Xaa locations
MTMAGSCAAPPVACLPSLRTLPPTHVRLSGFLPCSSAARSRGAAVLGCALGTKRQTPGVLNRLFCGYMQRDGHEGDVSCQGRDDTVMFGPDDDGVKIPTQVETLVKGTAMVAEPEYKASPDLDYLQELLAIQQQGPRAIGFFGTRNMGFMHQQLIEILSYAMVITKNHIFTSGASGXNAAVIRGALRAEKXELLTVIYPQS

SEQ ID NO: 1790 - protein, 281 aa, Eremothecium gossypii
MQLYICHRDRDQTQVPSAGGSVKEAIRMVLEATVLVVDNSEYSRNGDFPKTRFEAQIDAVEFIFQAKRSSNPENTVGLISAAGSSPRVLSTFTAEFGKILAGLHDTTVGGSIHLSTAIQIAALTLKHRQNKVQHQRIVVFVCSPISDEREELVRLAKKLKKNHIAVDIVNFGEEAANTAILEEFVAAVNNSQEDNSHLLTVSPGPRLLYEHIASSPIVLEEGATAPGMGAFGGDDYMDFAVDPSMDPELAMALRLSMEEEQARQERLRQEQDAKGKSEEQH

SEQ ID NO: 1791 - protein, 212 aa, Phytolacca americana
SVLCDAEVALIVFSTKGKLFEYSTESSMEAILERYERYSYAEKQLVATDSESQQQGSWAMEYPRLISKLEVLQRNMRHYVGQDIDSLALRELQHLEQQIDTALKRIRNRKNQVMHESISQFQKKEKAMQEQNNLLVKLVKEKGKTQVIEEENPSQALMLSSSNPLSFPSLSIGGSYQERTEMGVEQVHYQGQGQVVPPNSNTTMPPWMLRHL

SEQ ID NO: 1792 - protein, 366 aa, Arabidopsis thaliana
MNSKFRYNKPKGKKQKKKKKALDSESQIKKPTMPIKVLSSLDVARTQWYHFKAIIVAGMGLFTDAYDLFCIAPVMKMISHVYYNGDSINTAVLSTSYAIALLGTATGQLVFGYLGDRVGRRRVYGLCLIIMILSSFGCGFSVCTTRRSCVMVSLGFFRFFLGLGIGGDYPLSATIMSEFANKRTRGAFIAAVFSMQGLGILVSSAVTMAVCVAFKRSGGGLEVDAAAPTEADLAWRLILMIGALPAALTFYWRMLMPETARSGKLYTVAIDPLLISDFDKVGWAFQLLAIKPKTDQNAPDDLTKLNPVCTYGPRRWNPSEPGSYVHCSSTRNALNDFSVSANLTLEIGIKNFKNWLGLEVFNAKKF

SEQ ID NO: 1793 - protein, 182 aa, Pseudomonas fluorescens PfO-1
MVFDSFDIKSLIRPVIDFPKPGVIFRDITPLFQSPKALRLVMDSFAHRYVEADFTHIGAMDARGFLIGSVLAYQLNKPLVLFRKQGKLPADVLAEGYATEYGEAFLEVHADSLCEGDSVVMFDDLIATGGTLIAAANLIRRMGARVHEAAAIIDLPELGGSQRLEDMGIPTFCLTQFALTDK

SEQ ID NO: 1794 - protein, 169 aa, Cytophaga hutchinsonii
MKNKLTSIFLTAGLLMSLTACSQQKAQPIKKTDTIQATSNMPLMPIKDQSNYNPLTPEEKYVIINKGTERPFTGKYYNFKEPGTYICKQCNAPLYRSSDKFDSHCGWPSFDDEIPGAVTRVPDADGRRVEIICTNCKAHLGHVFEGERMTDKNVRHCVNSISIEFVPVK

SEQ ID NO: 1795 - protein, 661 aa, Oryza sativa (japonica cultivar-group)
MLQVEEALAAVLSAAAASAAARAAEAVPLHDALGLVLAEDVRAPDPLPPFRASIKDGYAVVASDGPGEYPVITESRAGDDALGVVVTPGTVAYVTTGGPIPDGADAVVQVEDTEQLAGAPDGSKRVRILVRPTQGQDIRNVGCDIQKDSVVLKSSEHIGPAEIGLLATVGVTTVKVYRRPTIAVFSTGDELVEPATASLSRGQIRDSNRAMLIAAAIQHKCKVVDLGIAKDTEESLKEHMDAALSSDADIILTSGGVSMGDRDLVKPCLASMGKIHFEKIRMKPGKPLTFAEIVTEDSSKPSKKVLAFGLPGNPVSCVVCFNLFVVPAIRSLSGWSNPHLPRVHARLLHPLRGDPHRQEFHRAVIRWVPDDGSGRPGYVAESTGQQASSRLLSMKSANALLEVPLVGQMLEAGTSMQAILISDMTSSPFDKLPTASNPLPSHLFPSAKSVSTDLSQVPASQNTEVKVAILTVSDTVSLGAGPDRSGPRAISVVNSSSEKLGGATVVATAVVPDDVEKIKNILVKWSDIDRVSLILTLGGTGFTPRDVTPEATKSVIEKEAPGLTYVMLQESLKVTPFAMLSRATAGIRGSTLIINMPGNPNAVAECMEALLPALKHALKQIKGDKREKHPRHVPHAEAAPVDQWDRSFRAASSGRGCSCEP

SEQ ID NO: 1796 - protein, 275 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQLGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSA

SEQ ID NO: 1797 - protein, 514 aa, Salmonella typhimurium LT2
MKIRSQVGMVLNLDKCIGCHTCSVTCKNVWTGREGMEYAWFNNVETKPGIGYPKNWEDQQEWQGGWVRDVNGKIRPRLGGKMGVISKIFANPVIPQIDDYYEPFTFDYQHLHNAPESKHQPTARPRSLIDGKRMDKVIWGPNWEELLGGEFEKRARDRNFDNIQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEHETDLYERQCDVFLNPHDPAVIEEALKQGIPQNVIDAAQRSPVYKMAMDWKLALPLHPEYRTLPMVWYVPPLSPIQSYADAGGLPHNGNILPAVETLRIPVQYLANMLSAGDTGPVIRALKRMMAMRHYMRSQTVEGVTDTRAIEEVGLSIQQVEEMYRYLAIANYEDRFVIPTSHREMARDAFPERNGCGFTFGDGCHGSDTKFNLFNSSRIDAINITEVRDKAEGE

SEQ ID NO: 1798 - protein, 175 aa, Oryza sativa
MELSVVGGEPLLAVAMQQLLDLDLPDELERQLNPPTRAYVRDRRAMANTPMDVKELRASGALVLAVDMPGVAPADVRVEVEDGNVLAISGERRRPAGDGDDGGEGVKYLRMERRMGKFMRRFPLPESADLDGVRAEYKDGVLTVTVDKKPPPEPKKPRVVEVKVAGAGEPKGKGK

SEQ ID NO: 1799 - protein, 351 aa, Corynebacterium efficiens YS-314
MQLVPQLLFALAHGLKDIPYFRWGTGFGQTPAGRVVSMSLSIKEHVNAVKTVVVPAAGMGTRFLPATKTVPKELLPVVDTPGIELIAEEAAKLGATRLAVITAPNKAGVLAHFERFTELEATLEERGKTDQLQKVRRAAGLIDAVPVTQEHPLGLGHAVGLAESVLDADEDVVAVMLPDDLVLPFGVMERMAQVRAEFGGSVLCAVEVADDEVSNYGIFRVENADDNGADQDVKRVTGMVEKPAVEDAPSNLAATGRYLLDRSIFDALRRITPGAGGELQLTDAIALLIDDGHPVHIVVHRGKRHDLGNPGGYIPACVDFGLDHPVYGPQLRRALAQIMVDHGVVDASAIR

SEQ ID NO: 1800 - protein, 446 aa, Enterococcus faecalis V583
MTRKAKTAEEIKHIAEEENVRFLRLMFTDIMGTIKNVEVPVSQLDKVLDNKMMFDGSSIEGFVRIEESDMYLYPDLSTWMIFPWESDHGKVARLICDIYNPDGTPFAGDPRGNLKRALADMKELGFTSFNLGPEPEFFLFKLDENGEITTDLNDKGGYFDFAPTDLGENCRRDIVLELESLGFEVEASHHEVAPGQHEIDFKYADVVDACDNIQTFKLVVKTIARKHGLHATFMPKPLFGINGSGMHCNMSLFNEEGNVFYDESGEMGLSQTAYHFLGGLLKHARAYTAVCNPTVNSYKRLVPGYEAPVYVAWSGRNRSPLIRVPESRGLSTRLELRSVDPSANPYLTMAVLLQAGLDGIRNELTPPPAVDRNIYVMNEEERQHAQIEDLPSTLHNAIKELRKDQVMIDALGRHIFANFVEAKRMEWAAFRQTVSEWEREQYLELY

SEQ ID NO: 1801 - protein, 397 aa, Desulfovibrio vulgaris subsp. vulgaris (strain Hildenborough)
MSQSQFPRMHRLPPYVFAVVNELKMQLRRQGVDIVDLGMGNPDMPTPQHIVDKMVEASMKGNNHRYSVSRGIPNLRKAICDWYTRRFGVYLDPDTEAVVTMGAKEGLSHLSLAMLSPGDVVFAPDPTYPIHTYAPVIAGADVRRIPIGRGRDFFEDLLVATRQTWPQPKLLFLSYPHNPTTELATPEFFQKVVDFAKEHKIYVIHDFAYADLAFDGHMPPSFMQADGAKDVGVEFFSMSKSYSMAGWRVGFCVGNREMVNTLTRIKSYLDYGIFQPIQIAATVALNGPQECMTEIVDTYRKRRDVLIEGLNRSGWEVPAPKGTMFVWAQIPEPFRAMGSVEFSKLLLREAHVAVSPGLGFGAHGDDHVRFALIENEQRTKQALRGIRHLLSGKPCGE

SEQ ID NO: 1802 - protein, 247 aa, Glycine max
SARAEGVDIMLIRELTGGIYFGEPRGFGTNDNGEEIGFNTEIYATHEIDRIAHFAFKVAQKRRRKLCSVDKANVLEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 1803 - protein, 524 aa, Lycopersicon esculentum
MDTCCAAMKSTVHLGRVSTGGFNNGEKEIFGEKIRGSLNNNLRINQLSKSLKLEKKIKFGEAYSVITIENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIIAEKATIRDGTVI

SEQ ID NO: 1804 - protein, 472 aa, Escherichia coli O157:H7 EDL933
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 1805 - protein, 373 aa, Candida maltosa
MSVKTKTITILPGDHVGTEIVNEAIKVLEAIEAATPYQKIHFDFKHHLIGGAAIDATGVPLPDDALESAKKSDAVLLGAVGGPKWWTGALRPEQGLLKIRKELNLYANIRPCNFASDSLLELSPLRPEVVKGTNLIIVRELVGGIYFGDREEQEESEDKQTAWDTEKYTVDEVTRITRMAAFMPLQDNPPLPIWSLDKANVLASSRLWRRTVDKVISEEFPTLSVQHQLIDSAAMILIQNPTKLNGIIITSNMFGDIISDEASVIPGSLGLLPSASLASLPDTNTAFGLYEPCHGSAPDLPANKVNPIATILSAASMLRLSLDCVKEAEALEEAVKQVLDKGIRTADLRGTRSTTEVGDAIVEAVTKILKEKA

SEQ ID NO: 1806 - protein, 344 aa, Synechococcus sp. PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREAYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 1807 - protein, 382 aa, Oryza sativa
MAEQANQPTVLQKFGGQFHLGSSFSEGVRARNICPSVSSYDRRFTTRSYMTQGLVNGGINVPMMSSSPIFANAPAEKGGKNFMIDFLMGGVSAAVSKTAAAPIERVKLLIQNQDEMIKAGRLSEPYKGIGDCFGRTIKDEGFASLWRGNTANVIRYFPTQALNFAFKDYFKRLFNFKKDKDGYWKWFGGNLASGGAAGASSLFFVYSLDYARTRLANDAKAAKGGGERQFNGLVDVYRKTLKSDGIAGLYRGFNISCVGIIVYRGLYFGMYDSLKPVVLYGSLQDNFFASFALGWLITNGAGLASYPIDTVRRRMMMTSGEAVKYKRYMDAFSQILKNEGAKSLFKGAGANILRAIAGAGVLSGYDQLQILFFGKKYGSGGA

SEQ ID NO: 1808 - protein, 151 aa, Yersinia mollaretii
LMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAG

SEQ ID NO: 1809 - protein, 334 aa, Shigella flexneri 2a str. 301
MEYMTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 1810 - protein, 479 aa, Gibberella zeae
MAENSTPDVPGPAGIPYFGNYLEIYPDHLGNHQRLFEKYGPLFTTTSMGNRLYQTNSAELSNIFLSEDHYFTKDIVPGHPLHPIKNQEAGVFLADTNTEQWRLAHKFLPPALGPKAVRHYAPTMQRTVESSFKVFDELDQKGEAWNVYQYMLKLGSQAVGKLVLGMDFAHFEQVDSPLHEMVLKIAENLELNKRVSSMGAWYAQMPFGDPKKVRQTMARIMEMMDESIARASKGQEDLELQDAALKADTVVDYFLRATDNKGNKLPPSQFAPALLVATAAGFTTTSSLLSWLIYSLVKYHGNQERLLQELIDNDWDENTQVTADTTSKLTFLDKFIKETQRLHNPSFQPGRTAKVDMILPGGYRLPKGAVVISALHHMHNNKDVWENPGRFDPDRWDTEQVKNRPPGSYIPFATGPRMCVGFNFALQEIKVFLPKLVYRYKFSLAQDGPIEYDPYFQLIRPNNLYVQAEKRVKWPPKSE

SEQ ID NO: 1811 - protein, 333 aa, Zea mays; identical to SEQ ID NO: 907

SEQ ID NO: 1812 - protein, 67 aa, Zea mays
MDWPNSWAAVVPSSSNIVSTVNLDCKLDLKAIALQARNAEYNPKVFSLLLYFYLDPFICKQRFAAGM

SEQ ID NO: 1813 - protein, 407 aa, Pyrobaculum aerophilum str. IM2
MVRIAVIPVGGEAVRLRPLTVETSKAMIRFLNRPLVELSILHLARQGIEEFYFGVRGYHNYRDIYDYFREGSWFAVKYGVNIKIRYMPRVETRGNAEAVLATLEYYDINEPVLVIQGDNIFNLDVKEMYSFHSSKKAFITIALKEETGDLSEFGVAAVDDNMRILKFVEKPKRREEAPSNLVNTGLYLLSEDFKSFFKGELGGKLYSEGRLDFGGDVIPAVIEAGLPVYGYHTKGYWFDVGTPERYLKAVQYLLRHLTAYELEAEEIAPSVFAQGKSEQSKALKEKIAEAIKNGQIKAEGRLLLGRHVQIGDNSYLRDTVIDNYVIIGDNSVIEDSVVMDRSYIGRGVVIRRSIIGRHVQIGDGAVIEDAVVADNVIVGDGAHLRRVKVWPHKTVERGVRLEGFSLI

SEQ ID NO: 1814 - protein, 274 aa, Zea mays
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQRPLAVAA

SEQ ID NO: 1815 - protein, 384 aa, Pleurotus sajor-caju
MPTQEVFDKQDGAVYTTSNGAPVAEPYAAQRAGLHGPLLLQDFHHIDLLAHFDRERIPERVVHANAAGAHGYFEVTHSCADITSNKLLCSVGKKVRLTARFSTVGGESGSADTARDPRGFALKLRTEEGNWDWVFNNTPIFFIRDPAKFPHFIHTQKRDPQTHLKDADMFWDYLGQNPESIHQMMILFSDRGTPDGVRQMHGYSGHTFKWLKDDGSFTYVQVHCRADSGFKTLDGDTAHRLTADNPDYSTEMLFRTIEAGKFPSWTVYIQTMTPEQAENFRYNILDLTKVWPHKEFPLRPIGRFVLDENPKNYFAEIEQAAFAPSHLVPYIEPSADPVLQSRLFSYPDTHRHRLGANYHQIPVNAPIVPVANFQRDGPMTVNNN

SEQ ID NO: 1816 - protein, 57 aa, Candida albicans
MAPTFTNSNGQPIPEPFATQRVGQHGPLLLQDFNLIDSLAHFDRERIPERVVHAKGS

SEQ ID NO: 1817 - protein, 474 aa, Grateloupia dichotoma
RYESGVIPYAKMGYWDPDYVIKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAASGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVMARNEGREYVAEGPQILQDAAKTCGPLQTALDLWKDITFNYTSTDTADFVETPTANV

SEQ ID NO: 1818 - protein, 158 aa, Triticum aestivum
  unsure (1)..(158): unsure at all Xaa locations
MAPTVMASSATSVAPFQGLKSTAGLPVSRRSNGASLGSVSNGGRIRCMQVWPIEGIKXFETLSYLPPLSTXGLLKQVDYLIRSKVVPFLRXQQVXXIFXXEHNASPGYYDGRXYWDMLELPKFPDAPTPPGXXTKVEEVQERIPDPISAHRKSVMLNL

SEQ ID NO: 1819 - protein, 486 aa, Bacillus cereus ATCC 14579
MITTEIKRVKNHINGEWVESTGTEVEAVPNPATGKIIAYVPLSPKEDVEKAVEAAKAAFETWSKVPVPNRSRNLYKYLQLLQENKDELAKIITLENGKTLTDATGEVQRGIEAVELATSTPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFNEDNYVGPLIRESHKERVLGYINSGVADGATLLVDGRKINEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLSTNGTDGVQFYTRKKVVTERWF

SEQ ID NO: 1820 - protein, 288 aa, Oryza sativa
MACSHLAAAAAAASPAAARSPAASSAATASAFARLSATPRVGCGGLAVRGQRGVAAVVAAAAGAAAATPVADIEERRATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVRYDEELGKALFNGLPNPFTAARYHSLVIEQETFPHDALEATAWTEDGLIMAARHKKYRHIQGVQFHPESIITPEGKRIILNFVRFIEELEKQRAGEKN

SEQ ID NO: 1821 - protein, 335 aa, Zea mays
MAPLGDGGAVAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRDRVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 1822 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 1823 - protein, 167 aa, Limonium latifolium
GYDGFEGVKTLVDVGGSSGDCLRMIINKYKDIPKAINFDLPEVVAKAPKIPGITHVGGNTFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPV

SEQ ID NO: 1824 - protein, 492 aa, Zea mays
MDPYKHRPSSAFNAPYWTTNSGAPVWNNDSSLTVGARGPILLEDYHCEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVAVGGANHSHATKDLTDAIAAGNFPEWTLYIQTMDPEMEDRLDDLDPLDVTKTWPEDAFPLQPVGRLVLNRNIDNFFAENEQLAFCPGLIVPGIYYSDDKLLQTRIFSYSDTQRHRLGPNYLLLPANAPKCAHHNNHYDGSMNFMHRHEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 1825 - protein, 199 aa, Arabidopsis thaliana
MSFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLACARKMVAFHHKAGTGKLTGSTTHLSSFMLQEVNQLGFCFKGGKNYNKNLI

SEQ ID NO: 1826 - protein, 351 aa, Zea mays
MDQSFGNLGAGAGSSSGGSNSKAAAAAVSSSSFLQLPLSTASPAYYGAPLALLHHAAAAPSSSQQHQQQQHHHHYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 1827 - protein, 441 aa, Plocamium cartilagineum
PQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIIVERERMDKFGRPFLGATVKPKLGLSGRNYGRVVYEGLKGGLDFLKDDENINSQPFMRWKERFLYSMEGVNRSIAASGETKGHYLNVTSATMEEMYERAEFAKEIGSIIVMIDLVIGYTAIQTMAIWARRNDMILHLHRAGNSTYSRQKIHGMNFRVICKWMRLAGVDHIHAGTVVGKLEGDPLMIRGFYNTLLHTHLATNLPQGIFFEQDWASLRKVTPVASGGIHCGQMHQLLDYLGVDVVLQFGGGTIGHPDGIQAGATANRVALESMVLARNEGRDFVTEGPQILQDAAKTCGPLQTALDLWKDITFNYTSTDTSDFVETPTSNV

SEQ ID NO: 1828 - protein, 110 aa, Triticum aestivum
  unsure (1)..(110): unsure at all Xaa locations
RGTIKGGIFGNIGNMQNLYETVKKAQMVVQVEAVRVQKELAATEIEGYCEGELIKVTLSGNQQPINVEITEAAMELGAEKVSELVNEAYKDXADLAQSIGMPAGLGDGLK

SEQ ID NO: 1829 - protein, 313 aa, Oryza sativa (japonica cultivar-group)
MASDGTDVVALYGGANGLSHKSGSFSVKVGLAQMLRGGVIMDVVTPEQARIAEEAGACAVMALERVPADIRAQGGVARMSDPGLIRDIKRSVTIPVMAKARIGHLVEAQILEAIGVDYVDESEVLTLADDAHHINKNNFRVPFVCGCRDLGEALRRIREGAAMIRTKGEAGTGNVVEAVRHVRSVMGDIRALRSMDDDEVFSYAKRIAAPYDLVMQTKQLGRLPVVQFAAGGVATPADAALMMQLGCDGVFVGSGIFKSGDPALRARAIVQAVTHYSDPKILAEVSSGLGEAMVGINLSDPKIHVERFAARSD

SEQ ID NO: 1830 - protein, 100 aa, Oryza sativa
MSAAGEEDKKPAGGEGGGAHINLKVKGQDGNEVFFRIKRSTQLKKLMNAYCDRQSVDMNAIAFLFDGRRLRGEQTPDELEMEDGDEIDAMLHQTGGCLPA

SEQ ID NO: 1831 - protein, 357 aa, Populus tomentosa
MGSLETERKIVGWAATDSTGHLAPYTYSLRDTGPEDVFIKVISCGICHTDIHQIKNDLGMSHYPMVPGHEVVGEVVEVGSDVTRFKVGDVVGVGVIVGSCKNCHPCKSELEQYCNKKIWSYNDVYTDGKPTQGGFAESMVVDQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINTPLQFGTPMVMLGRKSITGSFIGSMKETEEMLEFCKEKGLASMIEVIKMDYINTAFERLEKNDVRYRFVVDVAGSKLIP

SEQ ID NO: 1832 - protein, 256 aa, Bacillus circulans
MTKWMSIRVKMTALLAAAALLISVSATQPIQAQGAAFTEPLNGPNPGMFYTSDGWGNGVDFGVGWKASNQEFSNGIMALRLDNVGCPSNCSGKPYASAEYATTQKYGYGRVEARIKAAKGTGLVTSLFTYSGAAPGTSNDEIDIEILGKDTTKMETNYFTNGVGGHSTVIDLGFDASLDFHDYAFEWSPTSIKWYVDGRLVHTETGSRGPLPTSPGYIMVNLWSGAGPAEIWTGKFTYPGHPIRAYYDWIKFTPAS

SEQ ID NO: 1833 - protein, 174 aa, Triticum aestivum
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 1834 - protein, 512 aa, Zea mays
  unsure (1)..(512): unsure at all Xaa locations
MFIESFRVESPHVRYGPTEIESEYRYDTTELVHEGKDGASRWVVRPKSVKYNFRTRTAVPKLGVMLVGWGGNNGSTLTAGVIANREGISWATKDKVQQANYYGSLTQASTIRVGSYNGEEIYAPFKSLLPMVNPDDIVFGGWDISNMNLADSMTRAKVLDIDLQKQLRPYMXESMVPLPGIYDPDFIAANQGSRANSVIKGTKKEQVEQIIKDIREFKEKNKVDKIVVLWTANTERYSNVCAGLNDTMENLLASVDKNEAEISPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAXPENNMILEYK

SEQ ID NO: 1835 - protein, 497 aa, Nostoc punctiforme
MTEPQNLTTADGIPVSDNQNSLTAGARGPVLIQDFHLIEKLAHFNRERIPERVVHAKGAAAHGTLTITNDITRYSKAKLFSEIGKKTELILRFSTVGGEKGSADAERDPRGFSLKFYTEEGNWDLVGNNTPIFFIRDPLKFPDFIHTQKRNPQTNCKDQNAKWDFWSLSPESLHQVTILFSDRGIPKTHRHMDGFGSHTFSLINAEGDRVWCKFHFKTLQGHQTLTEEESAKIKGEDPDHATHDLFEAIAKKDYPKWRMCIQVMTEEQAEKHPDNPFDLTKVWKQGEYPLIEVGILELNRNPENYFAEVEQAAFSPSAVVPGVSFSPDKMLQARIFSYPDAQRYRLGGNYQQLPVNQPKCPVMHYQRDGFMASGNNGGSVPNYEPNSAEGTPKENPAYAEPPSHLGDVTVDRYSHREGNDDYTQAGNLYRLLTPEQQERLAKNIVGSLSQAREDIQMRQLCHFFRADVSYGRRVAEGLGIAIDPSMFSHDAQPVGNW

SEQ ID NO: 1836 - protein, 376 aa, Nepenthes alata
AVIGSGVLSLAWATAQLGWIAGPTAMLLFSFITFYTSRLLADCCRSGDSFTGERNPTYMDAVRSNLGGIQVKICGLVQYANLFGVSIGYTIAASISMMAIKRSNCFHASDDKNPCQYPASPFMIIFGLTEIIFAQIPDFHRLWWLSIVAAVMSFTYSTVGVSLGIAQVAENGKIKRSLTGISIGTVSQAQRIWRRFQALGDIAFAYSYSLVLVEIQDTIKSPPSEIKTMKKATVMSIAVTTLIYLLCGCMGYAAFGDLAPGNLLTGFGFYNPYWLLDLANAAIVVHLLGAYQVCCQPIFAFIETTASNAFPDNEFITKEVEIPIPGFKPYKLNLFRLVWRTSFVGVTTTISILLPFSNGVVGLLGALAFWPLTVYY

SEQ ID NO: 1837 - protein, 763 aa, Novosphingobium aromaticivorans
MPERIASQLRSGPPLVALRRYRSTHSMFLSRRLLVSASSVLALSATAIHAAPASPADIAKADARAAATVRQMTGEEKVVLTHGIMPLPLAGPVPGMPADAIPGAGYIAGIERLGIPALKETDASLGVSYVMGIRKDGATALPSGVAQAASWNPDLLYRGGAMIGSEARAKGFNVLLAGGVNLMRDPRNGRTFEYLAEDPLLSGMLVGAAIRGIQSNNIISTIKHFALNGQETGRKYVDVKIDEGAARESDLLAFQIGIEQGQPGSVMCAYNRVWGEQACANDWLLNKVLKQAWGYKGFVMSDWGAVPNIEAALKGLDQQSGEQLDPGVFFADKLKEKAASDPAYKARLDDMNRRILTAIYASGLDKAPATPGGKIDFAANAQVAEEVAKQGIVLLKNDGALPLAKSARSIAIIGGYADGAVLSGAGSSQVHGEGGPAVVRPVGGKGVWAGFIAQQYHRSSPMDAIQELAKDAKVTFRDGRYIADAVEKARQSEVAIVFATQWQTEGLDVPDLSLPDGQDELIAAVAAANPRTIVVLETGGPVKMPWLDKVAGVIEAWYPGARGGPAIASVLFGDTNPSGRLPLTFPKDESQLPRPRLDGSDWVEPDFSGNPSSGSDKLVSDYDIEGSDVGYRWFARKGQKALFPFGHGLSYTTFESSGLKVKGLAASFTVKNTGQRAGDDVAQVYLVSRNGQARQRLVAFQRVSLAPGASKSVTVTFDPRILADYRNGGWVMGGGEYAFALGKDAENLSAPVKVKLAAKKWKD

SEQ ID NO: 1838 - protein, 481 aa, Xanthomonas campestris pv. campestris str. ATCC 33913
MFPGEPMSSVSIDGAPDAGENTRFIILISCVATIGGFLFGFDSGVINGTVDGLKQTFQSSAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 1839 - protein, 573 aa, Neurospora crassa
MGTHDSISSVQPDLEQPSHAGGHGSNGIDELDESRLAQFGYKQELNRDWGLAHNFGVSFSIISVITGLTTLFSYGLATGGPAVMSISWIVISFFTLLVAIAMAEIVSAIPTSGGPYFWSAMLAPPRWSPFLAWLTGWFNLLGQVAVTTGITFGLAGLVSTAITVKNPDYEPTAAKTIGIYAALLVSHGVVNTFGVKGLRFLNNVSIVLHSAGITALCIAVLAKAPKLQSAKFVFGTYHDGTAAEEGTEGWGQRASPAYVVLCGALLSQYTLTGFDASAHLSEETKNASWSAPIGVVSSVGFSSLFGFFVLMAFLFSIQDFESTLNSKYGQPVLQILVDVAGEDGALVLFSLIMLCVWHCGLFSMTSNSRMMFSFARDRGIPSFFHQVDDRFKSPIRAVWLAAILSFILALPSLGSDVAFAAATSIATIGLYLSYGLPIMIGFFWHKNFTAMKGPFNLGALSRVIAGAACLWICFITVVFCLPTANPVTSQTLNYTVVAVGIIAVGSIGSWVVWARRWFTGPAAEVAEAMRLGVDITEPGALEKKEKEALEGARMEGEREAREREEKQPPAVSE

SEQ ID NO: 1840 - protein, 406 aa, Thermosynechococcus elongatus BP-1
MGLEWIQPADRLGALPPYVFARLDELKLKARQQGLDLIDLGMGNPDGSAPRPVIEAAIAAFEEPSYHGYPPFEGTAVFRQAITRWYQRRYNVSLDPEGEALPLLGSKEGLTHLALAYVNPGDVVLVPSPAYPAHFRGPAIAGANIYPLILKREKGWLIDLSEIPSDIARQAKVLYFNYPSNPTAAIAPRSFFEEVVAFAREYQILLVHDLCYAELAFDGYQPTSLLEIPGAKEIGVEFHTLSKTYNMAGWRVGFVVGNRHIIQGLRTLKTNLDYGVFSVLQKAAEVALSLPDSYIASVCDRYRQRRDFLIQGLNELGWQLTPTQATMYLWVPVPLGMSSTDFALKLLQETGIVVTPGNAFGEGGEGYVRISLIADCDRLGEALKRMAQANIRFDSLSHSLTPSSHD

SEQ ID NO: 1841 - protein, 221 aa, Glycine max
  unsure (1)..(221): unsure at all Xaa locations
MGRGRVELKRIENKINRQVTFAKRRNGLLKKAYELSVLCDAEVALIIFSNRGKQYEFCSGSSMLKTLERYQKCNYGAPEDNVATKEALELSSQQEYLRLKARYEALQRSQRNLMGEDLGPLSSKELESLERQLDSSLKQIRSIRTQFMLDQLSDLQRKEHFLGESDRDLRQRLEEFQINPLQLNPSAEDMGYGRHXRYHPDPVSVVTEGPSMNNYMAGWLP

SEQ ID NO: 1842 - protein, 344 aa, Porphyra purpurea
MSYPKKVELPLTNCNQINLTKHKLLVLYEDMLLGRNFEDMCAQMYYKGKMFGFVHLYNGQEAVSTGVIKLLDSKDYVCSTYRDHVHALSKGVPSQNVMAELFGKETGCSRGRGGSMHIFSAPHNFLGGFAFIAEGIPVATGAAFQSIYRQQVLKEPGELRVTACFFGDGTTNNGQFFECLNMAVLWKLPIIFVVENNQWAIGMAHHRSSSIPEIHKKAEAFGLPGIEVDGMDVLAVRQVAEKAVERARQGQGPTLIEALTYRFRGHSLADPDELRSRQEKEAWVARDPIKKLKKHILDNQIASSDELNDIQSSVKIDLEQSVEFAMSSPEPNISELKRYLFADN

SEQ ID NO: 1843 - protein, 314 aa, Tropheryma whipplei str. Twist
MPRYDVVSLGEGQIRLTVPRGENLLTAKQLYLTAAGSEANVTGLLSQLGHSCAWASVIPKGELGDRIVREYRAVGTDVSHIVRTDTGRVALYFLQPGADPMPAEVVYDRLHTPFREIEPEIFDWGSLLDTRILFITGITMALTEKTRRVIEYGVACASERGVDIVLDVNHRARLWSGKEARGVIVPLLDKVKILFCSRGDADRVFGITGEPDDVARTLRARYGVPTVVSTAGTQGVYLSSATGEESFPVTPVRVIDRPGAGDAFVGGSLHGHLSGDLRMGIKTGMLAAQHALSHYGDLVSTSAFGEYTSTDILR

SEQ ID NO: 1844 - protein, 347 aa, Symbiodinium muscatinei
MATKIGINGFGRIGRMVFQAICDQNLLGTKLDVVGVVDMSTDAEYFAYQMKYDTVHGRFKHEVKIGEKDELIVNGHKIKCIQASREGPKALPWKDMGVEYVIESTGLFVEAEKAAGHIEAGAKKVIISAPGKGDLKTLVCGVNHTEYDKANHNVVSNASCTTNCLAPIVHVLLKEGVGIEKGLMTTIHSFTATQKTVDGVSAKDWRGGRGAACNIIPSATGAAKAVGEVLPTTKGKLTGMAFRVPTPDVSVVDLTFTAEKDTSIEEIDALFKKASETYMKGVLSFTDEELVSSDFIHNVNSSIYDSKATLQNNLKGEKRFFKIVSWYDNEWGYSNRVVDLLMHMISA

SEQ ID NO: 1845 - protein, 236 aa, Trichodesmium erythraeum IMS101
MTTTEKKPIVISPSILSADFSRLGDEVRAVDQAGADWIHIDVMDGRFVPNITIGPLIVKALRPVTKKPLDVHLMIVEPEKYVEDFAKAGADIISVHAEHNASPHLHRTLGQIKELGKQAGVVLNPSTPLELIEYVLDLCDLVLIMSVNPGFGGQSFIPTVISKIRKLREMCDARGLNPWIEVDGGLKTDNTWQVLEAGANAIVAGSAVFKANDYAEAINGIRNSKRPVPQPQLATV

SEQ ID NO: 1846 - protein, 135 aa, Oryza sativa (japonica cultivar-group)
MIEIIDLSQYIGPELDKKKAKLEKAKSKLLELEKKADIEENTRVTAVESVMQALVFLDSEHDVNMIVSDYCMPEMTGYDLLMEVKKSPRLVHLPVIIASSDNIPERIRKCFDGGAKDYILKPVKIADVPRILNYI

SEQ ID NO: 1847 - protein, 388 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 1848 - protein, 574 aa, Oryza sativa
MQGSSTSILHFVPSDPTSTSVLDFLSPTPRGTSPVHDRRLHAGDLALRAGGDRLLVADTVAAVVESLVQAWRQVRMELLVPLLRGAVVACMVMSVIVLAEKVFLGVVSAVVKLLRRRPARLYRCDPVVVEDDDEAGRASFPMVLVQIPMYNEKEVYQLSIGAACRLTWPADRLIVQVLDDSTDAIVKELVRKECERWGKKGINVKYETRKDRAGYKAGNLREGMRRGYVQGCEFVAMLDADFQPPPDFLLKTVPFLVHNPRLALVQTRWEFVNANDCLLTRMQEMSMDYHFKVEQEAGSSLCNFFGYNGTAGVWRRQVIDESGGWEDRTTAEDMDLALRAGLLGWEFVYVGSIKVKSELPSTLKAYRSQQHRWSCGPALLFKKMFWEILAAKKVSFWKKLYMTYDFFIARRIISTFFTFFFFSVLLPMKVFFPEVQIPLWELILIPTAIILLHSVGTPRSIHLIILWFLFENVMALHRLKATLIGFFEAGRANEWIVTQKLGNIQKLKSIVRVTKNCRFKDRFHCLELFIGGFLLTSACYDYLYRDDIFYIFLLSQSIIYFAIGFEFMGVSVSS

SEQ ID NO: 1849 - protein, 467 aa, Streptococcus pyogenes MGAS315
MNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLVLAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 1850 - protein, 206 aa, Borrelia burgdorferi
MAKIIGISGGSGSGKTTVVSKISEFIPEFVLISQDNYYKSVGDYEHEFSKVNFDHPDAFDNNLFYEHLKNLKKNSPIDMPLYDFINHKRQLKTVLVVPTPVVIVEGIMIFVEERVRNLIDLKIYIDTPNDIRFIRRLRRDISKRGRTVESVIDQYLNTTRWGYYRFIEPTKEYADLIIPEGGHNDKALYVLSTFLKSLSKEGLDFT

SEQ ID NO: 1851 - protein, 533 aa, Helicobacter pylori 26695
MEIKNIKEFEKASKKLQKDTLKIALALLFLIGAALLALIFGQANSKGLLLIFAAVIGGYMAMNIGANDVSNNVGPAVGSKAISMGGAILIAAICEMLGAIIAGGEVVSTIKGRIVSPEFINDAHIFINVMLASLLSGALWLHVATLIGAPVSTSHSVVGGIMGAGMAAAGMVAVNWHFLSGIVASWVISPLMGALIAMFFLMLIKKTIAYKEDKKSAALKVVPYLVALMSLTFSWYLIVKVLKRLYALNFEIQLACGCILALLIFILFKRFVLKKAPQLENSHESINELFNVPLIFAAALLSFAHGANDVANAIGPLAAISQTLEDANSPIGNTLSSVPLWIMVVGAAGIALGLSLYGPKLIKTVGSEITELDKMQAFCIALSAVITVLLASQLGLPVSSTHIVVGAVFGVGFLRERLREQSRRRFARIRDNIVAAHFGEDLEEIEGFLERFDKANLKEKSLMLESLKKSKNTAIALELKKKEKKSLKKVYKEEVIKRSILKKIVTAWLVTVPVSALLGALLFVALGFIEKYF

SEQ ID NO: 1852 - protein, 256 aa, Glycine max
MEAGYNPRTVEEVFRDFKGRRAALIKALTTDVEEFYQQCDPEKENLCLYGFPSEQWEVNLPAEEVPPELPEPALGINFARDGMQEKDWLSLVAVHSDAWLLAVAFYFGARFGFDKADRKRLFNMINDLPTIFEVVTGMAKKQGKEKSSVSNHSSTKSKSNSKRGSESKYTKAMQSKDEDDEGGAGLGLGLEDEDEEEHGDTLCGACGESYAADEFWICCDICEKWFHGKCVKITPARAEHIKQYKCPSCSNKRARP

SEQ ID NO: 1853 - protein, 323 aa, ASPERGILLUS NIDULANS FGSC A4
MVKIALLGAAGQIGTPLSLLCKASDLFAEISLYDIVHVPGIATDLMHIDTRARVTGHLPDDSGLKKALTGADIVVVTAGIARKPGMTRDAQTNASIIRDIFAEIAATCPNAVSCVVTNPVNSTLPVAAETLKKAGVFEPTRLFGITTLDVVRASTFAAHALDSNSDPKAFKVPVIGGHSGATILPLYSQAEPPVNLDKETLAAVIHRVQFGGDEIVKSKQGAGSATTCMAYAGFRFVKAIVAAMNGESVTEEAYVYLPGIAGGQEIAQELGVDYFALKVTLGRTGANQVLPIGEISENESTLLKVAINDLKANIVTGVSFMAA

SEQ ID NO: 1854 - protein, 532 aa, Arabidopsis thaliana
MPELSLLSALDAARIQWYHFKAIIVAGMGLFTDAYDLFCIAPIMKMISQIYYHKDSIGTALLSTSYAIALLGTALGQLIFGYLGDRVGRRKVYGLSLLIMVFSSFGCGFSVCTTRRSCVMVSLGFFRFVLGLGIGGDYPLSATIMSEFANKRTRGAFIAAVFSMQGLGILMSSAVTMVVCLAFKNAGEGSSEKTNVAGLETLAPPESDIAWRLILMIGALPAALTFYWRMLMPETARYTALVENNVVQAAKDMQRVMSVSMISQITEDSSSELEQPPSSSSYKLFSRRFLSLHGRDLFAASANWFLVDVVFYTSNLLLSQIFNFSNKPLNSTNVYDSAFEVAKLAAIVAACSTIPGYWFTVYFIDKIGRVKIQMMGFFLMAVVYLVAGIPYSWYWSKHEKTNKGFMVLYGLIFFFSNFGPNTTTFIIPAELFPARFRSTCHGISGAAGKFGAIVGTVGFLWATRHHEEDGFPDVKRVRIAFLILGGVCIAGMIVTYLFTRETMGRSLEENEDEIVSTSAGSSPANELLRRQY

SEQ ID NO: 1855 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 1856 - protein, 200 aa, Glycine max
MADQGLEGSQPVDLQKHPSGIVPTLQNIVSTVNLDCKLDLKTIALQARNAEYNPKRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 1857 - protein, 339 aa, Pseudomonas syringae pv. tomato str. DC3000
MSQESINWDTLGFDYIKTDKRYLSHWRDGAWDQGSLTEDNTLHISEGSTALHYGQQCFEGLKAYRCKDGSINLFRPDQNAQRMQRSCSRLLMPHVPTDVFIEACKQVVKANERFIPPYGSGGALYLRPFVIGVGDNIGVRTAPEFIFSIFCIPVGAYFKGGLKPNNFVISGYDRAAPNGTGAAKVGGNYAASLMPGSEAKKHSFADCIYLDPQTHSKIEEVGSANFFAITSDDVFLTPKSPSVLPGITRLSLIELAKNRLGLTVEEGDVFIDQLDTFKEAGACGTAAVITPIGGISYQDNLHVFYSQTDVGPVTQRLYKELTGVQSGDIEPPAGWIVKV

SEQ ID NO: 1858 - protein, 427 aa, Oryza sativa (japonica cultivar-group)
MLPQQQQQQKQQAAALMPPSMYAMPPPPPLHHHHHPLLAAAPPQQQIEPILTGNLPPGFDTSTCRSVYVGNVHVQVTEALLREVFQSTGLVEGCKLIRKEKSSYGFVDYYDRRSAALSILTLNGKQIFGQLIRVNWAYASGQREDTTDHFNIFVGDLSPEVTDSALFAFFSGYSSCSDARVMWDQKTGRSRGYGFVSFRNQQDAQSAINDLNGQWLGSRQIRCNWATKGASNGEQQTSDSKNVADLTNNLTEDGKEKANEDAPENNPQYRTVYVGNLAHEVTQDVLHRLFHALGAGAIEEVRIQLGKGFGFVRYSNHAEAALAIQMGNGRILGGKPIKCSWGNKPTPPGTTSAPLPPPAAPSVTAADLLEYQRSLALSKMVSSQALMQAQAQQHLKQAMGMGAGVSQAMYDASFPNVGPSQQQLMYY

SEQ ID NO: 1859 - protein, 463 aa, Listeria monocytogenes EGD-e
MTKVNSFFRKKSFHNPATDKHHLNKSLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTAISSAYDPSAGTYFDLLAFVVVMVIGILLSFGIRESTRVNNIMVLVKIAVVVLFILVGAFYVKPDNWTPFLPFGVQGVITGASTVFFAYIGFDAVSSAAEEVKNPQKNMPIGIISSLAVCTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFKTPFYPVVPALSFLLCVYLMINLSKTTWIAFGIWFVIGILVYTFYGRKHSALRIK

SEQ ID NO: 1860 - protein, 133 aa, Zea mays
SAGGLEEEIRMFQTRVLLGGMNMYDRYQDWRLDVDNMTYEELLELGDKIGYVNTGLRDDEITRNLRKVKHPSFSSLRFATEMERKCSICQEEFETNEEMGRLDCGHSYHVYCIKQWLSQKNICPVCKTAVSKN

SEQ ID NO: 1861 - protein, 178 aa, Glycine max
FGTRIATTDLAQHTLEQIEPIRNLFAALFLASTVTLIHLHFLWNHVDILVASVILVIVIKTIIIASVVKGFGYNNKTSIHVGMSMAQIGEFAFVLLSRASNLHLVEGKLYLLLLGTTALSLVTTPLLFKLIPAVVHLGVLLRWFSTDSSMEIGYKLDNLRSDSGKQRIILMDQESHDS

SEQ ID NO: 1862 - protein, 584 aa, Synechocystis sp. WH 8501
MSALSSNTKSSLVKKQGASASRKLTKLETAEKYRWNRENYSIARRRIDIWRFVLSLLFRFWRNGKKWSYKGGFTQEKLDARRKIQAVWIRENLLNLGPTFIKVGQLFSTRADLFPAEYVDELSKLQDEVPAFTYEQVSKTIEKDLGKPLSKLFRNFDPVPIAAASLGQVHKAKLHSGEEVVVKIQRPGLQQLFTIDLAILKKIAYYFQNHPKWGKGRDWIGIYEECCKILWEETDYLNEGQNADAFRRNFRGENWVKVPRVYWRYTSPRVLTLEYLPGIKISHYEGLEAAGLDRKLLARLGAKAYLCQLLNDGFFHADPHPGNIAVDTDGSLIFYDFGMMGRINTNVREKLMDTLFGIAQKDGDRVVSSLIALGALSATSDMGPVRRSVQFMLDNFMDKPFEEQSIAAISDDLYELAYDQPFRFPATFTFVMRAFSTLEGVGKGLDPDFNFMEVAQPFALELVADLDGSTGNSIIDELTRQATQVSNTALSLPRRIDDTIEKLDRGDIRLRVRSVESDRLLRRLGMMQMATNYSVFVSALVICATLLFINGYIRIAIAAVMLGLVPAWALVRLLRRINRLDKMF

SEQ ID NO: 1863 - protein, 579 aa, Staphylococcus aureus subsp. aureus MW2
MAKIKANEALVKALQAWDIDHLYGIPGDSIDAVVDSLRTVRDQFKFYHVRHEEVASLAAAGYTKLTGKIGVALSIGGPGLIHLLNGMYDAKMDNVPQLILSGQTNSTALGTKAFQETNLQKLCEDVAVYNHQIEKGDNVFEIVNEAIRTAYEQKGVAVVICPNDLLTEKIKDTTNKPVDTSRPTVVSPKYKDIKKAVKLINKSKKPVMLIGVGAKHAKDELRAFVEAAKIPVVHSLPAKTILPDDHPYSIGNLGKIGTKTSYQTMQDADLLIMVGTNYPYVDYLPKKNIKAIQIDTNPKNIGHRFNINVGIVGDSKIALHQLTENIKHVAERPFLNKTLERKAVWDKWMEQDKNNNSKPLRPERLMASINKFIKDDAVISADVGTATVWSTRYLNLGVNNKFIISSWLGTMGCGLPGAMASKIAYPNRQAIAIAGDGAFQMVMQDFATAVQYDLPLTVFVLNNKQLAFIKYEQQAAGELEYAVDFSDMDHAKFAEAAGGKGYTIKSASEVDAIVEEALAQDVPTIVDVYVDPNAAPLPGKIVNEEALGYGKWAFRSITEDKHLDLDQIPPISVAAKRFL

SEQ ID NO: 1864 - protein, 518 aa, Nostoc sp. PCC 7120
MYQQKSRTRNRRFSTRNYAKSRQSNSQIQIFNLVKKLSPSWQACIPLACLIVLGWSYVAVAQAPAAGPTTAELKVALDTLWVAIAAFLVFFMNAGFGMLETGFCRQKNAVNVLAKNLIVFALATVAFWAIGFGLMFGDGNDFIGFNGLFLSGVDNSPATGDAYKGVFSALSWAGVPLAAKFLFQLVFAGTAATIVSGAVAERIKFVDFLIFSLLLVGIAYPITGHWIWGAGWLAKAGFWDFAGSTVVHSVGGWAALMGAAFLGPRIGKYQDKQIVALPGHNMSIATLGCLILWLGWFGFNPGSVMAADPNAITHIALTTNMAGAVGGIAATATAWLYLGKPDLSMIINGILAGLVGITASCAYVSIPSSIIIGLIAGVIVVFSVTFFDKLGIDDPVGATSVHLVCGVWGTLAVGLWSVGPGVYSWYGEGLGPTKGLFAGGGLGQLITQFLGAAAVGGMTVLVSSIFWVVLKATLGIRVTREEELEGLDIGEHGMEAYSGFLKEASPGGFAEGKTSDGY

SEQ ID NO: 1865 - protein, 231 aa, Zea mays
KINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 1866 - protein, 346 aa, Trichodesmium erythraeum IMS101
MYKMIQERTVPKFDTNSVKITKEKALILYEDMVLGRLFEDKCAEMYYRGKMFGFVHLYNGQEAVSSGVIKAMRQDEDFVSSTYRDHVHALSAGVPAREVMAELFGKATGCSKGRGGSMHMFSATHNLLGGYAFVAEGIPVATGAAFQSKYRRETMGNQAADQVTACFFGDGACNNGQFFECLNMAALWKLPIIYVVENNKWAIGMAHERATSEPEIYKKAHAFGMVGVEVDGMDILAVHSAAQEAVARARAGEGPTLIEALTYRFRGHSLADPDELRDQEEKQYWFSRDPIKKFTTYLTENNLVDVAELVAIDKKIENLITEAVDFATNSPEPGSDELYRYIFAED

SEQ ID NO: 1867 - protein, 195 aa, Triticum aestivum
  unsure (1)..(195): unsure at all Xaa locations
KPWSQSSAKRRKVKVQYQDRETAIRPDEDSIGSSEDAQIKICPPHPGYFGGLCFRCGKRQDEEDVPGVAFGYVHKGLRLXHQEIGRLRGSDLENLLRERKLILILDLDHTLINSTKLHDISAAENNLGIQTAASKDDPNGSLFTLEGMQMLTKLRPFVRKFLKEASNMFEMYIYTMGDKAYXIEIAKLLDPRNDG

SEQ ID NO: 1868 - protein, 439 aa, Glycine max
MASRLEQQQQPTNVGGENKQKNMGGEGRNRRVLQDIGNLVGKQGHGNGINVSKPVTRNFRAQLLANAQAATEKNKKSSTEVNNGAVVATDGVGVGNFVPARKVGAAKKPKEEPEVIVISSDDESDEKQAVKGKKAREKSAMKNAKAFSSVLSARSKAACGLPRDFVMNIDATDMDNELAAAEYIDDIYKFYKETEEDGCVHDYMGSQPDINAKMRSILVDWLIEVHRKFELMPETLYLTLNIVDRFLSVKAVPRRELQLVGISSMLIASKYEEIWAPEVNDFVCISDNAYVSEQVLMMEKTILRKLEWTLTVPTPYHFLVRYTKASTPSDKEMENMVFFLAELGLMHYPTVILYRPSLIAASAVFAARCTLGRSPFWTNTLMHYTGYSEEQLRDCAKIMANLHAAAPGSKLRAVYKKFSNSDLSAVALLSPAKDLSALS

SEQ ID NO: 1869 - protein, 477 aa, Neisseria meningitidis MC58
MNEYSQLIKHPDISLPPVSDGIKVDNPATGETLAFVRKTDSDKLKNLIQKAAAAQKLWAAKTALERADVLWRWYFQIKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALASLAYEAGIPQDLLPVVSGSASEIGHEFATNPIIRKISFTGSTEVGAKIFADSAADIKKLSLELGGNAPFIVFDDADLDKAVEGALASKFRNSGQTCVCTNRVYAQSAIYDEFCRKLSEKAAALKLGNGLEDGVNQGPLIEEKAVEKVEQHIADALAKGASCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 1870 - protein, 223 aa, Xylella fastidiosa Ann-1
MSNCLIAPSILSADFARLGAEVDAVLAAGADWIHFDVMDNHYVPNLTFGPMVCKALRSYGITAPIDVHLMVEPVDRIVPDFAQAGASMISFHMEASRHVHLTIQLIKSHGCMAGLVFNPATPVDMLDWVLPELDLVLLMSVNPGFGGQRFIPGTLDKLRLVRKKIDLLGRPVRLQVDGGVGIDNIGAIAEAGADTFVAGSAIFHAPDYGDVIAHMRAAVAAVR

SEQ ID NO: 1871 - protein, 404 aa, Zea mays
MEAPPVPELMDLDAPPPAAADAAAAAPVPPAVSDKKKEGEGGDTVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLIPGEPNISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPSLRCSALDACAHPFFDELRTPNARLPNGRPFPPLFNFKHELANASPDLVSRLVPEHIRRQIGVNFGSS

SEQ ID NO: 1872 - protein, 83 aa, Zea mays
  unsure (1)..(83): unsure at all Xaa locations
MLSGACEEDMKLAVGGAHMNLKVKGQDGHEVFFRVKRSTHLKKLVNAYXDRXSVDMCAIALLFDGRTLCIEQTLDELEMEDCD

SEQ ID NO: 1873 - protein, 326 aa, Pelobacter carbinolicus
MKTQLSKEDLLKAYRKMREIREFEDRVHVEFAKGTLPGFVHLYSGEEAVAVGVCSHLNDLDRIASTHRGHGHCIAKGVELEGMMAEIYGKKTGTCGGKGGSMHIADLDKGMMGANGIVGAGPPLIAGAALASKLRKDGSVGVVFFGDGASNQGTNFESMNFAVTLDLPMIFVLENNGYAESTSPKYSAKVGSDNIADRARGFGMPAVTVDGNDFFAVYEAAGEAIERARKGGGPTFIECKTMRYFGHFEGDAQTYRPKNEVKDARANDCPLKRFADAAISAGLVEAADIEAIDKDVLAQVEKAVKDAEVAPQPDMEALMADVYVSY

SEQ ID NO: 1874 - protein, 389 aa, Nostoc punctiforme
MKAMILAAGKGTRVRPITYTIPKPMIPILQKPVMEFLLELLRQHGFDQIMVNVSHLAEEIENYFRDGQRFGVQIAYSFEGKIDDDGKLVGEAIGSAGGMRRIQDFSPFFDDTFVVLCGDALIDLDLTAAVKWHRAKGSIATIITKSVPQEEVSSYGVVVTDEEGRVKAFQEKPSTEEALSTNINTGIYIFEPEVFNYIPSDVEYDIGSQLFPKLVEIKAPFYAIPMDFEWVDIGKVPDYWRAIRGVLLGEIKNVQIPGHEVAPGIYTGLNVAVNWDKVDITGPVYIGGMTRIEDGAKIVGPAMIGPNCWICSGATVENSVIFEWSRLGPGVRLVDKLVFGRYCVDKTGAAIDVQAAALDWLITDARQIPPSHTPVERQAIEELLGTNAS

SEQ ID NO: 1875 - protein, 465 aa, Gelidium subfastigiatum
AKMGYWDPNYAIKETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGDDVVLQFGGGTIGHPDGIQAGATANRVALEAIVIARNEGRDYVKEGPQILRDAAKTCGPLQTALDLWKDISFNYTSTDTADFVETPTANV

SEQ ID NO: 1876 - protein, 213 aa, Hordeum vulgare
MSMSCGLCGASNCAYHMMSPVLLHHHHHQEHPLHEYQFFAQGHHHHHSAAADYPPPPPPPDNCHHHRSWTTPFHETAAPENSTRLTREVDAGGQHMAHLLQPPAPPRATIVPFCESAFASTISNATIMTIDTEMMVGPAYNPTMQEREAKVMRYREKRKRRRYDKQIRYESRKAYAELRPRVNGRFAKVPEAVVSPSPPTSPHDPSKLHLGWF

SEQ ID NO: 1877 - protein, 336 aa, Bacillus coagulans
MAVKVGINGFGRIGRNVFRAAVKNPDIEVVAVNDLTANADGLAHLLKYDSVHGRLDAEVVVNDGVSVNGKEIIVKAERNPENLAWGEIGVDIVVESTGRFTKREDAAKHLEAGAKKVIISAPAKVENITVVMGVNQDKYDADAHHVISNASCTTICLAAFARVLHQIFGEVSRMMTTAHSYTNIQRILDAATHADLRGARAAAESIIDTTNGAAMAVALVLPELKGKLNGMAMRVATANVSVVDLVYELAKEVTVEEVNAALKAIAEGELKGILAYSIEPLVIRNYNGSTVSSTIDILSTMVIDGAMVKVVSWYDNETGYSHRVVALAAYINAKGL

SEQ ID NO: 1878 - protein, 191 aa, Galega orientalis
NWVNIREITKLELRVLRLANVQCPRDTHFWVYDDGRYEEEGQKNIRGNIWEKASTRFVCALFSLPFPHGQPHGSRDETSHYTTVPKYLEQRKTQKLLLLGLQGSGTSTMFKQAKFLYGNKFTAQELEDAKLMIQSNMYKYLSILLDGRERFEEEIVSKMNGQCSPRQITEPASNGEASNTSECIYSLNPRL

SEQ ID NO: 1879 - protein, 189 aa, Glycine max
  unsure (1)..(189): unsure at all Xaa locations
MASSMISSPAVTTVNRAGAGMVAPFTGLKSMAGFPTRKTNNDITSIASNGGRVQCMQVWPPVGKKKWETLSYLPDLGDAQLAKEVEYLLRKGWIPCLEFELEHGFVYREHNRSPGYYDGRYWTXWKLPMFGCTDALRVLXELQEAKTAYPHGFXRISGFDDGVPSAMALIVSGVQPPGLLSERRYAKLW

SEQ ID NO: 1880 - protein, 322 aa, Streptococcus pyogenes M1 GAS
MVTVSKEQHLDMFLKMERIREFDSRINKLVRRGFVQGMTHFSVGEEAANVGAVAHLSYDDIIFSNHRGHGQSIAKDMDLNKMMAELAGKATGVSKGRGGSMHLADFEKGNYGTNGIVGGGYALAVGAALTQQYKGTNNIAVAFSGDGATNEGSFHESVNMAATWKLPVIFFIINNRYGISMSINNATNTPHLYTRAEAYGVPGFYCEDGNDVMAVYETMGKAVEHVRGGNGPAIVEVESYRWFGHSTADAGKYRTKEEVDEWKEKDPMIKYRTYLTSEGIATDDELDAIQAQVKKEVDDAYEFAQNSPDPELSVAFEDVWVD

SEQ ID NO: 1881 - protein, 511 aa, Phaseolus vulgaris
MFIESFKVESPNVKYTENEIHSVYDYETTEVVHEKTVNGTYQWIVKPKTVKYDFKTDIRVPKLGVMLVGLGGNNGSTLTAGVIANKEGISWATKDKVQQANYFGSLTQASSIRVGSFNGEEIYAPFKSLLPMVNPDDVVFGGWDISDMNLADAMARARVLDIDLQKQLRPYMENIVPLPGIFDPDFIAANQGSRANHVIKGTKKEQVDHIIKDMREFKEKNKVDKVVVLWTANTERYSNEVVGMNDTMEDLMESVDRDEAEISPSTLYAIACVLEGIPFINGSPQHTFVPGLIDMAIRNNVLIGGDDFKSGQTKMKSVLGDFLVGAGIKPTSIVSYNHLGNNDGMNLSAPQTFRSKEISKSNVVDDMVASNGILFEPGEHPDHVVVIKYVPYVADSKRAMDEYTSEIFMGGKNTIVMHNTCEDSLLAAPIILDLVLLAELSTRIQFKSEGEGKFHSFHPVATILSYLTKAPLVPPGTPVINALSKQRAMLENIMRACVGLAPENNMIMEFK

SEQ ID NO: 1882 - protein, 439 aa, Methanosarcina mazei Goe1
MVSDPDGGLNEKTEKNSEYNSQKASGQGTEKDIEPDDGTHASLYQESLAMHRRLGGVLEVASKVRLRTIHDLGVAYTPGVAEPCRKIRENRDLAYLYTLKKNTVAVVTDGSAVLGLGNIGPYAALPIMEGKAIIFKEFAGIDAFPICLGTQDTEEVIKAVKNMAPAFGGINLEDISAPRCFEIEARLREELEIPVLHDDQHGTAIVVFAGLLNALKIVKKDLAELKIVISGLGAAGVAILKFLVRAGANPAKILACDSQGIVYEGREKGMNTIKDEISRITNPERLKGELKEVFPGADLFIGVSVGGIVTGSMVRSMAKDAIVMAMANPVPEIMPEAAKRAGARIVATGRSDFPNQLNNCLSFPGIFKGALGTCARKITPEMEMAAAHALANVVTSGELSEDHIIPDPLDKHVVPAVAKAVASASLESCAARKRLEETF

SEQ ID NO: 1883 - protein, 99 aa, Zea mays
  unsure (1)..(99): unsure at all Xaa locations
MSGACEEDKKPLVGGAHINLKGKGQDGNGGFFRIKRGTXLNKPMNPYCDPPSGDMNALAFLFDGPMLPGEQTPDELEMEDSHKIDPLLDQTGGSVPSTT

SEQ ID NO: 1884 - protein, 570 aa, Emericella nidulans
MSPPSAKSMEEGRTPSVQYGYGDPKTLEGEIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLACEVSTMALLSFLSCWNPDNVGHCLGLIIEYWNPPVSVGLWIAIVLVESEFWFAGLKILAIIGLIILGVVLFFGGGPNHERLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIKTLVLEGSTMSSMLPSGSLPGHPVTHGCYAGSEKLYSLAGEGQAPKIFTRTNRTGVPYVAVLATWTIGLLSFLNLSSSGQTVFYWFTNITTVGGFINWVLIGIAYLVCFPPSLHLNTPDQKQRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 1885 - protein, 541 aa, Raphanus sativus
MAIHVERIRRRRLWRERERERKEMEDIQEEENGTDVEVLGSSLTMEKVAAAKQYIENHYKAQNKNIQERKERRWILERKLASSGVPKEEQINMIKDLERKETEFMRLKRNKISVDDFELLTIIGRGAFGEVRLCREKKSGNIYAMKKLKKSEMVMKGQVEHVRAERNLLAEVASHYIVKLYYSFQDAEYLYLIMEYLPGGDMMTLLMREDTLREDVARFYIAQSVLAIESIHRYNYIHRDIKPDNLLLDKDGHMKLSDFGLCKPLDCRTLPSIQENRATDDEAVSEPMDVDRAFPDTDNKRSWRSPQEQLQHWQMNRRTLAFSTVGTPDYIAPEVLLKKGYGMECDWWSLGAIMYGMLVGYPPFYADDPLSTCRKIVNWRNHLQFPEDAKLSREAKDLICRLLCNVDHRLGTGGGAQQIKVHPWFKDVVWEKLYEMEAAYKPEVNDELDTQNFMKFDEVNSPATERTKSGTSRKNLAPKDLSFVGYTYKNFDAVKGLRHSLEMARTMSLDRSPAEVMPVGRISGEAAEAQMVSTMDDPMVI

SEQ ID NO: 1886 - protein, 213 aa, Hordeum vulgare subsp. vulgare
EPMLYTEDSCIIREGDPVNEMLFVMRGYLESMTTNGGQSGFFNSNVLKGGDFCGEELLTWALDPAAVSNLPSSTRTVKTLSEVEAFVLRADDLKFVATQFRKLHSKQLQHTFRFYSQQWRTWAACFIQAAWHRYCRKKLEDSLFEKEKRLQAAIVSDDSTKLSLGAALYASRFAGNMMRILRRNATRKARLQERVPARLLQKPAEPNFFAVGE

SEQ ID NO: 1887 - protein, 239 aa, Xylella fastidiosa 9a5c
MILAQVSGHSLSSERFMSNCLIAPSILSADFARLGAEVDAVLAAGADWIHFDVMDNHYVPNLTFGPMVCKALRSYGITAPIDVHLMVEPVDRIVPDFTQAGASMISFHMEASRHVHRTIQLIKSHGCMAGLVFNPATPVDMLDWVLPELDLVLLMSVNPGFGGQRFIPGTLDKLRLVRKKIDLLGRPVRLEVDGGVGIDNIGAIAEAGADTFVAGSAIFHAPDYGDVIAHMRAAVAAVR

SEQ ID NO: 1888 - protein, 429 aa, Caldococcus noboribetus
MVSHPCTADEAKPPSEGQLARFENGKLIVPDNLIVAYFKGDGIGPEIVESAKKVLDAAVDKAYGGTRRIVWWEVTAGEEAQKECGSLLPDGTLQAFKLARVNLKGPLTTPVGGGFRSLNVTLRMVLDLYSNVRPVKWYGQPTPHCHPENIDWVIFRENTEDVYAGIEWPFDSPEAQKIRDFLKKEFGIELTPDTGIGIKPISKWRTQRHVRRAMEWAIRNGYKHVTIMHKGNIMKYTEGAFRQWAYDLILSEFRDYVVTEEEVNTKYGGKAPEGKIIVNDRIADNMLQQIITRPGEYNVIVTPNLNGDYISDEANALVGGIGMAAGLDMGDGIAVAEPVHGSAPKYAGKNVINPTAEILSGMYLLSDFVGWPEVKLLVEYAVKQAIAHKQVTYDLAREMGGVTPISTTEYTDVLVDYIRHADLKALKGQ

SEQ ID NO: 1889 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFNKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 1890 - protein, 286 aa, Triticum aestivum
  unsure (1)..(286): unsure at all Xaa locations
PRVRPRVRPRVRFSPIMAAWTFTTPMVGIYSIFRYYPGIFKAISPHYIVHFFLKNKKEGWQMLGATVLAITGAEAMFADLGHFSKKAIQIAFLSSVYPSLILTYAGQTACLINHLKDTDQENIGKVFDDAFYKFIPRPVYWPMFVIATLAAIVASQSLISATXSVIKQSVVLDYFPRVKVVHTSDENEGXVYSPETNYILMVLXALVVILGFGXVDKAIGNAFGLVVIMVMLITSIMLTLVMIIIWRTPPVLIAAYFVPFVIMEGSYVSAVFTKFXEXGWLPFAIS

SEQ ID NO: 1891 - protein, 163 aa, Zea mays
MADEKLAKLREATAGLTQISDNEKSGFLSLVGRYLSGDEEHIEWAKIHTPTDEVVVPYDTLESPPEGTEATKKLLDKLAVLKLNGGLGTTMGCTGPKSVIEVRNGFTFLDLIVIQIESLNKKYGSNVPLLLMNSFNTHDDTLKVNCLFITIQFFLFIFLGTES

SEQ ID NO: 1892 - protein, 453 aa, Areschougia congesta
KDTDILALFRVSPQPGVDPIEASAAVAGESSTATWTVVWTDLLTACDLYRAKAYKVDAVPNTTDQYFAFIAYDIDLFEEGSIANLTASIIGNVLGFKAVKALRLEDMRIPVAYLKTFQGPATGIISERERMDKFGRPFLGATVKPKLGLSGKNYGRVVYEGLRGGLDFLKDDENINSQPFMRWKERYLYAMEAVNRSVAATGEVKGHYLNVTAATMEEMYERADFGKQLGSIIIMIDLVIGYSAIQTMGIWARKNDMILHLHRAGNSTYSRQKIHGMNFRVICKWMRMAGVDHIHAGTVVGKLEGDPLMIRGFYNTLLLPYLKINLPQGIFFEQDWASLRKVTPVASGGIHCGQMHQLLDYLGVDVVLQFGGGTIGHPDGIQAGATANRVALESMVLARNEGRDYVAEGPQILQDAAKTCGPLQTALDLWKDITFNYTSTDTADFVETPTANV

SEQ ID NO: 1893 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAADLTKRIQNAGTEVVEAKAGGGSATLSMGQAAARFGLSLVHALQGEKGVVECAYVEGDSQYARFFSQPLLLGKNGVEERKSIGTLSAFEQRSLEG

SEQ ID NO: 1894 - protein, 210 aa, Glycine max
PPLFQKDIFSAIGWIPPAKTMNALEEVFFIARAQTLIALCSTVPGYWFTVAFIDRIGRFAIQLMGFFFMTIFMFALAIPYDHWTLRENRIGFVVIYSLTFFFANFGPNATTFVVPAEIFPARFRSTCHGISSASGKLGAMVGAFGFLYLAQNQDPSKADAGYPAGIGVRNSLLVLGVINILGFMFTFLVPEAKGRSLEEISGEQEEETKV

SEQ ID NO: 1895 - protein, 159 aa, Buchnera aphidicola
  unsure (1)..(159): unsure at all Xaa locations
MANILLLDNVDSFTYNLVDQLRKYKHHVMIYRNTVDITMIISALYRLHNPILMLSPGPGLPKNAGCMLELIQKVKTYVPIVGXCLGHQAIVEAYGGTIGYADEIFHGQASLINHDGLEMFEGVPQPLSVARYHSLICSTIPSHFVINSFFENIIMSIRH

SEQ ID NO: 1896 - protein, 320 aa, GIBBERELLA ZEAE PH-1
MDDYVSESDSDYTSYWRDWFISSRGNEYFCEIDEDYLTDRFNLTGLNTEVQYYQYALDLVTDVFDLECDDEMREAIEKSARHLYGLVHARYIVTTRGLSKMLDKYKKAEFGKCPRVMCHSHPLLPMGLSDVPNLKPVKLYCARCEDIYNPKSSRHAAIDGAYFGTSFHNILFQVYPALIPTKSVDRYVPRVYGFKVHASAALIRWQSSKRDEMRRRLRKLEIDTGFRDEMEDEEEDDDEELEFEGIDGRMAVVEGLYALSVQLTGRGSPAGWISIISQGVTILLLSFLLVRFWIGVWRQVNVGQNWQGWYKPQMGEIVFS

SEQ ID NO: 1897 - protein, 494 aa, Bacillus cereus ATCC 14579
MSQLAVNLHEKVEKFLQGTKKLYVNGSFIESASGKTFKTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGVGLNPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 1898 - protein, 125 aa, Glycine max
  unsure (1)..(125): unsure at all Xaa locations
APPPSGLDSHRWVPLXPGVGFSAHTVGDENHEDVTPPSNLMEHPPLAVFINGVSAAMNELRPCAPISLKHVLAQELIKGLQAVSDSLLLYNTTRVLRSNESGLFLSLCWAFIEVFCNSYTIQLDC

SEQ ID NO: 1899 - protein, 104 aa, Salmonella typhimurium
DVEVRVDYCGICHSDLSMIDNEWGFSQYPLVAGHEVIGRVAALGSAAQDKGLKVGQRVGIGWTARSCGHCDACISGNQINCQEGAVPTILNRGGFAEKLRAGWQ

SEQ ID NO: 1900 - protein, 564 aa, Saccharomyces cerevisiae
MSSAQSSIDSDGDVRDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWALIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGISSEESKTEKKDWKKFLKFSKNSD

SEQ ID NO: 1901 - protein, 464 aa, Shigella flexneri 2a str. 301
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMCVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGSLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMGLFVQISLFSESILLTISRVNI

SEQ ID NO: 1902 - protein, 320 aa, Schizosaccharomyces pombe
MSEKQTIKALPAHNPTQVKKLGPVSGFLSGGLAACGAVTLTNPFEVIKTRFQLQGQLTKLDPSKRIYKSVGQAFSLIARHEGIRGLQRGLGTAYVYQICLNGCRLGFYEPIRRTLNTWFLDDPKGNKLAINVASGAGSGLCGALFGSPFFLVKTRMQSYSPKFPVGQQYGYKHIFNAFSRIIKENGVKGLFVGADAAILRTVSGSSVQLPIYNWAKRMIEHYNLLEEGMIKHLTASAVSGFGVCCTMQIFDTVMTRMYNQKNKELYKNPIDCILKTIRSEGFFALYKGFGAHLARIAPHTIFCLTFVEQTNKLFLKFQKD

SEQ ID NO: 1903 - protein, 491 aa, Pseudomonas putida
MSQRLAAYENMSLQLIAGEWRVGKAGRDLDVLDPFTQEKLLQIPLANREDLDEAYRSARQAQVAWAACGPSERAQVMLNAVRIFDERRDEIIDWIIRESGSTRIKAQIEWGAARAITQESASLPSRVHGRILASDVPGKESRVYREPLGVIGIISPWNFPLHLTARSLAPALALGNACVIKPASDTPVTGGLLLAHIFEEAGLPKGVLSVVVGSGSEIGDAFVEHEVPGFISFTGSTQVGRNIGRIAAGGEHLKHVALELGGNSPFVVLADADLDQAVNAAVVGKFLHQGQICMAINRIIVEDSVYDEFVNRYAERVKSLPYGDPSKPETVVGPVINAKQLAGLQDKIATAKSEGARVMVEGEAQGNVLPPHVFADVTADMEIAREEIFGPLVGIQRARDEAHALELANSSEYGLSSAVFTSSLERGVKFARGIRAGMTHINDIPVNDEPNAPFGGEKNSGLGRFNGDWAIEEFTTDHWITVQHAPRRYPF

SEQ ID NO: 1904 - protein, 464 aa, Pterocladiella capillacea
KMGYWDPDYTVKETDVLALFRVTPQPGVDPVEASAAVAGESSTATWTVVWTDLLTACDLYRAKAYKVDDVPNTNDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIASSGEIKGHYMNVTAATMEDMYERAEFAKQLGTVIVMIDLVIGYTAIQTMAIWARRNDMILHLHRAGNSTYSRQKSHGMNFRVICKWMRMAGVDHIHAGTVVGKLEGDPLMIKGFYNTLLLTHLDTNLPQGIFFEQDWASLRKVTPVASGGIHCGQMHQLLDYLGEDVVLQFGGGTIGHPDGIQAGATANRVALEAMVIARNEGRDYVAEGPQILRDAAKTCGPLQTALDLWKDISFNYTSTDTADFVETPTANV

SEQ ID NO: 1905 - protein, 812 aa, Oryza sativa
MAAAAARRGSSLLSRCLLSRPAAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQICAGDGEDGRQWGSTAPWVVPRCGVRRAKAPGLVLLLCRRPAEPRPPSYPFFHLVGHGVFPGTGRSGWGAAGRKLPPNSPSISSFHSSPTSSKLAGLGGLIDPRCILSPARISPINLDDFVSPLPPPPVMPAAETVVVPAETAAVVAPLVVVSKEADSAGDEALDLRLFLQGRDGRCVVMELDFGVLCDNITFFVAMAPHPSSPPPPLLCVGGLLPSDRSGRGERRGWEGRGGAATSFLWRRPVAEPGRRRRSPPPSPVGVSRGRRGMRKGCGEKRS

SEQ ID NO: 1906 - protein, 505 aa, Staphylococcus warneri
MSKQDGKLTGLFGAPVSDRENSMTAGPRGPLLMQDIYFLEQMSHFDREVIPERRMHAKGSGAFGTFTVTNDITQYTSAKMFSEVGKQTEMFARFSTVSGERGAADAERDIRGFALKFYTEDGNWDLVGNNTPVFFFRDPKLFVSLNRAVKRDPRTNMRSAQNNWDFWTGLPEALHQVTILMSDRGIPKDLRHMHGFGSHTYSMYNDKGERVWVKYHFRTQQGIENLTDEEAANVIATDRDSSQRDLFNAIENGDYPKWKMYIQVMTEEQARNHKDNPFDLTKVWYHGDYPLIEVGEFELNRNPNNYFQDVEQAAFAPTNIVPGLDYSPDKMLQGRLFPYGDAQRYRLGVNHWQIPVNQPKGVGIENLCPFSRDGQMRILDDNQGGGPHYYPNNQGVYDSQPEFKKPPFPADGDGYEYNQRQDDDNYFEQPGKLFRLQSDEAKERIFTNTANAMDGVTEDVKRRHIRHCYKADPDYGKGVAKALGIDINSIDLEGEQDETYENFKN

SEQ ID NO: 1907 - protein, 452 aa, Phycodrys quercifolia
GKVKNDRYESGVIPYAKMGYWDPEYVIKETDILALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAGTGEIKGHYMNVTAATMEEMYERAEFAKQLGSIIIMIDLVIGYTAIQTMGIWARRNDMILHLHRAGNSTYSRQKIHGMNFRVICKWMRMAGVDHIHAGTVVGKLEGDPLMIKGFYDTLLLPQLEVNLPLGIFFKQDWASLRKVTPVASGGIHCGQMHQLLDYLGNDVVLQFGGGTIGHPDGIQAGATANRVALESMVIARNEGRPYVEEGPQILRDAAKTCGPLQT

SEQ ID NO: 1908 - protein, 466 aa, Batrachospermum helminthosum
LCKMGYWDPDYVIKETDVLALFRITPQPGVDPVEAAAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGCDFVNEGPQILRDAAKTCGPLQTALDLWKDISFNYTSTDTADFVETPTANV

SEQ ID NO: 1909 - protein, 337 aa, Lentinula edodes
MAVKVGINGFGRIGRIVLRNALLNPEVNVVAVNDPFIALEYMVYMFKYDSVHGRFKGTVETKGGKLIVDGKEISVFGEKDAGAIPWSSVGAEYIVESTGVFTTIEKASAHLKGGAKKVIISAPSADAPMYVCGVNLDSYDSQHAVISNASCTTNCLAPLAKVIHDKFGIVEALMTTVHATTATQKTVDGPSNKDWRGGRSVNGNIIPSSTGAAKAVGKVIPSLNGKLTGLAFRVPTLDVSVVDLVCRTEKSATYDEIKAAVKEASKGPLKGILGYTEDHVVSTDFIGDNHSSIFDATAGIQLNKNFVKLIAWYDNEWGYSGRVVDLLVFAAKKDGAL

SEQ ID NO: 1910 - protein, 459 aa, Gelidiella acerosa
  unsure (1)..(459): unsure at all Xaa locations
DPDYQVKETDVLALFRVSPQPGVDPVEASAAVAGESSTATWTVVWTDLLTACDLYRAKAYKVVEVPNATDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEIKGHYMNVTAAXMEDMYERAEXXXQLGTIIIMIDLVIGYTAIQTMAIWARKNDMILHLHRAGNSTYSRQKIHGMNFRVICKWMRMAGVDHIHAGTVVGKLEGDPLMIKGFYNTLLLPYLEINLPQGIFFEQDWASLRKVTPVASGGIHCGQMHQLLDYLGNDVVLQFGGGTIGHPDGIQAGATANRVALEAMVIARNEGKDYVAEGPQILRDAAKTCGPLQTALDLWKDITFNYTSTDTADYVETPTANV

SEQ ID NO: 1911 - protein, 784 aa, Oryza sativa
MWRLRVAEGGGDPWLRTKNGHVGRQVWEFDPAAGDPDELAAVEAARRGFAARRHELKHSSDLLMRMQWPVGKSNWVSMFLASYEDCRMQRTQFAKANPLKLDIPAIKLEEHEAVTGEAVLSSLKRAIARYSTFQAHDGHWPGDYGGPMFLMPGLIITLYVSGALNTALSSEHQKEIRRYLYNHQNEDGGWGLHIEGHSTMFGSALTYVSLRLLGEGPDSGDGAMEKGRKWILDHGGATYITSWGKFWLSVLGVFDWSGNNPVPPEIWLLPYFLPIHPGRMWCHCRMVYLPMCYIYGKRFVGPVTPIILELRKELYEVPYNEVDWDKARNLCAKEDLYYPHPFVQDVLWATLHKFVEPAMLRWPGNKLREKALDTVMQHIHYEDENTRYICIGPVNKVLNMLACWIEDPNSEAFKLHIPRVHDYLWIAEDGMKMQGYNGSQLWDTAFTVQAIVATGLIEEFGPTLKLAHGYIKKTQVIDDCPGDLSQWYRHISKGAWPFSTADHGWPISDCTAEGLKAALLLSKISPDIVGEAVEVNRLYDSVNCLMSYMNDNGGFATYELTRSYAWLELINPAETFGDIVIDYPYVECTSAAIQALTAFKKLYPGHRKSEIDNCISKAASFIEGIQKSDGSWYGSWAVCFTYGTWFGVKGLVAAGRTFKNSPAIRKACDFLLSKELPSGGWGESYLSSQDQVYTNLEGKRPHAVNTGWAMLALIDAGQAERDPIPLHRAAKVLINLQSEDGEFPQQEIIGVFNKNCMISYSEYRNIFPIWALGEYRRRVLAADK

SEQ ID NO: 1912 - protein, 482 aa, Microspongium tenuissimum
NRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 1913 - protein, 193 aa, Brassica oleracea
MQDQLMCHGCRNTLLYPRGATNVRCALCNTINMVPLHPPPPPPHHAHAGMDMAHIVCGGCRTMLMYTRGASSVRCSCCQTVNLVPATPPTNQPAHVNCGNCRTTLMYPYGAPSVRCAVCQFVTNVNMGNGRVPFPTNQPNGTASSPGPMPSTSTQSTPPSQTQTVVVENPMSVNESGKLVSNVVVGVTTDKKK

SEQ ID NO: 1914 - protein, 255 aa, Hordeum vulgare
RTLSLAFQSVGIIYGDIGTSPLYVYSSTFPDGIRNRDDLLGVLSLILYTLIIIPMLKYVFIVLYANDNGDGGTFALYSLISRYAKIRLIPDQQAEDAAVSNYHIEAPNSQLKRAQWLKQKLESSKAAKIVLFTLTILGTSMVIGDGTLTPAISVLSAVSGIREKAPSLTQTQVVLISVAILFMLFSVQRFGTDKVGYTFAPVISVWFLLIASIGMYNLVVHDIGVLRAFNPMYIVQYFIRNGKSGWVSLGGIILC

SEQ ID NO: 1915 - protein, 215 aa, Candida glabrata
MSALRTVSGSSGNGKSYDSIMKILLIGDSGVGKSCLLVRFVEDKFNPSFITTIGIDFKIKTVDINGKKVKLQLWDTAGQERFRTITTAYYRGAMGIILVYDVTDERTFANIKQWFKTVNEHANDEAQLLLVGNKSDMDTRVVTYEQGEALAKELGLPFIESSAKNDDNVNEIFFTLARLIQEKIDSNKLSGPNSGKDGNISINANKGDSSKSNCC

SEQ ID NO: 1916 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 1917 - protein, 100 aa, Glycine max
MALSKLLVASLLVSFVLFHLVDADDQSAYAQTQGSLVQQIDCNAACAARCRLASRQRMCHRACGTCCRRCNCVPPGTSGNQEVCPCYASLRTHGGRRKCP

SEQ ID NO: 1918 - protein, 297 aa, Escherichia coli O157:H7 EDL933
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 1919 - protein, 723 aa, Saccharomyces cerevisiae
MSSRALRRLQDDNALLESLLSNSNANKMTSGKSTAGNIQKRENIFSMMNNVRDSDNSTDEGQMSEQDEEAAAAGERDTQSNGQPKRITLASKSSRRKKNKKAKRKQKNHTAEAAKDKGSDDDDDDEEFDKIIQQFKKTDILKYGKTKNDDTNEEGFFTASEPEEASSQPWKSFLSLESDPGFTKFPISCLRHSCKFFQNDFKKLDPHTEFKLLFDDISPESLEDIDSMTSTPVSPQQLKQIQRLKRLIRNWGGKDHRLAPNGPGMHPQHLKFTKIRDDWIPTQRGELSMKLLSSDDLLDWQLWERPLDWKDVIQNDVSQWQKFISFYKFEPLNSDLSKKSMMDFYLSVIVHPDHEALINLISSKFPYHVPGLLQVALIFIRQGDRSNTNGLLQRALFVFDRALKANIIFDSLNCQLPYIYFFNRQFYLAIFRYIQSLAQRGVIGTASEWTKVLWSLSPLEDPLGCRYFLDHYFLLNNDYQYIIELSNSPLMNCYKQWNTLGFSLAVVLSFLRINEMSSARNALLKAFKHHPLQLSELFKEKLLGDHALTKDLSIDGHSAENLELKAYMARFPLLWNRNEEVTFLHDEMSSILQDYHRGNVTIDSNDGQDHNNINNLQSPFFIAGIPINLLRFAILSEESSVMAAIPSFIWSDNEVYEFDVLPPMPTSKESIEVVENIKTFINEKDLAVLQAERMQDEDLLNQIRQISLQQYIHENEESNENEG

SEQ ID NO: 1920 - protein, 58 aa, Glycine max
MATIKAVKARQIFDSRGNRTVEVDVILSDGCFHRAAVPSGASTGVYEALELRDGGSYY

SEQ ID NO: 1921 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 1922 - protein, 176 aa, Triticum aestivum
  unsure (1)..(176): unsure at all Xaa locations
LSPSTAMGGGNDGHGYPPGGQGGYPPQGYPPQQGGYPPQQGYPPAPGAYPPAPGAYPPAPGAYPPAPGAGGRARGEGAXSNILHHGGGGMGMGGMLAGGAAAAAAPYGAHKIPQXGHGGGGHMMGGMMGGHGGYGGGYGHHGGKFKHGKHGHGKFKHGKHGKHGMFGGGGKFKKWK

SEQ ID NO: 1923 - protein, 473 aa, Nostoc punctiforme
MTTPQELLKKIQDEKIQLIDLKFIDTVGTWQHLTLYQNQIDETAFTDGVPFDGSSIRGWKAINESDMTMVLDPNTAWIDPFMEVPTLSIICSIKDPRTGEPYNRCPRVIAQKAVDYLVASGIGDTVFFGPEAEFFLFDSARFAQTANEGYYFLDSEEGAWNSGKEGTAEKPNLGYKPRFKEGYFPVAPTDSFQDIRTEMLLTMAELGVPIEKHHHEVATGGQCELGFRFGKLIEAADWLMTYKYVIKNVAKKHNKTVTFMPKPIFGDNGSGMHCHQSIWKDGQPLFAGDKYAGLSDMALYYIGGLLKHAPALLAITNPSTNSYKRLVPGYEAPVNLAYSEGNRSASIRIPLSGKNPKAKRLEFRCPDATSNPYLAFAAMLCAGIDGIKNKIHPGEPLDKNIYELSPEELAKVPSTPSSLELALQALENDHGFLTESGVFTEDFIENWIDYKLNEAKQLQLRPHPYEFYLYYDA

SEQ ID NO: 1924 - protein, 143 aa, Triticum aestivum
  unsure (1)..(143): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLDSASWVHLPVEHNASPXYYDGRYWDNVXTAYFGCTDPPVGSQEGYLTLCISVRS

SEQ ID NO: 1925 - protein, 391 aa, Halobacterium sp. NRC-1
MDPALIALFAGAALASLFMAWVIGAGSSGATPYAPAVGANAISTMRAALLVGIFGFVGAVTQGGNVSEAIGSGLVGGISLPIAGVILVLVLGAGLMAIGITTGYPIATAFTVTGAVIGVGLALGGSPVWPKYQQIAAVWVLTPFVGGGIAFTIASLLPRPGVPERYSIPVLAGLVGAVLVNIQFSFLGAGSAAGTVRGVGQRVLAVDGLTSAVGITGFAALVVATVVWWDVSRDERGGLRRVLLALGSLVAFSAGGSQVGLAVGPLLPLLDEVGMVSTFAVLVGGGLGMLVGSWTGAPRMIKSLAQDYSSLGPRRSISALVPSFLIAQLAVLLGVPVSFNEIVVSAIIGSGAAVGGREAVDARKIGVTIGAWIGSFALSFALAYAAGALLL

SEQ ID NO: 1926 - protein, 65 aa, Zea mays
MNLTVSRIALVKPDKARGVEDVLLRAAQTGGISEKVSEERLISLLEQINSHTSKQTKVTVCQRRW

SEQ ID NO: 1927 - protein, 500 aa, Triticum aestivum
MATTPRLASLLLLLALCAAAAGALRLPPDASFPGAQAERLIRALNLLPGRPRRGLGAGAEDVAPGQLLERRVTLPGLPEGVGDLGHHAGYYRLPNTHDARMFYFFFESRGKKEDPVVIWLTGGPGCSSELAVFYENGPFTIANNMSLVWNKFGWDKISNIIFVDPATGTGFSYSSDDRDTRHDEAGVSNDLYDFLQVFFKKHPEFVKNDFFITGESYAGHYIPAFASRVHQGNKKNEGTHINLKGFAIGNGLTDPAIQYKAYTDYALDMNLIQKADYDRINKFIPPCEFAIKLCGTDGKASCMAAYMVCNSIFNSIMKLVGTKNYYDVRKECEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKESVPEEEPATTFYAAI

SEQ ID NO: 1928 - protein, 252 aa, Bacillus subtilis
MRKPIIAGNWKMNKTLGEAVSFVEEVKSSIPAADKAEAVVSPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 1929 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVNKSA

SEQ ID NO: 1930 - protein, 276 aa, Triticum aestivum
LARMQLAKKNNFSLDQQKPNDEATVDINVATVSEALRRALGYFSAIQAHDGHWPGDFPGPLFTTATMMRVLYVTESLGTTLSSEHRKEICRYLYNRQNIDGGWGLHAEGESSMLSSALNYAALRLLGEGADDGPDMSMPKARKWIHDHGGATMIPILGKVWLSVLGVSEWSGVNPMPPELFLLPSFVPIQPGRLWSHFRMAFIPMSYLYGKKFVGPITKLVLSLREELHIHPYKKINWKQARKLCAKEDAYHPHTWLQECLSDCLYSFGEPFLACW

SEQ ID NO: 1931 - protein, 107 aa, Glycine max
FIEVAYPHCATCFGRCYPGGATLVMDAKNVYDGISRLLETSSSRELPKPVNNEESKSVAENGELPKMENGETPDAKESEAVIGKDVNEEGPTLQIDQEDPNLEKSVE

SEQ ID NO: 1932 - protein, 507 aa, Oryza sativa; identical to SEQ ID NO: 560

SEQ ID NO: 1933 - protein, 866 aa, Oryza sativa
VNGKVLDKTAKVTLVGGDEVIFSSLGRHAYIFQQLPEERSSTSTFSATCAFQQGQYPVTKGTLDVSSKGAKLSVMPFNFGNGRPPLVPHDTEIVSSLCKTMEEQSQLASEENLQVAQHQLLKEDLKKVVVNASDISDSFDSFPYYLSENTKNALLSSAYVNLCCKESIKWTKHISSLCQRSEIYQESLVKALTKHFGAKLLIIDPSLLASSSKSKESESYKKGDRVRYIGSVQSTGIILEGQSRAPDYGSQGEVRLPFEENESSKVGVRFDKKIPGGIDLGGNCEVDRVDSLCLDGPGWEDRAKHPFDVIYEFASEESQHGPLILFLKDVEKMCGNSYSYHGLKNKIESFPAGVFIVGSQIHTDSRKDKSNSGSPFLSKFPYSQAILDLTFQDSFGRVNDKNKEALKIAKHLTKLFPNKVTIQTPQDELELSQWKQLLDRDVEILKAKANTSKIQSFLTRNGLECADIETSACVKDRILTNECVDKVVGYALSHQFKHSTIPTRENDGLLALSGESLKHGVELLDSMQSDPKKKSTKKSLKDVTTENEFEKRLLGDVIPPDEIGVTFEDIGALENVKETLKELVMLPLQRPELFSKGQLMKPCKGILLFGPPGTGKTMLAKAVATEAGANFINISMSSIASKGEKYVKAVFSLASKIAPSVIFVDEVDGMLGRRENPGEHEAMRKMKNEFMVNWDGLRTKDKERVLVLAATNRPFDLDEAVVRRLPRRLMVNLPDASNRKKILSVILAKEDLADDVDLEALANLTDGYSGSDMKNLCVTAAHCPIREILEREKKERASAEAENKPLPPPRSSSDVRSLRMNDFKHAHEQVCASITSDSRNMTELIQWNDLYGEGGSRKKTSLSYFM

SEQ ID NO: 1934 - protein, 533 aa, Burkholderia fungorum
MPWIVRTATHRCDFAQSDKMFAICSPSRARAGPAPMCDDRAACRFPLYRNPSMAIPSYTDTRLLINGEWCDAASGKTLDVINPATGQAIGKVAHAGIADLDRALAAAQRGFEAWRKVPANERATTMRRAAALVRERASDIGRLMTQEQGKPFAEARIEVLAAADIIEWFADEGRRVYGRIVPSRNLAAQQLVLKEPIGPVAAFTPWNFPVNQVVRKLSAALACGCSFLVKAPEETPASPAALLQAFVEAGVPAGTVGLVFGDPAEISGYLIPHPVIRKVTFTGSTPVGKQLAALAGAHMKRATMELGGHAPVIVAEDADVALAVKAAGGAKFRNAGQVCISPTRFLVHNSIREEFAAALVKHAEGLKLGDGLAEGTTLGPLANARRLSAMSKVLDDARKTGAKVETGGERVGSEGNFFAPTVLTNVSLEADVFNNEPFGPIAAIRGFDKLEEAIAEANRLPYGLAGYAFTKSFSNVHLLSQQVEVGMLWINQPATPSPEMPFGGVKDSGYGSEGGPEAMEGYLVTKAVSVMAV

SEQ ID NO: 1935 - protein, 251 aa, Hordeum vulgare
MGRSPCCEKEHTNKGAWTKEEDQRLIAYIRANGEGCWRSLPKAAGLLRCGKSCRLRWMNYLRPDLKRGNFTDDEDELIIRLHSLLGNKWSLIAGQLPGRTDNEIKNYWNTHIKRKLLSRGMDPHTHRPLTAVIDAAAPTRPAQIAVPARAAPTTMFALPTKQQQPPVPVESSDDDGSSGATSTGEPRCPDLNLDLSVGPPAADTPTSHPVCLCRHLGFRGGEACSCRQADSAGSQGGGFRYFRPLEEGQYI

SEQ ID NO: 1936 - protein, 161 aa, Zea mays
MDGRMFGLETPLMVALQHLLDVPDGDAGAGGDKAGGGGPTRTYVRDARAMAVTPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 1937 - protein, 686 aa, Bacillus circulans
APDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIAFAPNHTSPASSDQPSFAENGRLYDNGTLLGGYTNDTQNLFHHNGGTDFSTTENGIYKNLYDLADLNHNNSTVDVYLKDAIKMWLDLGIDGIRMDAVKHMPFGWQKSFMAAVNNYKPVFTFGEWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 1938 - protein, 462 aa, Zea mays
ISGGEETYEDSPSNGERTGSSPPLQAAPRVQPFSAPAPIPIFSSKPRAAVRSPIPPPHLPAAVTSAPAPLAATAEAPSRPPPASTDQPPQQQTGAMPPPPAPAPAGKGGPKPKAQLNEQNSGEYSQSENNVVETAQGHDKETTPGPVKATKRIKKLKASKHNLNNTNSGAIEGDADPSLSSLNHCRYDSSLSLLTKKFINLLQGAEDGALDLNKAAETLEVQKRRIYDITNVLEGVHLIEKGLKNMVRWKGFDISKPKDIERQISSLKEELESLYDEELRLDDEIREAKEKLQALALDGDKRKSLYLLKEDINKIPHFQRSTMIAINAPRGTCVEVPDPNADQYMYGNLGLQEKHYKIVLRSSMGPVDCYLISGDHEDIFNQGQLVAADRLKPAVATDSSQDLQQMDCDPNQASNGGCMRAAEPSRKQEIGILRIVPSDADADADYWLASGVDVSMTDAWGT

SEQ ID NO: 1939 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTAKKIVIKDVIADAFLQQILLRRPEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 1940 - protein, 465 aa, Yersinia pestis CO92
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 1941 - protein, 442 aa, Oryza sativa
MAVTIQSVKARQIFDSRGNPTVEVDVGLSDGSFARGAVPSGASTVIIRYMLIPFDLRFPRNAYLRYHRMVGIYEALELRDGGSDYLGKGVLKAVSNVNTIIGPALIGKDPTEQVDIDNFMVQQLDGTSNNWGWCKQKKLQHIANLAGNKTLVLPVPAFNVINGGSHAGNKLAMQSIIKKKYGQDATNVGDEGGFAPNIQVVIGMDVAASEFYSEKDKTYDLNFKEDNNDGSHKISGDSLKDVYKSFVSEYPIVSIEDPFDQDDWATYAKLTDEIGQQVQIVGDDLLVTNPTVNQIGSVTESIEAVRMSKRAGWGVMASHRSGETEDTFIADLSVGLSTGQIKTGAPCRSERLAKYNQEQVRIRALDTCSALGLIAPGISLRVCISDRQQKMRTSSLEEMILLNKNQTTQNQHKIKAVLQCKARQRTHNDEVNPFAPTRTDAQ

SEQ ID NO: 1942 - protein, 91 aa, Triticum aestivum
EIWAWDTFDCMPTAADGYSEQERAQLALIQRFLAGGFSLSGDHHHLSQQWSPPRCAADSYIVDTMKDLHQLPWLERFVSVMSDTYNDDYIQ

SEQ ID NO: 1943 - protein, 598 aa, Photobacterium profundum
MSQFNASLPLLGFAAYSGTGKTTLLEAMLPKLVERGIRVAVIKHAHHNFDIDQEGKDSYRLRKAGASQMLISSRYRRALVTETPEEEASLPYLIAQLDQTQLDLILVEGFKKLSFPKIELHREEVGKPWLHPDDSNIIAVAANVDADTTLPKLDINNLEKLTDFVVAFAKDNKDFKANTQENKQGLLCGDLTPSGMLSVDEGRDRILSQIEALQSTQKVDLKAALGQIVSRDILSPVNVPQHTNSAMDGYAIRGDDLERDNYNVVAQVMAGHSYDTPLEKGQAVRIMTGAPVPECADTVVMREQAEQEGDAVTFNLNMSPIYAGQNVRQAGEDLALGQTAVAAGTKIEAPELGMLASLGIDSVKINAPVRVAIFSTGDEVQHPGEAQKTNCIYDSNRYTLHAMLTQAGCEVIDLGIIEDNEASLEETLVKASEQADLILSSGGVSVGDADYIKTVLDKLGLINFWRINMRPGRPLAFGQIADTPFFGLPGNPVAVMVVFLQFVEPAIRKLQGINNWQPEVLNAIASERFRSRPDRTEYTRGIFSFDANGRLTVKSTGQQGSGILRSMSEANCLVEVLPEQANAEVGDTVRVIPLKSRI

SEQ ID NO: 1944 - protein, 197 aa, Syrrhopodon muelleri
GGAKKVVISAPSKDAPMFDMGVNEEKYTNEDIVSNASCTTNCLAPLAKVINDKFGILEGLMTTVHATTATQKTVDGPSNKDWRGGRSAASNIIPSATGAAKAVGKVLPELNGKLTGMAFRVPTTDVSVVDLTVRLEKPASYDAIKAALKEASQGKLKGILGYTEDEVVSSDFITDSRSSIVDAKAGIALSDTFVKLI

SEQ ID NO: 1945 - protein, 823 aa, Phanerochaete chrysosporium
MGLTLVVLLHLALGLLTGVQAQSGLYQQCGGIGWTGATTCVSGATCTVLNPYYSQCLPGAATTSVSSSHSSSSSVSSHSSSASSSSISSTSTSPPAPSQTVANVSPEWAAAYVKAQAAVAKLSVTDMVNLATGVQWQKGPCVGNTPAISSIPGFTGLCLQDSPVGVRYADGTSVFPPEINVAATWNRTLMRQRGAAMGAEFKGKGVHVALGPMMNLMRVPAAGRNWEGGGGDPFLSGEVAFETITGIQSSGAQACAKHFINNEQEHFRDSSSSNVDDRTEHELYGHPFLRSVQANVASVMCSYNQINGTFSCENEKTLSGLLKGEYGFQGYVMSDWWATHSGAPAVNAGLDMTMPGDETLSSGTTYFGQNLVNAVNSGQVSQARVKDMATRILAAWYLLGQDQNFPAVNFNSWNSGQGQHVNVSGNHASLIRTIGAASQILLKNVNSALPLKKPKTIGIIGNGAGSNPNGPNAFSDRAGDVGVLALGWGSGTANFPYLVAPVDAITARASQDGTTVSSSLSDTDLTGAANTATGKDVAMVFITADSGEGYLTVEGNAGDRNDLQAWHGGDALVQQVASHNKNTIVVINSVGPINMEAWVNHPNVTAIVWSGLPGQEAGNAVTDVLFGAVNPGGKLPFTIGKSISDYSAQIITTGSGIVPIPYNEGLFIDYRHFDQAGIAPRFEFGFGLSYTTFDYSNLVITGSTAGGTRQPPGPGSSLDPWLHDSVVTVSFTLTNNGTVDGTEVPQLYLSPPASAKSAPQNLKGFDSVFLPAGASTTVSFELSRYSFSVWDVVSQSWQIPAGVTGISVGASSRDLRLKGSITN

SEQ ID NO: 1946 - protein, 167 aa, Listeria monocytogenes
ARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREVRGSSVHAFKWINEEGKTVYVKLRWVPKAGI

SEQ ID NO: 1947 - protein, 461 aa, Chondracanthus tenellus
YWDPDYVVKDTDVLALFRVSPQPGVDPVEASAAVAGESSTATWTVVWTDLLTACDLYRAKAYKVDSVPNTSDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRSIAASGETKGHYLNVTAATMEEMYERAEFAKQLGSIIVMIDLVIGYTAIQTMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALESMVIARNEGRDYVSEGPQILQDAAKTCGPLQTALDLWKDITFNYTSTDTADFVETPTANV

SEQ ID NO: 1948 - protein, 488 aa, Vaucheria prona
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNATAGTMEEMYERAEYAKKLGTIIVMIDLVIGYTAIQSMAIWARKADMILHLHRAGNSTYARQKNHGINFRVICKWMRMAGVDHIHAGTVVGKLEGDPLMVKGFYNTLLDTKLDINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 1949 - protein, 536 aa, Glycine max
CLSIRPRDVSSRPTRGRTRGPPTRPRTRGRPRVGSSSRFLKMSLSFVLLFLISIPPSFSSPIHPTSNDLRFSSTAEKLIRGLNLFPKDPINTLENDPLFVSGSIVEKSFTFPSLAASSESSVEELGHHAGYYRLPRSKAARMFYFFFESRSSKNDPVVIWLTGGPGCSSELALFYENGPFQLTKNLSLVWNDYGWDKASNIIFVDQPTGTGFSYTSDESDIRHDEEGVSNDLYDFLQAFFKEHPQLTKNDFYITGESYAGHYIPALASRVHQGNKAKEGIHINLKGFAIGNGLTNPEIQYQAYTDYALDRGLIKKADYDSINKLIPPCKQAIEACGTEGGETCVSSLYVCNKIFNRIMTIADDVNYYDIRKKCVGDLCYDFSVMEDFLNKKTVRDALGVGDLDFVSCSSTVYSAMMQDWMRNLEVGIPTLLEEGIKVLVYAGEEDLICNWLGNSRWVNAMEWSGQKQFGASGTVPFLVDGAEAGTLKSHGPLSFLKVYEAGHMVPMDQPKAALEMLRSWMQGKLTMTKSGDNVSPK

SEQ ID NO: 1950 - protein, 233 aa, Escherichia coli CFT073
MNMKISPSLMCMDLLKFKEQIEFIDSHADYFHIDIMDGHFVPNLTLSPFFVSQVKKLASKPLDCHLMVTRPQDYIAQLARAGADFITLHPETINGQAFRLIDEIRRHGMKVGLILNPETPVEAMKYYIHKADKITVMTVDPGFAGQPFIPEMLDKVAELKAWREREGLEYEIEVDGSCNQATYEKLMAAGADVFIVGTSGLFNHAENIDEAWRIMTAQILAAKSEVQPHAKTA

SEQ ID NO: 1951 - protein, 225 aa, Zea mays
MATPVRPAAAAPARRPPQPLPLPAEPHHDTMLTLSLALPLPLPPPAFVVRALSPDGGGVARVRSSPTGDDTPPCTECGKRFPSWKALFGHMRCHPERQWRGMTPPHFRQHRTVVAAADLQFTEQERETATSLLMLGGGRPAGAGKGKKSVLGASPSAKKVTCGASKSASSPPPTVPRCDDDHKCSVCARGFATGQALGGHKRCHWERTTACAEGTTTVAAIATPA

SEQ ID NO: 1952 - protein, 509 aa, Zea mays
  unsure (1)..(509): unsure at all Xaa locations
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGQGAXDFPGAAHLLRYYAGAADKVHGATLKMAQRMHGYTLKEPRGGVVGHHXVPWNYPTTMFFFKVGPAARRRLAPVVVKPAEQTPXLSALFYAHLARXEAGVPAGVLNVVPGFGPXTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 1953 - protein, 559 aa, Prochlorococcus marinus str. MIT 9313
MACPSLLVAIRRGLRALRIWRAVLTLIIFVWWDARHWTYPGGCTSERRQARQTIRARWLTTELLQLGSAFIKLGQLLSARPDVLPVQWVSELADLQDKVPAFSFEQAQILLEQELGDRCAEIIDLDDQPLAAASLAQVHRASLRSGRQVVLKIQRPRLERLFRLDLQIMQQVAAVLQRHPKWGRGRDWVGIAQECRRVLLRELDFRVEAQYAARFRQQFLDDSRIRVPAVVWELSTRRVLCLDYLPGIKVNDLDALLKAGIDPSAVAELGAASYLQQLVRFGFFHADPHPGNLAVAPDGALIYYDFGMMGLLSDSLRRRLGSMIRAAAARDAAALVEELQAAGLIAYGIDVGPVRRLVRVMFQDALTPPFSANVIEKLSGDLYELVYGQPFRLPVELIFVMRALSTFEGVGRSLDSGFSLMAIAKPYLLPLMTSSGSGPNDLFNELGRQVGAIGSRAAALPRRLDESLERLEQGDLQLQIRMGESDRQLRRMISVQKALGQSVLLGSLGIAAALLGASSRPIWAVLPLVAALPVGFGWFKLQIKLGRESRMDHLSSQSR

SEQ ID NO: 1954 - protein, 1448 aa, Neurospora crassa
MYWPIGTPRIYATSASCPPSYPHLYSHDGLPAPDQRPTRASLLSPGPTADGHDASSVPPTPITPVAPFTPAIKSVEHDYYDDGQSEPPSPPPPEPSRSNAPPREPILALRVARAGHLFAVITSTSMTIWQTKPTVVLAVVVRSEASLKSYGTNTSLMLRPDAAIFVVRTSLGYLITYSLATDADSRVYKPHFSSHTNVQKRRQTHAGGPGAIAPDQILWGPGEGSGVRDVSVRFRMVIKVDAGIESALALDDELVVATRKPAAVQCIRWTPDSSGSQTSTELLSRMGWVDKKVMVREMTHDRRMNLSTWVTSDGKAYAVQRISGSQLEPDTNQPPDPKKLFKGYCFYTPQTPGEQAIRCIVNAVFSLIAVGCADGNIRVFSAKDYSGNIPASHVHNLPASNNTCGRLTTLSYSPDGYCLFAGYEKGWATWSVYGKPLSNSFGADQTIASTTGEEWISGVLDAAWIGGGCELLLVGRAHESIWLLEMARSAVTGCYNSANLFRTVLQSTSSVMVYRGYDLPDLTSISAEPGLWHTARIPASYLMNHWPIRCTAISSDGRYVAVAGRRGLAHYSVNSSRWKTFADGDAENQFMVKGGMCWYQNILVAAVEANRSFELRLYSREASLDSSNVLHTQEMSAPVVLVTPSGEDSLLVYTYDNLLYHFIFAPFGGTVRLVEVGHIAFHGIIRSPARVRGLSWILPESQLLDGDPSQDVAHASVLFLVDGKLVLLRPSYNEGGLKYDMRVIANNLEFYVSMRDQPFVGGVLTPSEKQVFTAAADDSLRNSLWIFDGSEIKTWTDVEPVLRATSGEATRELPPMTSIPIDFYPLSALLSKAIVLGVESDLIQRRDVSFSFFRFSIRCTRKTEVRSWRTLFAYLPPPQELFEESLQRGSLKTAGGYLLILHTFDELATASEQSVRLLSRAMREGDWELCKELARFLAALDETGDTLREAMELAKMRVKQESELEDGHGSVGSGLGTMLGVPQGGGANGASSTTSSLISNTKGIIGSDWDADRRTISDAGSVVSANRYLGSQMVDFADLITYLCVVPWFGPTKGSNAVLDPGTRDFGLVDAKRQPTVVRAHFPPTTTFLPSFYAPSIDVVSPAMDDFVSESESDYASYWRDWFISSRGNEYFCEIDEDYITDRFNLTGLNTEVQYYQYALDLITDVFDLDCDDDMRETIEKSARHLYGLVHARYIVTTRGLQKMFEKYKKADFGKCPRVMCSSHPLLPMGLSDVPNSKPVKLYCARCEDIYNPKSSRHAAIDGAYFGTSFHNIFFQVYPTLVPAKSVERYIPRCYGFKVHAAAALVRWQNSQRDEMRRRLRKLEVESGFKDAEDEAELDDDDEEEEEEEEEEEELAAMDEAEGAQQQHAAAAAADEEYWNSEATIGAADEADDEAELPNEPNEPNHWLTPLMSAAARLRRSLRLGEDYEEQAEVEFDEWMEQARYGIF

SEQ ID NO: 1955 - protein, 417 aa, Candida albicans
MMNIDQHHQLQQQHQQQMLQQQAQAQAQAQAQAQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 1956 - protein, 476 aa, Zea mays
  unsure (1)..(476): unsure at all Xaa locations
MGKLAARLRAFSRNRWLVLVAAMWVQSMAGIGYLFGAISPVLKARLGYNQRQLAALAVAKNVGGYVGVVAGTLSAALPAWAMLLMGAAQNLLGYGWLWLIVTGQAPPLPLWMARASDRASFVFVYAVCLLLASYLAGVKLVQDFLQLSDGVVVSLTVVLLVLLISPVAVPVALTLTPEAECPIREXPLLSSSEPXRERGTLRKNRLHAHLRAGAGRAPYLGENFTMMEALVKADFWLIWVSFLLGSGSGLTVMDNLGQMSQALGFEDAHIFVSLTSIWNFLGRIGGGYFSEIIARQRAYPRHIALAFAQVLIAAAHFLFAMAWPGTIYIGTFLVGLGYGAHWAIVPAAVSELFGIKHFGAMYNFLALANPTGSLVFSNLITSTLYDYEAEKQARQRRRRVMAELLASSPRSLHSAGLFAGAVVEEEDXLIKCEGPACFLVSSLIMSVLCVVGAGLSLVTVHRTRRVYARLYRSVRT

SEQ ID NO: 1957 - protein, 186 aa, Zea mays
  unsure (1)..(186): unsure at all Xaa locations
RLSRRSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYSNDLAYLKRKVDAGADLIVTQLFYDTDIFLKFVNDXRQIGITCPIVPGIMPINNYKGFLRMTGFCK

SEQ ID NO: 1958 - protein, 76 aa, Zea mays
  unsure (1)..(76): unsure at all Xaa locations
GVFPGKEIIHPPVVGHPSFMVWKDQAFXIWPRGGGCMFPEGDSSRELLKKVQKTFYLVSLVYNDYVQGGLFSALKI

SEQ ID NO: 1959 - protein, 506 aa, Brucella suis 1330
MVMSTIVKPQPLTGLEVREFSMLIDGKWVGSDSGKSIERVAPGHGVTVSRYPAGNKADVERAVSAARKAFDDGRWSSTTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 1960 - protein, 119 aa, Triticum aestivum
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIGRFSTGVHERASPETMRDI

SEQ ID NO: 1961 - protein, 389 aa, Triticum aestivum
VPNLATKFSCRTGPENHHQSVCPWRPSPTRKLLQAHTELWDLTFGYLKSMALECAIKLGLPNAIHRCGGAATLPDLLDAISVPERKKAHLPRLMRFLAAFGIFTVNAPAAEECADGEKASAVYGLTPVSRLLVDDAGANGSCGSLSPFVLSQTTRYHVKAAMHLPEWFMSDDGAAAVAMPFRMAHGTDLWGVMGRDPKMNQVFNAGMGSDTQLAMDFVIGNYGDVFEGVTSLVDVGGGTGSAARAIARAFPHVKCSVLDLPNVVNSIPPDGVVEYISGDMMSSIPNTDAVFLKYIMHDWNDEDCVKILTQCKKAIPESGGKVIIIDIVVGSPLKAMLEAQVSFDLLMMVITAGKERDEHEWRKIFMDAGFSHYKTRPILGFMAITELYA

SEQ ID NO: 1962 - protein, 467 aa, Thermoplasma acidophilum
MLYGVCRRKHLIIDGYLFSMIMEDQERTERYNEDALRYSEYFKGKIQTISKVPVRSLDDFSIWYTPGVAAVSRKIASDPDLSFELTGRWNSIAILTDGTRVLGLGNIGPEAAMPVMEGKALIFNYLGGVNAIPIPIRVQSKEEFVKVAKALEPSFGGINLEDIESPKCFFLLETLQNEMNIPVWHDDQLGTASITLAGVINSLRIVGKKIDQVKVVFNGAGAANIAAAYLFKAAGFKMKNMILVDSKGILHPEREDIDALMINNPWKYQLAIETNGERVKGDLSNAIEGADLLISAAKSGPDTIDSRIVKKMNNDAIVFVLANPIPEMWPQEAKENGARIVATGRGDFPNQINNSLVFPGVFRGVLDARAKGVNFDVMVAASYEIANFVEDPTEEKIVPTMEEWELYPRLASAVASKTVELGLARKSDSKEGFYRRAREIIESNRNIYSKLMDLGLIKRMPNGEHKN

SEQ ID NO: 1963 - protein, 142 aa, Zea mays
SALLEVRQILKAEKECQANQLRPEQLIVNGCPLRPEELTDLLSCSRPPQKLKPGKYWYDKESGLWGKEGEKPDRIISSNLNFTGKLQVNASNGNTQVYMNGREITKIELKVLKVTVLSCSRAAFLWSLMGIVTEVRGIYRVD

SEQ ID NO: 1964 - protein, 278 aa, Zea mays
  unsure (1)..(278): unsure at all Xaa locations
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAXIRRSLEGNLKGILGY

SEQ ID NO: 1965 - protein, 394 aa, Thermotoga maritima
MGSDKIHHHHHHMVKVLILGQGYVASTFVAGLEKLRKGEIEPYGVPLARELPIGFEDIKIVGSYDVDRAKIGKKLSEVVKQYWNDVDSLTSDPEIRKGVHLGSVRNLPIEAEGLEDSMTLKEAVDTLVKEWTELDPDVIVNTCTTEAFVPFGNKEDLLKAIENNDKERLTATQVYAYAAALYANKRGGAAFVNVIPTFIANDPAFVELAKENNLVVFGDDGATGATPFTADVLSHLAQRNRYVKDVAQFNIGGNMDFLALTDDGKNKSKEFTKSSIVKDILGYDAPHYIKPTGYLEPLGDKKFIAIHIEYVSFNGATDELMINGRINDSPALGGLLVDLVRLGKIALDRKEFGTVYPVNAFYMKNPGPAEEKNIPRIIAYEKMRIWAGLKPKWL

SEQ ID NO: 1966 - protein, 185 aa, Glycine max
ACAHLIKSIADDVNYYDIRKKCVGDLCYDFSVMEDFLNKKTVRDALGVGDLDFVSCSSTVYSAMMQDWMRNLEVGIPTLLEEGIKVLVYAGEEDLICNWLGNSRWVNAMEWSGQKQFGASGTVPFLVDGAEAGTLKSHGPLSFLKVYEAGHMVPMDQPKAALEMLRSWMQGKLTMTKSGDNVSPK

SEQ ID NO: 1967 - protein, 436 aa, Haemophilus somnus 129PT
MSNSITKNLSKHKLVKDTLVLILAGGRGSRLHELTDKRAKPALYFGGNRRIIDFALSNCINSGLNRIGVVTQYAAHSLLRHLQKGWSFLPQERGEFIDMLPARQQIDDSTWYRGTADAVYQNMAIIRDHYRPKYILILAGDHIYKQDYSQMLLDHVSSNAKCTVGCIEVPREQASEFGVMAVDENLKVKAFVEKPKDPPAIPNKPDTSLASMGIYVFDADYLYDVLMREVNTPYTSHDFGKDILPKSLEEEVLYAHPFSRSCMGRNTDGEIYWRDVGTLDSFWQSNIDLVSEHPQLDIYDQRWPIRGNPTQTYPSKFFYNKQDIKPVDNSLISGGCVITDAEISYSVLFDQVKVKADSKVEYSVVLPQVTIGKNCILRNCIIDRQVVIPDNTVIGVNIEEDRKRFRVSSTGKVILVTESMMKKLNGEKVVSEIHLD

SEQ ID NO: 1968 - protein, 173 aa, Oryza sativa
MAPLGDGAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHSSRRRRDGVYIKSGVGFVSLRRKFRRI

SEQ ID NO: 1969 - protein, 126 aa, Zea mays
MADPELEAIRQRRMRELQHGAANQQNAGQEKAQEDAKQEAEERRQMMLAQILSSEARERLSRIALVKPDKARGVEDVLLRAAQTGGISEKVSEERLISLLEQINSHTSKQTKVTIQRRRNVLDDDD

SEQ ID NO: 1970 - protein, 492 aa, Nicotiana tabacum
MDPYKYRPSSAFNSPFCTTNSGAPVFNNNSSLTVGARGPVLLEDYHLVEKLANFDRERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYVKFHWKPTCGVKSLLEEEAARIGGANHSHATQDLYDSIAAGNYPEWKLFIQTMDPDHEDRFDFDPLDVTKTWPEDILPLQPVGRLVLNKNIDNFFNENEQLAFCPSIVVPGVYYSDDKMLQTRIFSYSDTQRYRLGPNYLQLPANAPKCAHHNNHYDGSMNFMHRDEEIDYFPSRYDPVRHAEKYPIPSTMCTGKREKCVIQKENNFKQPGDRYRSFTPDRQERFIRRWVEALSDPRITYEIRTIWISYWSQADKSLGQKLASRLNVRPSI

SEQ ID NO: 1971 - protein, 602 aa, Oryza sativa
MELALVGNPSNGVAKPSCNSVGSLPVVSSNAVIHPPVTSAARATLGRHLARRLVQIGATDVFAVPGDFNLTLLDYLIAEPGLKLIGCCNELNAGYAADGYARALVGAFVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 1972 - protein, 345 aa, Triticum aestivum
  unsure (1)..(345): unsure at all Xaa locations
MECLAEMPHAPLDRRPRKRQRLGWDVGPEIPQLKKLCGEEVANVISAMTMGLSSGGIVSSQETQGLFRFVTPPLREDDKDGHYVFAVGDNLTSRYRINAKMGEGTFGQVLECWDRERKEMVAIKIIRGIKKYRDAAMIEIGMLEQLCKYEKSRSRFHXCSPKEGSYYKRVPKSSSIKVIDFGSTTYDQQDQTYVVSTRHYRAPEVILGLGWSYPCDIWSVGCILVELCTGEALFQTHENLEHLAMMERVLGPLPYHMLKKADRHGEKYVRKGRLNWPEGCASRESMKAVMKLPRLQNLVMQNVEHSAGDFINLLQGLLSYDPASRLTAQEALEHPFLTELSERRR

SEQ ID NO: 1973 - protein, 125 aa, Glycine max
  unsure (1)..(125): unsure at all Xaa locations
IPQWMPFISTVKVLEDKPELSRWTLKYAILGRDVEFSWLARNMTPTKNQKIHWRSLEGLPNRGAVRFFPKSSSSCRVQLTVAYEVPEILTPVASALKPFXEGLLFNGLERFVAFAKERYSKSLQS

SEQ ID NO: 1974 - protein, 507 aa, Solenostemon scutellarioides
MTSLLAHPLLPPPRRRPLPPLLPPPVSHPAGPRPGRWWRNLYDVKPVRFRCFAEWAQLFGPTFSVWFGSTLNVIVSSSELAKEVLKEKDGQLADPPRSRSAVKLSRDGKDLIWADYGPHYVKVRKVCTVVLFSPKRLELLRPIREDEITVMVESIYQDSAASGKSVVIKKYLASMAFHNITRLVFGKRFVNSEGEVDKQGQEFKAIAINGLKLGASLAVSEHIPWLRWMFPLDEDAFTQHGVRMERLTREIMQEHTLARQKTGGAKQHFFDALLTLKDEYDLSEDTIIALLWDMIAAGMDTPAISVEWAMAELVRNPRVQEKVQEELDRVIGHERIMTELDIPNLPYLQCVVKESLRLHPPTPVMLPHRSNADVKIGGYDIPKGSNVHVNVWAIARDPKSWKVPLEFRPERFLEEDVDIKGHDFRLLRFGAGRRVCPGAQLGIDLATSMIGHLLHHFRWTPPTGVRAEDIDMGENPGTVTYMRTPVEAVPTPRLPANLYKRVAVVDI

SEQ ID NO: 1975 - protein, 353 aa, Podospora anserina
MSNAQARGGARKISFNVSEQYDIQDVVGEGAYGVVCSAIHKPSGQKVAIKKITPFDHSMFCLRTLREMKLLRYFNHENIISILDIQKPRSYESFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSDMALDLLEKLLAFNPVKRITVEEALKHPYLEPYHDPEDEPTAPPIPEEFFDFDKHKDNLSKEQLKQLIYQEIMR

SEQ ID NO: 1976 - protein, 345 aa, Streptococcus pneumoniae R6
MAKKIVALVGDGIGPEIMEAGLEVLEALAEKTGFDYEIDRRPFGGADIDAAGPPLPDETLKASREADAILLVAIGSPQYDGVAVRPEQGLMALRKELNLYANIRPVKIFDSLKYLSPLKPERISGVDFVVVRELTGEIYFGDHILEERKARDINDYSYEEVERIIRKAFEIARNRRKIVTSIDKQNVLATSKLWRKVAEEVAQDFPDVTLEHQLVDSAAMLMITNPAKFDVIVTENLFGDILSDESSVLSGTLGVMPSASHSENGPSLYEPIHGSAPDIAGQGIANPISMILSVVMMLRDSFGRYEDTERIKRAVETSLAAGILTRDIGGQASTKEMMEAIIARL

SEQ ID NO: 1977 - protein, 671 aa, Oryza sativa
  unsure (1)..(671): unsure at all Xaa locations
MAMMMADLSFSSSISNVKLQRFRASSNETSLIKRSPVFRAEARSTETEKFRTNGRAIKMVPTTELKRSKSGVRVRPDTVNGSPSGAVNGSTKVAINGSPNAAVNGSMKAVTNGSVNGTSLVKGSNMSALVKTQKRMRPNDDPFEEELKVLPSDEGFSWAKDNYNSWQRSADIWSFVLSFRIRVLFDNAKWAYAGGFSEEKQKVRRRKTASWLREQVLQLGPTFIKLGQLSSTRSDLFPREFVDELAKLQDRVPAFSPEKAKAFIEKEMGCPIEVVYKEDNRPIAAASLGQVHRAVLHNGERVAVKVQRPGLRKLFDIDLRNLKLVAEYFQSSEAFGGPSRDWIGIYEECSKILYEEIDYINEGKNADRFRRDFRNIKWVRVPLIMWDYTTEKVLTLEYVPGIKINNLTLLDNRGYSRSLIASRSIESYLIQILKTGFFHADPHPGNLAIDTDGSLIYYDFGVMGEIKSFTRERLLSLFYAVYEKDAXKVMKALIDLEALQATGDLSPDLFAISQDQPFRFPSTFTFVIRAFSTLEGIGYILDPDFSFVKVAAPYAQELLDLKQRRTSAPELVREIRKQANSARDSTISMPYRIQRIEDFVGQLESGDLKLRVRVLESERAARKANVLQMATMYTAIGGTLLNVGVTLSSQGNQIVANGSFVGAGGVLFFVW

SEQ ID NO: 1978 - protein, 150 aa, Zea mays
  unsure (1)..(150): unsure at all Xaa locations
ARVRNVLNGGSHVFFRRFPRFRAXPCEAPTFYQAMRQGAEVYQKLKALAKKTYGQSAGNVFDEGGVAPDIQTAEEALDLITKAIEEAGYTGKINIGIDVASSEFYKADEKKCDLDFNNPDSDKSKWITSEQLIDMYKSLPEKYPIVNIDD

SEQ ID NO: 1979 - protein, 464 aa, GIBBERELLA ZEAE PH-1
MSNENSSGHGPRQYPVKWYRSTFYNMTVLGLCNLAAPGIWGAMNSLGAGGAQKPYLVNTANALTFCLMVLSCWGGSVLVHYIGIKGALIFGTFGYAPYAAGLYTNNRFGNEWLVILGAALCGISAGVFWMAEAAIAIAYPEPWNKGKALGYWLTYRLSGQIIGGAINLGLNVDRDEAGQVSYTVFLIFIAIQASGPLFALFLSPPNKVERTDGKKVDLSIVNNPWLETKKITRLFFTTKFLLIVLYIGAVVFSEAVFFTYLSLWFTVRSRALGSFVSGIIAVIGGNILGAWLDRTSVPLKRRTRGAFWVLVVLQGGWWTWATILVTRFNISQPTYDWSSPGFGAAFAIFVFLTFGFQLNYLFLYFVVQNLASDEEEIVRYAALLRGTESAWQAISYGTSSIPIMARVGGVYFNLALWAVSILPAWTVIKHFGSVPYGSDIDATSTPSSEDVKLKGSAKVTSSNE

SEQ ID NO: 1980 - protein, 323 aa, GIBBERELLA ZEAE PH-1
MSSALDQLKATGTTVVSDSGDFASIGKYKPQDATTNPSLILAASKKEEYAKLIDVAIDYAKQKGGSVDQQVDDALDRLLVEFGKEILKIIPGKVSTEVDARYSFDTEASVNKALHLIELYGEQGISKDRILIKIAATWEGIKAAEILQRDHGINTNLTLMFSLVQAIGAAEAGAYLISPFVGRILDWFKASTKKEYTKEEDPGVLSVKQIFNYYKKFGYNTIVMGASFRNTGEITELAGCDYLTISPNLLEDLLNSSDSVPKKLDASQASSLDIEKKSYIKDEALFRFDFNEDQMAVEKLREGISKFAADAVTLKGILKEKLS

SEQ ID NO: 1981 - protein, 323 aa, Oryza sativa (japonica cultivar-group)
MEEGLPPGFRFHPTDEELVTYYLARKVSDFGFATRAIADVDLNKCEPWDLPSKASMGEKEWYFFSMRDRKYPTGIRTNRATDSGYWKTTGKDKEIFHGGALAGMKKTLVFYRGRAPKGAKTSWVMHEYRLQSKFPYKPAKDEWVVCRVFKKLQCHLAKPRPPHDDVDGDGASPPEMVDASSLGELGELDVSSILLGGFAPPSGELCHGGGGGDGFGAHRLHVGAYMSWLQAAAAANQGMFQWPAATQAGLVGGTVFAAAHKAAGTMPFGGGCSQQQARDVGVSLANVGGGDALFGGAPLAKVDMECGEQAPQLDMDDSTWRAF

SEQ ID NO: 1982 - protein, 579 aa, Arabidopsis thaliana
MVSKECCRNEIRAAIRQLSDRCLYSAAKWAGEQLVGIEQDPSNFTPANTRFQRGSSSIRRRFSTNESISTPLPSVGFSQAATPLPEEDEAIDGDIYLLAKSYFDCREYRRASHMLRDQVSKKSLFLRYYALYLAGEKRKEEEMIELEGPLGKSDAINRELVSLERDLSALRRTGAIDSFGLYLYGVVLKEKGNESLARASLVESVNSYPWNWSAWSELQSLCTSIEILNSLNLNNHWMKEFFLGNAYQELRMHTESLAKYEYLQGIFSFSNYIQAQTAKAQYSLREFDQVEIMFEELLRNDPYRVEDMDLYSNVLYAKEACAALSYLAHKVFLTDKYRPESCCIIGNYYSLKGQHEKAVMYFRRALKLNKKYLSAWTLMGHEYVEMKNTPAAIDAYRRAVDINPTDYRAWYGLGQAYEMMGMPFYALHYFRKSIFFLPNDSRLWIAMAKCYQTEQLYMLEEAIKCYKRAVNCTDTEGIALNQLAKLHQKLGRNEEAAYYFEKDLERMDAEGLEGPNMFEALVFLATHFKNHKKFEEAEVYCTRLLDYSGPEKEKAKSLLRGIRMAQTGFPSMDLEHFPI

SEQ ID NO: 1983 - protein, 388 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANERDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 1984 - protein, 480 aa, Yersinia pestis CO92
MMSKKKGLTTAAGAPVVDNNNVITAGRRGPMLLQDVWFLEKLAHFDREVIPERRMHAKGSGAYGTFTVTHDITQYTRAKIFSEIGKKTDMFVRFSTVAGERGAADAERDIRGFAMKFYTEEGNWDLVGNDTPVFYLRDPLKFPDLNHVVKRDPRTNLRNPVYKWDFFSQLPEALHQLTIDFSDRGLPKSYRHMHGFGSHTFSLINANNERFWVKFHFRCQQGIENLMDDEAEKLIGSDRESSQRDLYEAIERGDFPRWKLQIQVMPEHEASQTPYNPFDLTKVWPHGDYPLIDVGYFELNRNPENYFAEVEQSSFNPANVVPGISFSPDRMLQGRLFSYGDAARYRLGVNHHQIPVNSAKCPFHNYHRDGAMRVDGNSGNGATYEPNSFGLFQEQPDFSEPPLTLEGAADHWNHREDTDYFSQPRALFNLLSEEEHQRMFTRIAGELSQVPEAIQRRQIALFTQVDPAYGAGVKKALGLN

SEQ ID NO: 1985 - protein, 515 aa, Oryza sativa
MGEDGGVNSSSNSPAAAVGLVLVVAICTYLAVVATRKQKRRRRRRPPVVGTAFHQLYHVRRVHDYHTALSREHMTFRLLVPAGREQIYTCDPAVVEHILRTNFANYGKGSFNHGNMSDLFGDGIFAVDGDKWKQQRKIASYDFTTRALRDFSGDVFKRNAAKLAGVVSSHAASNQSMDFQGFLMRATMDSIFTIAFGQDLNTLDGSGEGRRFAAAFDDASEFTMLRYLNPFWKLSRLLNVGAEAMLKERIKVVDGFVYKLIRDRSDELSNTKAHDTDSRQDILTRFIQATTSDSGTVDYKYLRDIILNIVIAGKDTTAGSLAWFLYMMCKHPEVQEKICHEAMEATNAGEAASIDEFSQSLTDEALNKMHYLHAALTETLRLYPAVPLDNKQCFSDDVLPNGFNVSKGDIVFYIPYAMGRMESLWGKDAESFRPERWLDENGVFQQESPFKFTAFQAGPRICLGKDFAYRQMKIFAAVLLRFFVLKLRDEKEIISYRTMITLSVDQGLHLTAMAR

SEQ ID NO: 1986 - protein, 329 aa, Beta vulgaris
MTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 1987 - protein, 535 aa, Rhodotorula sp. CBS 8446
MLALVCVGLFLYLLCKYRSHAIATSDRTDLAGPKGWPLMGVFKFPLPTLSVTYVVVDVTEKTLSGNLIFYATQSSTRGLEWGVRFVKTYGHAWTLSVPGLRLIDISTRPDWIEYVQKTNYHNYVKGSAFRNRLSDIIGNGIFVTDGRVWQFQRKVTSHIFTGRSFQDAICPAIAEELRSLNKLLDNYADTGETVDLQDVFYRFTFQAFGRFAFNLDLRNLEIDHKPVPFTTAFDQCQKPSLDASSTRSGAFASALPLPAVEYQTPPSCFRLCLRNDDKRAALLAKKDAKVPSDLLTMFMTARYDDSRPLSRVEIRDAIINLLLAGRDTTAQSLTWALYRLVDNPAHQRLVREEICGQLAGGTEPVTLENVKNLVQTQAAHLESLRLHPPVPRIVKQAVKDDALPNGGPLIKAGEFIRLSDWALGRNEEVWGADAKEWKPSRWIDDEGRPIQYSQWKAHFFNGGPRICLGKSLATLEGVAVIANLLHRYNIAFAPGWWENVEKTGRIAGDLEETPLYGPALTLPMKSPFWVTISRR

SEQ ID NO: 1988 - protein, 752 aa, Streptococcus pneumoniae R6
MLSLQEFVQNRYNKTIAECSNEELYLALLNYSKLASSQKPVNTGKKKVYYISAEFLIGKLLSNNLINLGLYDDVKKELAAAGKDLIEVEEVELEPSLGNGGLGRLAACFIDSIATLGLNGDGVGLNYHFGLFQQVLKNNQQETIPNAWLTEQNWLVRSSRSYQVPFADFTLTSTLYDIDVTGYETATKNRLRLFDLDSVDSSIIKDGINFDKTDIARNLTLFLYPDDSDRQGELLRIFQQYFMVSNGAQLIIDEAIEKGSNLHDLADYAVVQINDTHPSMVIPELIRLLTARGIELDEAISIVRSMTAYTNHTILAEALEKWPLEFLQEVVPHLVPIIEELDRRVKAEYKDPAVQIIDESGRVHMAHMDIHYGYSVNGVAALHTEILKNSELKAFYDLYPEKFNNKTNGITFRRWLMHANPRLSHYLDEILGDGWHHEADELEKLLSYEDKAAVKEKLESIKAHNKRKLARHLKEHQGVEINPNSIFDIQIKRLHEYKRQQMNALYVIHKYLDIKAGNIPARPITIFFGGKAAPAYTIAQDIIHLILCMSEVIANDPAVAPHLQVVMVENYNVTAASFLIPACDISEQISLASKEASGTGNMKFMLNGALTLGTMDGANVEIAELVGEENIYIFGEDSETVIDLYAKAAYKSSEFYAREAIKPLVDFIVSDAVLAAGNKERLERLYNELINKDWFMTLLDLEDYIKVKEQMLADYEDRDAWLDKVIVNISKAGFFSSDRTIAQYNEDIWHLN

SEQ ID NO: 1989 - protein, 135 aa, Burkholderia fungorum
MNDTTQLARRDSNTVSRAEPERTEQRVTLSPAVDVIENAHGVTLWADLPGVPRENLEIRVQDGNLRIEASANIPTREGLRLQHAEVRVPHFARSFTLGPEFDTSKIEAKLQDGVLKLSIPRREEARPRRIEVAVG

SEQ ID NO: 1990 - protein, 256 aa, Pantoea endophytica
  unsure (1)..(256): unsure at all Xaa locations
GAAGGIGQALALLLKTQLPSGSELSLYDIAPVTPGVAVDLSHIPTAVKIKGFSGEDARPALQGADVVLISAGVARXPGMDRSDLFNVNAGIVKNLVQQIAEVCPKACIGIITNPVNTTVAIAAEVLKKAGVYDKNKLFGVTTLDIIRSNTFVAELKGKQPTEVEVPVIGGHSGVTILPLLSQIPGVSFTEQEVADLTKRIQNAGTEVVEAKAGGGSATLSMGQAAARFGLSLVRXLQGEKGVVECAYVEGDGQYAR

SEQ ID NO: 1991 - protein, 486 aa, Rhodobacter sphaeroides
MIEKRDFYINGGWTAPAEARDCEVIDPSTEEACAVISLGDQADTDAAVAAAKAAFEGWAATPPAERLRLVKGILAQYEARKEEMAQAISLEMGAPIDLARNSQAPCLPWHLTNFLKAFEEIEWVRPLGPHAPNDRIALEPIGVVGLITPWNWPMNQVTLKVIPALLAGCTCVLKPSEEAPLSSLLFAEFVHDAGLPAGVFNLVNGDGAGVGTQLSSHPDVEMISFTGSTRAGRAISKAAAESLKRVTLELGGKGANLIFADADERAVERGVKHCFNNSGQSCNAPTRMLVERPLYDRAVEIAAEVAAKTRVASAHEEGPHIGPVVNKRQFEQIQSYIQKGIDEGARLVAGGLGRPDGLNRGFFVRPTVFADVTPGMTIEREEIFGPVLSILPFETEEEAVRIANDTPYGLTNYVQSEDGARRNRLARRLRSGMVEMNGKSRGAGAPFGGVKASGRAREGGVWGIEEFLEVKAISGWDPEAEALAAE

SEQ ID NO: 1992 - protein, 295 aa, Haemophilus influenzae Rd
MKAVIPVAGLGTRMLPATKAIPKEMLTLVDKPLIQYVVNECVAAGIKEIVLVTHSSKNAIENHFDTSFELETMLEKRVKRQLLEEVRSICPKNVTIMHVRQGNAKGLGHAVLCGRPLVGNESFAVMLPDVLLAEFSADQKKENLAAMIQRFNETGASQIMVTPVPQENVSSYGVADCGGIELNGGESAKINSIVEKPSIEDAPSNLAVVGRYVFSAAIWDLLEKTPIGVGDEIQLTDAIDMLIEKETVEAFHMTGETFDCGDKIGYMEAFVEYGIRHEKLGKEFKSFIKNLAKTL

SEQ ID NO: 1993 - protein, 325 aa, Chlorobium tepidum TLS
MKAIIPVAGVGSRLRPHTFSQPKVLLNVAGKPIIGHIMDKLIESGIDEAVIIVGYLGGKIEEYLTSHYAIKLTFVTQADQLGLAHAVHMCRPHVIDEEPLFIILGDTIFDVDLKLVLGSSISTLGVKEVDDPRRFGVVVTEGDRIVRLVEKPEQPVSNLAIVGLYFLHRAGTLFNSIDYIITNDIRTKGEFQLTDALQHMIDLGEPFSTFPVQGWYDCGKPETLLSTNEVLLQRDTRQKSLPGCIINPPVFIADSATVTNSIIGPNATIAEHAVVRDSIIMNSIIGRKSQVSEIMLDRSIVGNNAIVSAMGHELNIGDYSEIRMG

SEQ ID NO: 1994 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQLGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNAL

SEQ ID NO: 1995 - protein, 296 aa, Agrobacterium tumefaciens str. C58
MRSETARRDGDIRLSFEFFPPKNAEMDAQLWETVAELKKWDPDFVSVTYGAGGSTKAPTLDAVRRMIGDSHLPTAAHLTCVDASRDDVHQVIEEFRNAGVRHFVALRGDPSTGIGTAYQPHPEGYENAAALVKGLREIGDFEISVSAYPEKHPESASETVDIDMLKRKADNGATRALTQFFFDNDVFERYMERVTAAGITIPVVPGIMPIQNLTQLKRFAGRCGTSVPRFLDERFEGYDEDLEGRARVAAEVAAEQIADLQRRGFNEFHLYTMNRAPLVDAVLENLGLQRLRRSAA

SEQ ID NO: 1996 - protein, 376 aa, Zea mays
  unsure (1)..(376): unsure at all Xaa locations
MASEVEDDAAVPGAPLVANGAADVRRRRDQAKAILSKQAVKIATKAEQHERFIFKVTHLLGVLGFGGFCYLLGARPQDVPYVYCLFYVIFVPLRWIYYRYKKWHYYLLDFCYYANTFLLVMILFYPKDEKLFMVCFSFAEGPLAWALIVWRCSLVFGSFDKLVSVLIHLLPGIVLFTIRWWXPQTFAAMHPEGRDARVTWPYVEDKSYMWTWLFXVPLAAYTLWQLMYFLIVNVLRRQRLLRDPEVMTSYRELSKKAQKANNIWWRLSGLLGDRNRQVMYILLQALFTVATMALTVPIFLSYRMHVVFLILKVCASTWNGGSFILVVMPRQVVQKQLKKLDMKPMEQGSSTQGAPGGDGGTLGNHHQHTSEEHIQE

SEQ ID NO: 1997 - protein, 474 aa, Escherichia coli K12
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 1998 - protein, 355 aa, Neurospora crassa
MCFGGRGKDDEAEASRSRELDKQIRADEKRLSKEVKLLLLGAGESGKSTILKQMKLIYAQGFSKNEKLEWRPVIFANILQSFRLIFDAMNEFNIKLEDEDNEKNMVQMMVDYEMRGDEPLPLEYFEPAKKLWQDSGVRQAIEKGNEFALHDNLQYFCSDLDRLWDRNYVPSDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKIDLFKEKLPRSPITNHGFTDYHGPPDDSKQASKYFMDKFRALNRNPDKEIYGHFTNATDTNLLKITMGSVQDMIIQRNLKQLIL

SEQ ID NO: 1999 - protein, 335 aa, Pseudomonas fluorescens PfO-1
MNSSTYPAAQHVMVLYTGGTIGMQASANGLAPASGFEARMRDYLHSQPELVVPQWRFREMSPLIDSANMTPAYWQQLREAVVDAVDVQGCDSVLILHGTDTLAYSAAAMSFQLLGLHARVCFTGSMLPAGVTDSDAWENLSGALVALGHGLAPGVHLYFHGELLAPTRCAKVRSFGRHPFKRLERQGGGVKATSLPAALNYNQPKQLAKVAVLPLFPGIGAEIIDGLLDSGIQGLVLECYGSGTGPSDNPQFLASLGRARDSGVVVVAVTQCHEGGVELDVYEAGSRLRGVGVLSGGGMTREAAFGKLHGLLGAGLEVTNIRQLVELDLCGELSL

SEQ ID NO: 2000 - protein, 465 aa, Hemineura frondosa
AKMGYWDPEYVIKETDILALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAASGEVKGHYMNVTAATMENMYERAEFAKALGTVIIMIDLVIGYSAIQSMAIWARRNDMILHLHRAGNSTYSRQKIHGMNFRVICKWMRMAGVDHIHAGTVVGKLEGDPLMIRGFYNTLLLPHLDINLPQGIFFTQDWAALRKVTPVASGGIHCGQMHQLLDYLGDDVVLQFGGGTIGHPDGIQAGATANRVALESMVIARNEGRDYVTEGPQILRDAAKTCGPLQTALDLWKDITFNYTSTDTADFVETPTASV

SEQ ID NO: 2001 - protein, 786 aa, Zea mays
  unsure (1)..(786): unsure at all Xaa locations
MQSDQPVISLRPGGGGGPRAGRLFSPAFATSVSGDFLRLHVGGASGISKIGDSHFEPRERVRYTRDQLLELRELVDVSEDILRLKQEIDIELHGEDQTWIHNDSAVQGQVQAQTQAQNRYAETDSRDWRARSAQPPSTNEEKSWDNISEAKEAYTSSGRQQEQANRQDQLSSQFASKAQFGSTPALIKAEVPWSARXGNLSEKERVLITDKYNCFKLTPEKFDLLKGQLMEAGITTADILKDVISLIFEKAVFEPTFCPMYAQLCSDLNEKLPTFPSEEPGGKEITFKRVILNNCQEAFEGASNLRAEISKLTGPDQGMERRDKERLVKLRTLGNIRLIGELLKQKMVPEKIVHHIVMELLGSGTDKKTCPEEEDVEAICHFFNTIGKQLDENPKSRRINDTYFIQMKELTMNPQLAPRLRFMVRDVIDLRSNNWVPRREEIKAKKISEIHSEAEKNLGLRPGAASGIRNGRSSPGGALLPGGAFPMNRPGTGGMMPGMPGSRKMPGMPGLDNDNWEVARSKSMPRGDSIRNQGPLLNKPSTVHKTSSINTRLLPQGSGAGLIGKSALLGTGVPPSRPLSFTPGPTPAQTTPKPIRAAPAVVPAPDKQASAPKGNTAELQKKTIALLEEYFGIRILDEAHQCIVELQSPDYYPEIVKEAVNLALDKGTNFVDPLVRLLEHLYTKKIFKTQDLESGCLLYGTLLDDIGIDLPKAPAQFGEIIARLTLLGALRFEALEVILKKMEDTYNRKAVSNAFMKTLEANPSGQAILGSPAAAAVIDACNSLLE

SEQ ID NO: 2002 - protein, 355 aa, Trichoderma atroviride
MSRSTAPNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPEDEPTAPPIPEEFFDFDKHKDTLSKEQLKQLIYQEIMR

SEQ ID NO: 2003 - protein, 398 aa, Halobacterium sp. NRC-1 [sequence omitted]

SEQ ID NO: 2004 - protein, 510 aa, Suaeda maritima subsp. salsa
MFIENFKVESPNVNYTENEIHSVYNYETTELVHENRKGSGYQWIVKPKTVKYQFKTQTHVPKLGVMLVGWGGNNGCTLTGGVIANREGISWATKDKIQQANYFGSLTQASSIRVGSFNGEEIYAPFKSLLPMVNPDDIVFGGWDISDLNLADAMTRAKVLDIDLQKQLRPYMEHMVPLPGIYDPDFIAANQDSRANNIIKGTKKEQVEQVIKDIREFKEKNKVDKVVVLWTANTERYSDVVVGLNDTTENLMAAVERNESEISPSTLYAIACIQEDVPFINGSPQNTFVPGLIELAIKKNCLIGGDDFKSGQTKMKSVLVDFLVGAGIKPTSIVSYNHLGNNDGMNLSAPQTFRSKEISKSNVVDDMVASNGILYEPGEHPDHVVVIKYVPYVGDSKRAMDEYTSEIFMGGKNTIVLHNTCEDSLLAAPIILDLVLLAELSTRIEFKAETEDKFHTFHPVATILSYLTKAPLVPPGTPVVNALSKQRAMLEKMRACVGLAPENNMILEYK

SEQ ID NO: 2005 - protein, 386 aa, Secale cereale
FFTDAYDLFCISLVTKLLGRIYYTDLSKPDPGTLPPGVAAAVNGVAFCGTLTGQLFFGWLGDKMGRKSVYGMTWCSWSLLHRLRPLLRAHPQERHGHPLFFRFWLGFGIGGDYPLSATIMSEYANKKTRGAFIAAVFAMQGFGILAGGIVTLIISSAFRAGFHEPSYQDDRVASTGTEADFVWRIILMIGALPALLTYYWRMKMPETARYTALVAKNAKLAAADMSKVLQVELEDETEKMDEMVSRGANDFGLFSPQFARRHGLHQVGTATTWFLLDIAFYSHNLFQKDIFTSINWIPKARTMSALDEVFRISRAQTLIALCGTVPGIWFTVFLIDVVGRFAIQLMGFFMMTVFMLGLAVPYHHWTQPGNQIGFVMYAFTFFFANF

SEQ ID NO: 2006 - protein, 581 aa, Tropheryma whipplei str. Twist
MVRISGAQAVIKSLEELGIDLVFGIPGGAILEVYNSLFSSSIRHILVRHEQGAGHAAEGYACSSGKLGVCLATSGPGATNLVTAIADAYMDSVPILAITGQVYSHLLGSDAFQESDIIGITMPITKHAFSVKRATEIPAAIFAGAKIATTGRPGPVLIDITKDAQQDEFDFMWPPKSIDLSGYSVAQNIPDTLAQFADGFFDMLSGSIRPVIYAGGGTVRSGASEELIRFAEGFGIPVVTTLTARGVLPDSNRLNLGMPGMHGTVAAILALQKSDLLIALGTRFDDRVTGRLDSFAQNARVVHVDIDPAEIGKNRRPDLFVIGDVKEVLGYINSHSENKTTGDLTAWWRSLEKMRQIYPLVFPQKSSDGNLSPGYVIKRLGELSGPDAIYATGVGQHQMWASQAISFSRPNSFLTSGGAGTMGYAVPAAMGAKAANPEKIVWAIDGDGCFQMTNQELATCSVNGLPIKVAVINNRSLGMVRQWQGLFYNKRYSQTDLNTGDAYIPDFCKLAESYSCASCRVSSVDEVDNAIEFALAINDRPVVIDFVVCKDSMVWPMVPQGLGNSHLKYLQDVSPVWHDNE

SEQ ID NO: 2007 - protein, 194 aa, Mitthyridium sp. Streimann 40876
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDTFV

SEQ ID NO: 2008 - protein, 523 aa, Polytomella sp. Pringsheim 198.80
MIRKALMNARAKLPFARFARSASTSAPVVDIASETIQFARNLPNKLFINNKWVDAKSGKTMGVEDPRNGEEILRVAEGDSADVDLAVKAARKAFDEGAWPRMTGKERGRLIYKLADALEANAEAFARLETLDNGKPLNISRIADVPLSVDHFRYYAGWADKIHGKTIPVDGPHMAYTLHEPLGVVGAIIPWNFPLLMAAWKLGPALAAGNTIVLKPAEQTPLSALLIAKLAAEVGFPEGVINVVTGFGPTVGGPLASHKLVDKTAFTGSTEVGKIVARLAAEQIKPCTLELGGKSPIIVCPDVDVDRAVADAHMALFFNHGQCCAAGSRVYVHEKIYDEFVEKATKAAANHSVGDPFSGQYDQGPQVDNAQFSKILSYVEHGKAEGAKLNVGGCRVGNKGYYVAPTVFSNVTDNMKIAREEIFGPVQSILKYSTFDEVIRRANASDYGLASGVFSKDLDTVNTLVRGLHAGTVWVNCYNLFDSAVPFGGFKTSGIGREKGEYALSNYTKVKAVYMPLVNPAWR

SEQ ID NO: 2009 - protein, 294 aa, Vigna aconitifolia
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEETWPGVTALPDFKSTFPKWPPKDLATVVPNLDAAGLNLLSSMLCLDPSKRITARIAVEHEYFKDIKFVP

SEQ ID NO: 2010 - protein, 439 aa, Aster tripolium
MKILLGVGINGGLFGSCVSSRSKVDSSTSGISSHFEIKSTNNVSKDQPTTSNSEHNLPTLTPEDELKVASRLRKFGFNDLKMATRNFRPESLLGEGGFGCVFKGWIEENGTAPVKPGTGLTVAVKTLNHDGLQGHKEWLAEVNFLGDLGNPNLVKLIGYCIEDDQRLLVYEFLPRGSLENHLFRRSLPLPWSIRMKIALGAAKGLAFLHEEAKRPVIYRDFKTSNILLDAEYNAKLSDFGLAKDGPEGDKTHISTRVMGTYGYAAPEYVMTGHLSSKSDVYSFGVVLLEMLTGRRSMDKKRPNGEHNLVEWARPHLGERRRFYRLIDPRLEGHFSIKGAQKAAQLASRCLSRDPKARPLMSEVVDCLKPLPALKDMAGPSYYLQTVQPERAGSSPDPNRTRVGSFSRNGSQHPRTLSIPNASPRHNQFLQDSPNPNGKQ

SEQ ID NO: 2011 - protein, 330 aa, Methanosarcina mazei Goe1
MRLAVIEGDGIGREVIPAAVEVLDAFGLEFEKVPLEIGYARWERTGTAMSEEDMEIIKSCNAVLFGAVTTVPDPGYKSVLLTIRKELDLYANVRPVKPLSGVVGVSGRSDFDFIIVRENTEGLYSGIEEIGHDLSWTKRVITRKGSERISEYACELAKKRSGKLTIVHKSNVLKSDKLFLDVCRETASSYGVEYGDMLVDSMAYSLIMHPEKYDVVVTTNLFGDILSDMCAALVGSLGLVPSANIGKKYAFFEPVHGSAPDIAGKGISNPLAAILCVKMLLEWMGKPEARLIDAAIADLLQKKIITPDLGGRASTAEVGNAVAKYIMQNL

SEQ ID NO: 2012 - protein, 316 aa, Escherichia coli O157:H7 EDL933
MNELDGIKQFTTVVADSGDIESIRHYHPQDATTNPSLLLKAAGLSQYEHLIDDAIAWGKKNGKTQEQQVVAACDKLAVNFGAEILKIVPGRVSTEVDARLSFDKEKSIEKARHLVDLYQQQGVEKSRILIKLASTWEGIRAAEELEKEGINCNLTLLFSFAQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 2013 - protein, 478 aa, Nitophyllum sp.
IKNERYESGVIPYAKMGYWDPNYVIKETDILALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMENMYERAEFAKQLGTVIIMIDLVIGYTAIQTMGIWARKNDMILHLHRAGNSTYSRQKIHGMNFRVICKWMRMAGVDHIHAGTVVGKLEGDPKMIKGFYDTLLEPYLDINLPEGIFFQQDWASLRKVTPVASGGIHCGQMHQLLDYLGNDVVLQFGGGTIGHPDGIQAGATANRVALEAMVIARNEGRNYVAEGPQILRDAAKTCGPLQTALDLWKDITFNYTSTDTADFVETPTANV

SEQ ID NO: 2014 - protein, 309 aa, Ralstonia metallidurans
MLHITDTLIDRHVTAADAQAAMLDAFRSFGRGQAAMQERIRTEAGGVKLSTLGAVIPDQQVAGAKVYTTIAGQFSFVILLFSTVDGRPLASFDAGAITRLRTAACTVLAAKRLARSDAQTLALFGAGTQGVQHALQLSAALPFQRILICDPYADAEAATRLSAQCGVSVSFAQAEEAVAAADIIVTASRSTTPLFPGAIVKPGTFIAAIGSSLPHTRELDDVALSRAAAVVVEWRPQSLREAGDLVLADKAVLPDEKIVELADVLLDTAPTRKHADDILIYKSVGVGLEDVALAGIAYQRITAAQAAAA

SEQ ID NO: 2015 - protein, 469 aa, Loranthophycus californica
LKNERYESGVIPYAKMGYWDPDYVIKDTDVLSLFRITPQPGVDPVEASAAVAGESSTATWTVVWTDLLTACDLYRAKAYKVDSVPKTSDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTAATMEEMYERAEFAKQLGTVIIMIDLVIGYTAIQTMAIWSRKNDLILHLHRAGNSTYSRQKIHGMNFRVICKWMRMAGVDHIHAGTVVGKLEGDPLMIRGFYDTLLLPYLDVNLPRGIFFLQDWASLRKVTPVASGGIHCGQMHQLLDYLGEDVVLQFGGGTIGHPDGIQAGATANRVALESMVIARNEGIDYVAEGPQILRDAAKTCGPLQTALDLWKDITFNYTSTDTAD

SEQ ID NO: 2016 - protein, 389 aa, Triticum aestivum
TPARTGPPSAVRRHASDKMGLEAAVEATVEFLNKAVKPVLVAGPKLRVAKAGKAFVDLVDASGYAYAIMPSAKGFVPETHPHFLGTYWGAVSTAFCAEIVESADAYLFAGPIFNDYSSVGYSFLLKKDKAIIVQPERVIVGNGPAFGCVMMKEYLSALAKRVQKNTTAYENYKRIFVPEGHPLKGEANEPLRVNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWNYTALVEAIHNGEGKCWTAKVKCEEELTAAIGSALGEKKDSLCFIEVIAHKDDTSKELLEWGSRVSAANSRPPNPQ

SEQ ID NO: 2017 - protein, 377 aa, Wolbachia endosymbiont of Brugia malayi
MSDLAKRMSLIKPSPTIAVTDKANRLKDEGKKICILAAGEPDFDTPDHIKKVAIQAIDEGKTKYTAVDGTRELKEAIISKLKRDNNLEYALSQVCVGAGAKQVLFNLFMATVNPGDEAIIPAPYWVSYVDMVSLFGGLPVVIECGQGLKLTPELLKNKVTKKTKWLILNSPNNPAGVVYTYDELKAIAQVLLEYPHVNIITDDIYEHIYDEKFFTIAQVEPKLYNRVFVVNGVSKAYAMTGWRIGYIAGRSDVVKAISTLQSQSTSNPNSIAQAAAVEALNGDHSFLKERMGIFKSRRDFVIEKLNSAPGLLASIPQGAFYLFVSCKDLLGKSTKSGKVINNDLDFAEYLLEDHLVAVIPGIAFGLKNFIRISYATS

SEQ ID NO: 2018 - protein, 488 aa, Gelidium floridanum
MSNSVEERTRIKNQRYESGVIPYAKMGYWDPNYAIKETDVLALFRITPQPGVDPVEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIIMIDLVIGYTAIQTMAIWARKNDMILHLHRAGNSTYARQKNHGMNFRVICKWMRMAGVDHIHAGTVVGKLEGDPLMIQGFYNTLLMSHLDQDLVKGIFFEQDWASLRKVTPVASGDIHCGQMHQLLDYLGVDVVLQFGGGTIGHPDGIQAGATANRVALEAMVIARNEGRDYVEEGPQILRDAAKTCGPLQTALDLWKDISFNYTSTDTADFVETPTANV

SEQ ID NO: 2019 - protein, 469 aa, Sinorhizobium meliloti
MTTANEVLKQIKENDVKFVDLRFTDPKGKLQHVTMDVVCVDEDMFADGVMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKPNGVEVRFPDPTANPYLAFAAMLMAGLDGIKNKLHPGKAMDKDLYDLPPKELKKIPTVCGSLREALESLDKDRKFLTAGGVFDDDQIDSFIELKMQEVMRFEMTPHPVEFDMYYSV

SEQ ID NO: 2020 - protein, 224 aa, Pseudomonas aeruginosa PAO1
MQPFAIAPSILSADFARLGEDVDKVLAAGADIVHFDVMDNHYVPNLTIGPMVCSALRKYGVSAPIDVHLMVSPVDRIIGDFIEAGATYITFHPEASQHIDRSLQLIRDGGCKAGLVFNPATPLEVLKYVMDKVDMVLLMSVNPGFGGQKFIPGTLDKLREARALIDASGREIRLEIDGGVNVKNIREIAAAGADTFVAGSAIFNAPDYAEVIRAMHAELAQAHQ

SEQ ID NO: 2021 - protein, 376 aa, Arabidopsis thaliana
MATPVDPPNGIRNQGKHYFSMWQTLFEIDTKYVPIKPIGRGAYGVVCSSVNRESNERVAIKKIHNVFENRIDALRTLRELKLLRHLRHENVVALKDVMMANHKRSFKDVYLVYELMDTDLHQIIKSSQVLSNDHCQYFLFQLLRGLKYIHSANILHRDLKPGNLLVNANCDLKICDFGLARTSNTKGQFMTEYVVTRWYRAPELLLCCDNYGTSIDVWSVGCIFAELLGRKPVFPGTECLNQIKLIINILGSQREEDLEFIDNPKAKRYIESLPYSPGISFSRLYPGANVLAIDLLQKMLVLDPSKRISVTEALQHPYMAPLYDPSANPPAQVPIDLDVDEDEDLGAEMIRELMWKEMIHYHPEAATINNNEVSEF

SEQ ID NO: 2022 - protein, 355 aa, Oryza sativa (japonica cultivar-group)
MDQSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLADGKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 2023 - protein, 362 aa, Triticum aestivum
MASERRLYALKAFDDTKAGVKGLVDAGVTAVPTIFHHPPESLDDAPTHPHGHQFSIPVIDLAGLVTPSGRASVVGAVKAAAETVGFFQVVNHGVPEAAMSGMLAALRSFNEEPAEAKRPYYSRDPGRRAKYESNFDLFQSRAASWRDTLFMEIPRVRPPPEEIPPACRRVAPEYVGLVQRLGRTLFELLSEGMGLRRGYLEEEQECLDGLSFAGHYYPACPEPHLTLGAARHSDPSFLTVLLQDAVGGLQVLVDDDKNQPAWVDVPTAAGALVVNIGDYLQLMSNDRFKSVEHRVVAKSVGPRVSVACFFRPSASAASTRVLEPIVTDAGGARYRSTTVAELVRHYRAKGLDGVLALQHVRI

SEQ ID NO: 2024 - protein, 356 aa, Streptomyces antibioticus
MKALVLAGGSGTRLRPITHTSAKQLVAVANKPVLFYGLEAIAAAGITDVGLIVGDTAGEVRAAVGDGAKFGLDITYIEQSRPLGLAHAVLIAHTYLGDDDFVMYLGDNFIVGGIDDLVRTFRDGRPPAARILLTHVSDPSAFGVAELDDDGRVVGLEEKPRHPKSDLALVGVYFFTPAIHEAVRAIEPSWRGELEITHAIQHLIDNGADIQSMVIEGYWKDTGNVADMLEVNRTVLEDLEPRIEGTVDEHTVVIGRVVVGEGARVTNSRIMGPAIIGAGAEISDSYIGPFTSVGDNCRITGSEMEFSIMLAESAITGVRRIEGSLIGRNVQVTQSLHAPNAHRFVLGDHSKVEIQS

SEQ ID NO: 2025 - protein, 525 aa, Rhodospirillum rubrum
MWWPLTLRAAFPRCSRPWARSIRNSSMTQAAPPIDWTARARALRLPNHALIDGAPASAGDGATFDCVSPIDGRVLTRVAACGAADVDRAVAAGRAAFEDRRWCGLSPAARKKILLAFAERIEAHRDELALLETLDMGKPIADSLAVDVPATARCLRWYAEALDKVYGEVAPTGDDVLATITREPLGVVGVVVPWNFPMIMAAWKIAPALAAGNSVVLKPAEQSPLTAIRLGELALEAGLPAGVLNVVPGLGPVTGRAIGLHPDIDGAFFTGSTAVGKLFLSYSSQSNMKRLGLECGGKSAHIVLASCKNTTAAAQAAASAIFFNQGEMCTAGSRLIVERAIADEVIEKVVAEAAFWRPGPPLDPATRMGALVDAEQTERVLGYIALGQDEGARLATGGSRAMAESGGCYVEPTIFTGVAPTMRIAREEIFGPVLSVITVESADEAVRVANDSDYGLAAAVWSDDVTTLHRVAKRLRAGMVYANCYDADDITVPFGGFKQSGIGRDKSLHAIDKYTELKTTWLRLG

SEQ ID NO: 2026 - protein, 423 aa, Batrachospermum helminthosum
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTNGHPDGIQAGATANRVALESMVLARNEGCDFVNEGPQILRDAAKTCGPLQTALDLWKDISFNYTSTDT

SEQ ID NO: 2027 - protein, 364 aa, Triticum aestivum
  unsure (1)..(364): unsure at all Xaa locations
KSHRGRTGRPRLPLFLCSPVRPLPPLVGVVAAARIIVRASLPRPPTAPPQERATQRFDSGRREWRRRRPSPPPTSPASPLPHRPRSTTTRTTSSASAAPAAXAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 2028 - protein, 253 aa, Glycine max
MGRKFFVGGNWKCNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 2029 - protein, 650 aa, Desulfovibrio vulgaris subsp. vulgaris (strain Hildenborough)
MSEPRRNIYLRTLPIEDAVTRARTALDRDALMHTETVPAHEAAGRVLAAPVYARFSSPTFHSAAMDGIAVSAAKTYTAREGSPLTLALDADYRPVNTGHPMPEGCDAVIMIEQVVPVDDTHVQIESPAFPWQHVRRLGEDIVATELLFPRNHPLNAYDVGTLLSGGIWEVEVWEKVRVRIIPTGDEVLDFTLRPEPGAGQVVESNSQVLATMARGLGCSVERIAPVRDDPEALHAALRDSLDAGTHLTIFCAGSSAGSKDFTRATIEREGEVLVHGIAAMPGKPSLLGVCRGRLVAGAPGYPVSSVVCFEELLTPLLTWLSRRQSQARPVVEVELTRKVPSRLGIDEFLRLSVGRVGDKLVGTPLARGAGNITTLSRAQAVARIPAAAEGAEGHERLTAELTVPPALLDRIVVCVGSHDNTLDLLADELMGRDDPFRLASTHVGSMGGINALRNGSCHFAGAHLFDPETGDYNFPFIARFLEGVPVTVVNLAIRHQGLIVAPGNPMGIQGVQDLARKGVRFINRQRGAGTRILLDWHVREAGISPAEVAGYDKEEYTHMAVAANVLTGAADCGLGIHAAAKALGLDFVPLARERYDLLIPNAFLEEPRVRAVLDLLHTPAFAERIGNLGGYETTLMGRVMHPGDGLGDMG

SEQ ID NO: 2030 - protein, 330 aa, Pseudomonas sp.
KLANVVILATGGTIAGAGASAANSATYQAAKVGVDKLIAGVPELADLANVRGEQVMQIASESITNDDLLKLGKRVAELADSNDVDGIVITHGTDTLEETAYFLNLVQKTDKPIVVVGSMRPGTAMSADGMLNLYNAVAVASNKDSRGKGVLVTMNDEIQSGRDVSKSINIKTEAFKSAWGPLGMVVEGKSYWFRLPAKRHTVNSEFDIKQISSLPQVDIAYSYGNVTDTAYKALAQNGAKALIHAGTGNGSVSSRVVPALQQLRKNGTQIIRSSHVNQGGFVLRNAEQPDDKNDWVVAHDLNPEKARILAMVAMTKTQDSKELQRIFWEY

SEQ ID NO: 2031 - protein, 278 aa, Pseudomonas aeruginosa PAO1
MPRKVFSSQAYRHKVVLVSGGCSGIGRALALRFARAGARLAILDLDQAALDSLVQHLRDHLGGEALGLRCDVADADAVERAVALAVERFGGIDVLVNNAGITHRGTFAETGLGVFRKVMAVNFFGAVHCTRAALPSLLERRGQIVVLGSLTGFAPLLYRSAYNASKHALHGLFDTLRMELEGTGVSVTLACPGFTATDLRKNALVGDGSVTRQPVQVLGSQVASPVEVAEAIFQGAARRRRLLVLSNVNWRARLLARFFPRLFEKLLVPRLSGLKPQP

SEQ ID NO: 2032 - protein, 496 aa, Glycine max
MGKVAVGTAVVCAAAACVAAALVVRHRTRSSGKWGRATAIAKELEEQCWTFFSKLRQVADALDVEMHAGLASEGGCKLKMLITYVDNLPSGDEKGLFYALDLGGTNFRTLRVHLGGKEKGVVKIESEEVSIPPHLMTGSSQELFDFIASKLAKFVSSEPEELHPPPGRQRELGFTFSFPVKQTSIASGTLIKWTKGFNIEDAVGEDVVGGLTKSLEKIGLDMRVAARPNDTVGTVARARFSNQDVIAGVILGTGTNAAYVECAHAIPKWHGLLPKSGEMVINMEWGNFRSSHLPLTEYDHALDAESLNPGEQIFEKIISGMYLGEIVRRVLLKLAEEVDFFGDTVPPKLRIPFVLRTPDMSAIHQDTSSDLKVVGNKLKDILEINNTSLKMRKIVVELCDIVANRGARLSAAGIFGILKKIGRDTVKDGKKSVVALDGGLFEHYTKFRSSLESTLKELLGDEAAETIGIEQSNDGSGIGAALLAASHSQYLEVQES

SEQ ID NO: 2033 - protein, 441 aa, Leuconostoc mesenteroides subsp. mesenteroides ATCC 8293 [sequence omitted]

SEQ ID NO: 2034 - protein, 430 aa, Magnetospirillum magnetotacticum
MDLHHPELTYAAIVALAAVLCGGLMTRLKQPAIVGYILAGVVLGPSGFGLVSNRDAVATLAEFGVLMLLFVIGMKLDIIRFLEVWKTAVFTTVLQIAGSIGTALLLRHGLGWSLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSPAYGAFLGGVVLGNSAQRDMLLKRAQPIGSVLLMVFFLSIGLLLDFKFIWKNLGTVLTLLAMVTLFKTALNVAALRLARQDWPSAFLAGVALAQIGEFSFLLADTGKAVKLISAQETKLVVAVTVLSLVLSPFWLFTMRRMHRVAAVHVHSFRELVSRLYGDEARTARRARTLVRRGSWRDDHNAGPGTGI

SEQ ID NO: 2035 - protein, 803 aa, Paenibacillus sp. KCTC8848P
MTLYRSLWKKGCMLLLSLVLSLTAFIGSPSNTASAAVAEDFQASVMGPLAKITDWGSFKKQLQTLKNNGVYAITTDVWWGYVESAGDNQFDWSYYKTYANAVKEAGLKWVPIISTHKCGGNVGDDCNIPLPSWLSSKGSADEMQFKDEKGYSNSEALSPLWSGTGKQYDELYASFAENFAGYKSIIPKIYLSGGPSGELRYPSYYPAAGWSYPGRGKFQAYTETAKNAFRTAMNDKYGSLDKINAAWGTKLTSLSQINPPTDGDGFYTNGGYNSVYGKDFLSWYQSVLEKHLGVIGAAAHKNFDSVFGVRIGAKVSGLHWQMNNPAMPHSTEQAGGYYDYNRLIQKFKDADLDLTFTCLEMSDSGTAPNYSLPSTLVDTVSSIANAKGVRLNGENALPTGGSGFQKIEEKITKFGYHGFTLLRINNLVNNDGSPTGELSGFKQYIISKAKPDNNGGTGNKVTIYYKKGFNSPYIHYRPAGGNWTAAPGVKMQDAEISGYAKITVDIGSASQLEAAFNDGNNNWDSNNTKNYSFSTGTSTYTPGNSGNAGTITSGAPSGANPGDGGGTTNKVTVYYKKGFNSPYIHYRPTGGNWTAVPGVKMQDAEISGYAKITVDIGTASQLEAAFNDGNNNWDSNNTKNYSFSTGTSTYTPGLNGAAGSIRTGAPSGSTISVVASTYATNLNEVAGPIQTEKLSGVSLNVSASTYTPNVNGVEVTAQTEALSSAFTSIDPGTLSKPTPLGTDWSKQSIYFIMTDRFSNGDTSNDNYGGFNSNNNDQRKWHGGDFQGIINKLDYIKNMGFTAI

SEQ ID NO: 2036 - protein, 439 aa, Schizosaccharomyces pombe [sequence omitted]

SEQ ID NO: 2037 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSQGGFIFREHGSTPGYYDGRYWTMWKLPMFGCTDASQVIKEVEEVKKEYPDAYVRIIGFDNIRQVQCVSFIAFKPPGCEESG

SEQ ID NO: 2038 - protein, 492 aa, Arabidopsis thaliana
MDPYKYRPASSYNSPFFTTNSGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRILDFFSHHPESLNMFTFLFDDIGIPQDYRHMDGSGVNTYMLINKAGKAHYVKFHWKPTCGVKSLLEEDAIRVGGTNHSHATQDLYDSIAAGNYPEWKLFIQIIDPADEDKFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDQVRHAEKYPTPPAVCSGKRERCVIEKENNFKEPGERYRTFTPERQERFIQRWIDALSDPRITHEIRSIWISYWSQADKSLGQKLASRLNVRPSI

SEQ ID NO: 2039 - protein, 480 aa, Mazzaella membranacea
QGIKNERYESGVIPNAKMGYWDPDYVVKDTDVLALFRVSPQPGVDPVEASAAVAGESSTATWTVVWTDLLTACDLYRAKAYKVDTVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKELGSIIVMIDLVIGYTAIQSMAVWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGVDVVLQFGGGTIGHPDGIQAGATANRVALESMVIARNEGRDYVAEGPQILQDAAKTCGPLQTALDLWKDISFNYTYTDTADFVETPTANV

SEQ ID NO: 2040 - protein, 246 aa, Triticum aestivum
MKGGDIEAGTSGGTAAAPAGALYPGMAESPELRWALIRKIYVIVSLQLLLTAVVAAVVVKVPAIPHFFASSYAGLGLYIFLLILPFIVLCPLYIYRQKHPVNLLLLGVFTVAISFAVGMTCAFTSGKVILEAAILTTVVVFSLTAYTFWAVKRGKDFSFLGPFLFASLIMLLVFGFIQILFPLGKLSHMIYGALAALIFSGYIVYDTDNIIKRYTYDEYVWAAVSLYLDIINLFMALLTLFSAGDS

SEQ ID NO: 2041 - protein, 433 aa, Bacillus cereus ATCC 14579
MMTLVILLLFLLFCVLVFWISITFSIKYVLIFTAFLFSGLLVYYSFLTIAGLIHRNSKRKDRTLEHYPSVDIFIPAHNEGVVIKDTLEAMAKIEYPGKLTIYLLNDNSQDETPEIGDDFDKAYAHIRHIRVPPGEPKGKSRVLNYGLSISDGEYFCVYDADNQPEPHALRMLVEHAETTEDAVGAVGHVRTVNEKRNWLTRMISLEFQIFQLLMQSGRWLLFQTGSLTGTNMLLRRSALEELGGYDPYAIAEDAELTLRITQKGYLLPIVPESVTWEQEPEHLKILIKQRTRWLQGNLYILEKMFSSLSFFKGKLLVHSLQQVLVYVVFWLFLIISNVWFVIGLLGIFQIQYSIPLLFMWYVAYITYVSQLFSAQSVERTFTPTNIFISVIMYFTYAQLFTYLFIRSLILYLRAKSKKQVIGWDKTVRFKKDK

SEQ ID NO: 2042 - protein, 519 aa, Arabidopsis thaliana
MEDIQEEENGTDEEVLGSSLTMEKVAAAKQYIENHYKAQNKNIQERKERRWILERKLASSGVPKEEQINMIKDLERKETEFMRLKRNKISVDDFELLTIIGRGAFGEVRLCRERKSGNIYAMKKLKKSEMVMRGQVEHVRAERNLLAEVESHYIVKLYYSFQDPEYLYLIMEYLPGGDMMTLLMREDTLREDVARFYIAQSVLAIESIHRYNYIHRDIKPDNLLLDKDGHMKLSDFGLCKPLDCRNLPSIQENRATDDETMSEPMDVDRCFPDTDNKRSWRSPQEQLQHWQMNRRKLAFSTVGTPDYIAPEVLLKKGYGMECDWWSLGAIMYEMLVGYPPFYADDPISTCRKIVHWRNHLKFPEDAKFSSEAKDLICRLLCNVDHRLGTGGGAQQIKDHPWFKDVVWEKLYEMEAAYKPEVNDELDTQNFMKFDEVNSPAPERTRSGLSRKMLLAPKDLSFVGYTYKNFDAVKGLRHSLEMARTMSLDRSPAEAMPVELISGEAAEAQMVSSMDDPMII

SEQ ID NO: 2043 - protein, 630 aa, Magnetospirillum magnetotacticum
METPAAEKTDLKRLGTLALAAIGVVYGDIGTSPLYTLKECFDPDHGIPSTPENIFGIASLVFWAIILVVTFKYVLFVMRADNRGEGGILALLALTIRATGGDRGKVGTLVGLGLFGAALFIGDGMITPAISVLSAIEGLEVGTPFFTPYVVPLTLIVLIALFAIQSHGTELVGRLFGPVMVVWFVTIASLGLIEVVGHPAILTAINPAYGVTFLFTHGWIAFVVMGSVVLAVTGGEALYADMGHFGKFPIQLAWFTLVLPALTLSYFGQSALILDNPEAAKNPFYMLVPGWGLYPMVILSTMATVIASQAVISGVFSLSRQAVQLGYSPRLDIRHTSDEEEGQIYIPRANWGLLLGIVALVVGFKSSTNLAAAYGIAVTGTMGATTILALVVARHQWKWPLWLCLTLGAVFLTVDLGFLGANLLKVTQGGWFPLAVGFGMLLLMATWRKGRDILTRRLADGALPLDMFMAQQKDSTSILRVRGTAVFMTGGTDTVPIALLHNLKHNKVLHQRIVFLTVVTEDIPRVPARDRVVVEGLAEGFYRITVRYGFFQEPDIPKVLRLCKAFGLEFEMMDTSFFLGRETLVPSTHPEMPEWRERLFVIMSRNAVSATDFFHIPAGRVVELGIQVQL

SEQ ID NO: 2044 - protein, 391 aa, Lactobacillus plantarum WCFS1
MKFEESKILQQLPKQFFANLVKKVNAKAAAGADVINLGQGNPDQPTPEFVVKAMQTATANPADHKYSLFRGLPRFKQAAADFYEREYGVKLDPETEIAVLGGSKIGLVELPFALLNPGDTMILPDPGYPDYLSGITLAQVKLALLRLTAANHFLPDYQQVDPQVAAAAKLLYLNYPNNPTGAVATSQFFQDTVDFANEHQIGIVHDFAYGAIGFDGQRPVSFLQTPGAKDVGIEMYTLSKSFNMAGWRVGFAAGNADMIEALNLIQDHLFVSVFPAIQDAAIAALNSDQQTVHELVRLYERRRNQFFTTARKIGWEPYPSGGSFYAWMPVPEGYTSEAFADLLLDKAAVAVAPGNGFGAGGEGYVRVGLLIDEPRFTEACQRIAKLHLFDR

SEQ ID NO: 2045 - protein, 480 aa, Photobacterium profundum
MTESVVRENQLIKRTLDDLPQPKGWPLLGNFLQLQSKNLHQVLEQWCLEYGDTYKVDIAGLLFVVIADPVVVKDILRRRPKSFNRTASLERVFKELGIHGVLSANGESWKRQRRLIMPAFSKKSLASFFPLLEQTTERLRLRLVKKRGQDTLAIHDDLRRFTVDITTSLVFGHDTRLLEHDGDGLQKHLEVIFPQLNSRTRMPFPYWQYIKFKKDRKLDQALIEVEKYALKIVEQTRDELQFNPQLADAPETILQAMVAASDDDNRLTNEELFANILTLLLAGEDTTSNLIAWMLYFISQRPDIQCKINEEAEQIRLKHKGQINVQGLDELTYLEAVARETLRLKSTAPMISAETADQVTLLDGTELPAGTGLFLMTRLGGLNKEHFKDAEQFRPERWQEEAVAAEACPHKATSHFPFGGGARHCPGETLAFMETKMVIAMLCQQFDISQPESPPVVEEYAITMRPKNLQICLRLKPVGR

SEQ ID NO: 2046 - protein, 510 aa, Callistephus chinensis
MSILSLLVYFCISLLVIIALVNMFITRHTNRLPPGPAPWPVVGNLPHLGAIPHHTLAALATKYGPLVYLRLGFVHVVVASSPSVAAQFLKVHDLKFASRPPNSGAKHIAYNYQDMVFAPYGPQWTMFRKICKDHLFSSKALDDFRHVRQEEVAILARGLAGAGRSKVNLGQQLNMCTANTLARMMLDKRVFGNESGGDDPKANEFKEMATELMFLAGQFNIGDYIPVLDWLDLQGIVKKMKKLHTRFDKFLDVILDEHKVIASGHIDMLSTLISLKDDTSVDGRKPSDIEIKALLLELFVAGTDTSSNTVEWAIAELIRQPHLLKRAQEEMDSVVGQNRLVTEMDLSQLTFLQAIVKEAFRLHPSTPLSLPRIASESCEVDGYYIPKGSTLLVNIWAIGRHPEVWTDPLEFRPTRFLPGGEKPGIVVKVNDFEVLPFGAGRRICAGMSLALRTVQLLMGTLVQAFDWELANGIKPEKLNMDEAFGLSVQRAEPLVVHPRPRLPPHVYKSG

SEQ ID NO: 2047 - protein, 381 aa, Thermosynechococcus elongatus BP-1
MKAMILAAGKGTRVRPITYTIPKPMIPILQKPVMEFLVELLRQHGFNQIMVNVSHLAHEIESYFQDGQRFGVEIAYSFEGYIKDGELVGKALGSAGGIKRIQDFNPFFDDTFVVLCGDALIDLDLTAAVAWHRQKGAIATVVMKTVPREDVSSYGVVVTDKSDRIVAFQEKPSVEEALSNHINTGIYIFEPEVIDYIPSNQEYDIGSQLFPKLVEMGAPFYGLAMDFEWIDIGKVPDYWQAVRGVLNGTIKNVSIPGHEQFPGIYTGLNVAVNWDKVTIQGPVYIGGMTKIEDGATIIGPTMIGPNCHICSGAVVDNCVIFEYSRLGSDVRLVDKLVFGRYCVDKTGTTIDLKAAALDWLITDSRQTDIQLSPLELKEMMS

SEQ ID NO: 2048 - protein, 425 aa, Zea mays
RVGGRVGGRVGGRVGPDARRAPGQGGIKGVRPPPVLKPPPSMALPAVCGVGSTWDILRSLAPDEKDDAPASRSGRRFGHQDAVEKDDDERAAVLLMLDDLRLEESSESFTGTSSLSTTNDDDTSSTTTESMFYISPNGRFRRRIKSWSRGVLLGSGSFGTVYEGISDEGVFFAVKEVNLFDKGSNAKQCIFQLEQEIALLSQFEHENIVQYYGTDKEDSKLYIFLELVTQGSLASLYHKYRLRDTQVSAYTRPTRPRTRGLHERNIVHRDIKCANILVHANGSVKLADFGLAKEITKFNELKSCKGTVYWMAPEVVDPQQTYGPAADIWSLGCTVLEMLTRQIPYPDLEWAQALYRIGKGESPAIPNTLSRDARDFISRCVKPNPEDRPSASKLLEHPFVNKSIRSVRSMRTTPSRSNSSTRGIN

SEQ ID NO: 2049 - protein, 901 aa, Xanthomonas axonopodis pv. citri str. 306
MPSHPPTRFRSLAQGVLLALGCATGAAHAATPPYLDTQRSFEARAADLVSRMTLEEKAAQMQNAAPAIPRLQVPAYDWWNEALHGVARAGGATVFPQAIGMAATFDLPLMHEVATAISDEARAKHHQFLRQNQHARYQGLTFWSPNINIFRDPRWGRGQETYGEDPFLTARMGVTFVQGLQGEGAAAPKNAQGEPYRKLDATAKHLAVHSGPEADRHHFDARPSQRDLYETYLPAFEALVKEGKVDAVMGAYNRVYGESASASKFLLQDVLRDQWGFRGYVVSDCWAIVDIWKHHKIVATREQAAALAVKHGTELECGEEYATLPAAVRQGLIDEAQIDTALKTLMTARMRLGMFDPPGQLPWSTIPASVNQSPAHDALARRTARESLVLLKNDGLLPLSRAKFKRIAVIGPTADDTMALLGNYYGTPAAPVTVLQGIRAAAPNAQVLYARGADLVEGRDDPAATPLIEPQYLRPSANSPERGLRGEYFRNRDLSGKPALVRVDAQIGFKWDRGSPTDNLLARGEAGPSEAVPADNFSIRWSGQLVPPTTGTYHLEAAADDGVRLYLDGKPVIDRWSTSDRLHADGVDVQLQAGRAYEVRLEYFEGERDAAVRLAWRQPGARPPLQEALDVARSADVVVFVGGLTGDVEGEEMKVNYPGFAGGDRTDLRLPKPQRDLLEALQATGRPVVAVLTTGSALAIDWAQQHLPAILLAWYPGQRGGTAVADTLFGDANPGGRLPVTFYKESETLPAFDDYAMRGRTYRYFGGTPLYPFGHGLSYTQFAYSGLRLDRTTIATDGSLAATVTVKNTGQRAGDEVVQLYLHPLAPQRERAGKELHGFQRIALQPGEQRELGFTINAKDALRLYDEQRKAYGVDPGAYEVQIGASSADIRARQRFTVTDK

SEQ ID NO: 2050 - protein, 505 aa, GIBBERELLA ZEAE PH-1
MALPPKWYQFLVSVFASLGSLLYGYDLGVIAEVIASGNFKSKFGDDPNATGAVVSVFTGGAFFGAMFAGYAGDRLGRKWTIMIGALIFILGGSLQTAADHINYLYAGRCLAGLGVGFLVMIVPVYQGELCHPDIRGRVTALQQFMLGVGALIATAIGYGTYTSIDDSNSGQWRIPLGIQNLPAVILAALILFFPESPRWLIDHGREEEGLKTLAKLHANGDVNDTWVRAEFDQIQERLALEHEASAKSYSELFTDKSCFRRLWLAISVQVAAQMTGVSAIQYYSVAIYAKIGIQGDETLRYQMISSVIALVAQFLCMLFIDRTGRRWPLIGGNILNCITFIIATVLLASFPPGSNNGGGAAGWGFIVVTWIYNFSFSATCGPLSWIIPAEIFDMKTRAKGVSLATMMSFAFNTMIGQTTSVALDDKTGIGWRWYILFIVCNFTNAVYFWAILPETANRPLEEMRYLFTEAPLFVPLMDTAKFAAGQDLERRVEKAEQKQELEHHD

SEQ ID NO: 2051 - protein, 334 aa, Azotobacter vinelandii
MTIKVGINGFGRIGRLVLRAAWDWPELEFVQINDPAANAATHAHLLNFDSVHGRWRYEAGSDGNYLAIDGRRIPVSANKAIADTDWSDCDVVIEASGKMTRVALLQAYLEQGVGRVVVSAPVKEEGALNVVMGVNHQLFEPARHRIVTAASCTTNCLAPLVKVIHENLGIRHGSITTIHDLTNSQNILDAPHKDLRRARACGMSLIPTSTGSATAIAEIFPELRGRLNGMAVRVPLANASLTDCVFEVERATTVEEVNALLEAAAEGPLAGILGYEERPLVSIDYRSDPRSSIVDALSTMVVDGTQVKLYAWYDNEWAYANRTVELARLVSSVH

SEQ ID NO: 2052 - protein, 182 aa, Rhodospirillum rubrum
MAGIDESKPFLPVRIAILTVSDTRTLENDTSGATLVARLEGAGHVLADRAIVKDDVAAIRARLERWIADPEVDVVISTGGTGVTGRDVTPEAFQGLYEKEIPGFGELFRFLSYPKIGTSTIQSRATAGVVRGTYLFALPGSTGACKDGWDGILVWQLDSRYQPCNFVEMMPRLMEHMAPADH

SEQ ID NO: 2053 - protein, 377 aa, Saccharomyces kluyveri
MFRLARLQNTATSARSLASSFIRFNSTVAPAIPTTQKGVIFYESGGKLEYKDIPVPKPKPNEILINVKYSGVCHTDLHAWKGDWPLPTKLPLVGGHEGAGVVVAKGENVMNFEIGDLAGIKWLNGSCMACELCEQGHESNCLHADLSGYTHDGSFQQYATADAVQAAQIPKGTDLAEVAPILCAGVTVYKALKTADLRPGQWVAISGAAGGLGSLAVQYAKAMGLRILGIDGGPGKEELFKSLGGEVFIDFTKTKDIVSAIQEATKGGPHGVINVSVSEAAISTSTQYVRPTGTVVLVGLPANAYVKSEVFSHVVKSINIKGSYVGNRADTREALDFFTRGLVKSPIKIVGLSELPEVYGLMEKGKILGRYVVDTAK

SEQ ID NO: 2054 - protein, 186 aa, Nicotiana tabacum
IYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNRKIHHSVVGLRSCISEGAIIEDSLLMGADYYETDADRRFLAAKGSVPIGIGKNSHIKRAIIDKNARIGDNVKIINS

SEQ ID NO: 2055 - protein, 413 aa, Glycine max
LLLSLSVAIFTSACQYGLPFLAKCTPCDPSLSDVCPTNGRSGNFKQFNCPKGYYNDLATLLLTTNDDAVRNIFSTNTPLEYQPLSLVIFFALYCILGLITFGIAVPSGLFLPIILMGSGYGRLLGIYMGPHTNIDQGLFAVLGAASLMAGSMRMTVSLCVIFLELTNNLLLLPITMIVLLIAKTVGDSFNPSIYEIILHLKGLPFMDANPEPWMRNLTVGELVDVKPSVVTLHGVEKVAKIVDVLKNTTHNAFPVMDDGVVPPVVGQANGGTELHGLILRAHLIQALKKKWFLKERRRTEEWEVREKFTWVELAEREGSIEEVAVTSEEMEMFVDLHPLTNTTPFTVLESMSVAKAMTLFRQVGLRHLLVVPKYQASGISPVIGILTRQDLLAQNILTVFPHLAKSKGREKTN

SEQ ID NO: 2056 - protein, 283 aa, Glycine max
MGNANGREDGSIPPAAADPSAAARGTHAPPVSLPPVRAFSSDSMANSPPHSPRRSRSPILFGPQVPLAPLQRGNGPPFLNQMWQNESHGIVNHPSEQGIPVMITWNYGGNNVAVEGSWDNWTSRKALQRAGKDHSFLIVLPPGIYHYRFIADGEERFIPELPNVADEMGHVCNLLDVNDYVPENPDGVSEFEAPPSPESSYGQAFPAEEDFAKEPMAVPSQLHLTVLGMENSDIGSSSKPQHVVLNHVFIEKNLASKSVVALGLTHRFQSKYVTVVLYKPLKR

SEQ ID NO: 2057 - protein, 429 aa, Saccharomyces cerevisiae
MSENNEEQHQQQQQQQPVAVETPSAVEAPASADPSSEQSVAVEGNSEQAEDNQGENDPSVVPANAITGGRETSDRVLYVGNLDKAITEDILKQYFQVGGPIANIKIMIDKNNKNVNYAFVEYHQSHDANIALQTLNGKQIENNIVKINWAFQSQQSSSDDTFNLFVGDLNVNVDDETLRNAFKDFPSYLSGHVMWDMQTGSSRGYGFVSFTSQDDAQNAMDSMQGQDLNGRPLRINWAAKRDNNNNNNYQQRRNYGNNNRGGFRQYNSNNNNNMNMGMNMNMNMNMNNSRGMPPSSMGMPIGAMPLPSQGQPQQSQTIGLPPQVNPQAVDHIIRSAPPRVTTAYIGNIPHFATEADLIPLFQNFGFILDFKHYPEKGCCFIKYDTHEQAAVCIVALANFPFQGRNLRTGWGKERSNFMPQQQQQGGQHL

SEQ ID NO: 2058 - protein, 802 aa, Bacillus cereus ATCC 14579
MFTHVESFKSTFLEKLETMYGKSFKDSTTRDQYNTLGHMVREYMNSQWIATNESYRSGEQKQMYYLSIEFLLGRLLGSNILNLGIRDVCEQGLSELGISLQELEEVEADAGLGNGGLGRLAACFLDSLASLNLPGHGCGIRYKHGLFDQKIVDGYQVEFPEQWLLHENVWEVRRYDQAVEVSYFGSVEPLEIDGRLEFRHTNAEVIMAVPYDVPVVGYETSTVNTLRLWNAEPVPFPQNCKDILKYKRETEAVSEFLYPDDTHDEGKILRLKQQYFLVSASLQNIVRMHRERYGDLRQLHEKIAIHINDTHPVLAIPELMRILLDEEKLAWEEAWHITTQTISYTNHTTLSEALEKWPIHIFKPLLPRIYMIIEEINERFCHELWEQYPYEWDRIEAMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANVEIKDRVGEDNCFIFGLTAEEVLHYYQNGGYRASDYYHHNRHIKKVVDQLTNGFFAQSGAEFEAIYDSLVIQNDEYFVLRDFGPYAERQEAVGRAYENRTKWLEMSILNIAQSGHFASDRTILQYSNEIWGIGNAVKQF

SEQ ID NO: 2059 - protein, 467 aa, Agardhiella subulata
PYAKMGYWDPEYVIKDTDVLALFRVSPQPGVDPIEASAAVAGESSTATWTVVWTDLLTACDLYRAKAYKVEAVPNTSDQYFAFIAYDIDLFEEGSIANLTASIIGNVFGFKAVKALRLEDMRIPVAYLKTFQGPATGLVSERERMDKFGRPFLGATVKPKLGLSGKNYGRVVYEGLRGGLDFLKDDENINSQPFMRWKERFLYAMEGVNRSIAATGEVKGHYLNVTAATMEDMYERAEFAKQLGTVIVMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALEAMVLARNEGRDYVAEGPQILQDAAKTCGPLQTALDLWKDISFNYTSTDTADFVETPTANV

SEQ ID NO: 2060 - protein, 387 aa, Zea mays
MADQANQPTVLHKLGGQFHLSSSFSEGVRARNICPSVSSYERSFATRNYMTQSLFSPSMSVTGGINVPVMRTPLFANAPAEKGGKNFMIDFMMGGVSAAVSKTAAAPIERVKLLIQNQDEMIKSGRLSEPYKGIGDCFKRTIKDEGFSSLWRGNTANVIRYFPTQALNFAFKDYFKRLFNFKKDKDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 2061 - protein, 177 aa, Triticum aestivum
  unsure (1)..(177): unsure at all Xaa locations
MAPTVMASSATSVAPFQGLKSTAGLPVSRRSNGASLGSVSNGGRIRCMQVWPIRGXIKKFRDLSYLPPLSTGGXLSKQDHYLIRSKWXPCLQFIKGGFIXREHNASAVYYHGRYWTMWKLSMFXCTDSTQVINQVEEAKKEYPDAYVRIIGFDNMRQVQCVSFIAFKPPGCEESGKA

SEQ ID NO: 2062 - protein, 516 aa, Chlorobium tepidum TLS
MVQKLIFILTGVLLMLGIAMGGDLHAYTQPDPSGAKVGVTADISAANPGKPTAAEITDQIGKNKVSINMVWVLITGFLVMFMQAGFAMVEAGLTRAKNAAHTMSMNMMIYPIGMLGFFVSGFAIMFGGLGTLGTLGGYEGLNQEFAINLFGHTIGLFGMKGFFLNNVYDVGVFALFLFQMVFMDTTATIPTGSMAERWKFSAFAIYGIFVGTIIYPLYGNWVWGGGWLATLGSNFGLGHGHVDFAGSSVVHMTGGVLALVGAIIIGPRIGKYNKDGSPNAIPGHNIPMAIVGAFILAFGWFGFNPGSTLAGTDLRISVVAVNTMIASATGAAASMLYMWLFKTKKPDPTMMINGLLAGLVAITAPSAFVNVQAAALIGLISGVLVIEAAFFIEKVLKIDDPVGAVAVHGVNGAWGCLALGLFADGTYGDGWNGVAGPVTGLFYGNPGQFYAEVIGVLANIIYVGAIGWVVFKLIDVTIGNRVNPDDELDGLDIPEMGVEGYCGIRLDKNSETPLSK

SEQ ID NO: 2063 - protein, 360 aa, Azotobacter vinelandii
MSKQILVLPGDGIGPEIMAEAVKVLQLANEKYQLGFVLGYDELGGAAVDKYGVPLADETLERARRRCHPARRRRRSEMGRHRPGHPPGARPAENPFATGPVRQPAPGVLYPQLAEASTLRPEVVAGLDILIVRELTGGIYFGAPRESRLLANGERMAYDTLPYSESEIRRIAKVGFDMARVRGKKLCSVDKANVLASSQLWRAVVEEVAKDYPDVVLSHMYVDNAAMQLVRAPKQFDVIVTDNMFGDILSDEASMLTGSIGMLPSASLDADNKGMYEPCHGSRRPDIAGKGIANPLATILSVSMMLRYSFGQVEAANAIEQAVSKVLDQGLRTGDIWSEGCRKVGTAEMGDAVVAALATL

SEQ ID NO: 2064 - protein, 576 aa, Buchnera aphidicola str. Bp (Baizongia pistaciae)
MKMLSGSDMVIRSLIDQGIKYIFGYPGGAVLDIYDSLKQMHGIKHILVRHEQSATHMADGYARATGKIGVVLVTSGPGATNSITGIATAYMDSIPLVVISGQVASSLIGYDAFQECDMIGISRPIVKHSFLVKNTEDIPKIFKKAFWLASSGRPGPIVIDLPKDILNPLIKKPYIWPKLISIRSYSPVLQGHQGQIKKALHILIKAKQPIIYIGGGIITSNSHKELKLLAETLNIPVTTSLMALGALPQNHPQNLKMLGMHGTYEANMAIHNADVILAIGVRFDDRTTNNVDKYCPNATIIHIDIDPTSISKTISAHIPIVGHARNVLKQILNLLKNQFSKKNIYNLEHWWKQINCWKSKNSLEYDRKSKKIKPQNVIEIISALTNGNAFVTSDVGQHQMFTALYYSFNKPRRWVNSGGLGTMGYGLPAALGVKLALPKETVLCITGDGSIQMNIQELSTAMQYKLSILILNLNNRSLGMVKQWQDIIYSGRHSHSYMKSLPNFIKLAESYGHIGISIHNPEDLEKKLKLALLKLDQGNLVFVDITIDPEEHVYPMQIRSGGMNEMILRTTEHTSL

SEQ ID NO: 2065 - protein, 553 aa, Arabidopsis thaliana
MSLFLKPFLFLYDTTLSLLLLLFNGWSLEDTAAAQKRREADKNAAETEWIQLQYLWTKTRSVVLLPVFKGLVVMCLVLSIIVFFESFYMNFVILFVKLFKRKPHKVYKWEAMQEDVEVGPDNYPMVLIQIPMYNEKEVFQLSIAAICSLVWPSSRLVVQVVDDSTDPAVREGVDVEIAKWQSQGINIRCERRDNRNGYKAGAMKEALTQSYVKQCDFVAVFDADFQPEPDYLIRAVPFLVHNPDVALVQARWIFVNANKCLMTRMQEMSLNYHFKVEQESGSTRHAFFGFNGTAGVWRISAMEAAGGWKSRTTVEDMDLAVRVGLHGWKFVYLNDLTVRNELPSKFKAYRFQQHRWSCGPANLFRKMTMEIIFNKRVSIWKKFYVIYSFFFVRKVAVHFLTFFFYCIIVPTSVFFPEIHIPSWSTIYVPSLISIFHTLATPRSFYLVIFWVLFENVMAMHRTKGTCIGLLEGGRVNEWVVTEKLGDALKSKLLSRVVQRKSCYQRVNSKEVMVGVYILGCALYGLIYGHTWLHFYLFLQATAFFVSGFGFVGT

SEQ ID NO: 2066 - protein, 236 aa, Zea mays
  unsure (1)..(236): unsure at all Xaa locations
MSPEAGPIMRPADQLLLPFLLLAVASVAAAGGSWENGYGSILRLPSSSPRRFPRSAAVDLIHALNLHPADASPPLSTAGVEGALAPAGTLVERPIRIASFANGGAATSVEDLGPPPGYYRLPNTHDARMFYFFFESRGHKDDPVVIWLTGGPGCSSELALFYENGPFNIADNLSLGWNDFGLDRXSNSIYVDQPTGXTGFSYSSDSRDTRHNEATISNDLYDFLQGFFAEHXSMLK

SEQ ID NO: 2067 - protein, 97 aa, Zea mays
  unsure (1)..(97): unsure at all Xaa locations
GXEDGXXDLNKXXXEXEVFFLRXYDIKNVGGGVXLIEKGXKNMVGWKGFXIXKXKDIEXXIFXLKEEXEFFXDEELRLDXEIREXKEKIXXFXXDGD

SEQ ID NO: 2068 - protein, 128 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGI

SEQ ID NO: 2069 - protein, 472 aa, Haemophilus influenzae Rd
MPNANAIANVFKLIEENNVKFVLLRFTDIKGKEHGVSIPVSLVDEDMFEDGKMFDGSSVEGWKTINKADMLLMPMAETAIVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 2070 - protein, 857 aa, Clostridium thermocellum ATCC 27405
MPMYLFGKITVTAVIPDELSKLKDIAYNLWWSWNSEAIDLFREIDLALWEKLGKNPVRFLKEVSQKKLEAKLKDPDYMQRYKKVVNDFETYMNETDTWFSRNFPDKKDHMVAYFSAEYGLNEVLPIYSGGLGVLSGDHCKSASDLGIPFTAIGLFYKEGYFSQRINSEGWQETIFTPLNPSNLPIQPALNDKGEEVIISVELPGRVVYAKVWVVKVGRVNLYLMDTDIEQNSPYDRGLTARLYGGDQETRIQQEIFLGIGGARVLDALGIKATVYHMNEGHSAFLGLELIRKLVQNHNLPFNQAKEVVASSVIFTTHTPVPAGNDVFPLEMIDRYFGNYWPSLGINRHEFLDLGLRIGEHHNFNMTVLALTLAGQKNGVSELHGAVSRNIFKNVWPGIPEDEIPIGHITNGIHTLTWLSPSIKYLYDKYLDKDWKERLHEKEVWEKVDDIPDEELWKTHCVLKTKMIGYVREKLKEQRAANGESIERIKEVDTLLDSNALTIGFARRFATYKRANLIFRDLARIQKLLNNPEKPVQIIFAGKAHPADGPAHEIIKYINDIAKQEGFNGKVILVENYNMTLARNLVQGVDIWLNNPRRPLEASGTSGQKVAINGIINFSVLDGWWCEGYNGKNGWAIGDDTFYDNEYHQDNADSESIYNILEKQIIPTFFDRNEKGVPEKWVKIMKESIKSIAAQYSTHRMVQDYINKYYIPAMERYDKIKASNYQFAANISEWKKKVAHLWPQVQIIAEKTANQLKERNFISGESIPIYATVNLGGLEPSDVKVQAYYGSIGKNNSIENPVIVDMDVVERNSDGTYLYSANITLYEGGEYGYTFRVIPNHPDIINPFDLGLIRWIVQ

SEQ ID NO: 2071 - protein, 471 aa, Aspergillus niger
FEFLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINAKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGAAYRQLEFLLGRIDSLSAKGDYTS

SEQ ID NO: 2072 - protein, 56 aa, Brassica napus
DWLVEVSEEYKLASDTLYLAVNLIDRFLSNNYIEKRRLQLLGVTCMLIASKYEEIY

SEQ ID NO: 2073 - protein, 462 aa, Bacillus subtilis subsp. subtilis str. 168
MPDQLTVYNPATGEEIKTIPQQSATEVEEAIERSHQAFKTWSKTSANERTSLLKKWYELIVEHKEELADLITKENGKPYQEAVGEVLYGAGYIEWFAEEAKRVYGRTVPAPTTGKRIVVTRQPVGPVAAITPWNFPNAMITRKAAPALAAGCTFIIKPAPDTPLSAYELARLAYEAGIPKDVLQVVIGDGEEIGNVFTSSPKIRKITFTGSTPVGKILMKNSADTVKHVSMELGGHAPLIVDEDADIDLAVEQAMASKYRNAGQTCVCANRLIVHESIKDEFAAKLSEQVSKLKVGNGLEEGVNVGPIINKRGFEKIVSQIDDAVEKGAKVIAGGTYDRNDDKGCYFVNPTVLTDVDTSMNIMHEETFGPVAPIVTFSDIDEAIQLANDTPYGLAAYFFTENYRRGIYISENLEYGIIGWNDGGPSAVQAPFGGMKESGIGREGGSEGIEPYLETKYLSIGL

SEQ ID NO: 2074 - protein, 478 aa, Onikusa foliacea
  unsure (1)..(478): unsure at all Xaa locations
IKNQRYESGVIPYAKMGYWDPDYAVKETDVLALFRVTPQPGVDPVEASAAVAGESSTATWTVVWTDLLTACDLYRAKAYKVELVPNTTDQYFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMXDMYERAXFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLEVDLPQGIFFEQDWASLRKVTPVASGGIHCGQMHQLLDYLGDDVVLQFGGGTIGHPDGIQAGATANRVALEAMVIARNEGRDFVAEGPQILRDAAKTCGPLQTALDLWKDISFNYTSTDTADFVETPTANV

SEQ ID NO: 2075 - protein, 300 aa, Zea mays
  unsure (1)..(300): unsure at all Xaa locations
LQDPTAQTEIDNFMVQQLDGTKNEWGWCKQKLGANAILAVSLAVCKAGASIKRIPLYQHIANLAGNKQLVLPVPAFNEFMILPTGAASFKEAMKMGVEVYHHLKXICLNVGQDAANVGDEGGYENXEGLELLKTAIEKAGYTGKAHHILVVIGMDVAASEFYSDKDQTYDLNFKEENNDGSQKISGDSLKNDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTLLRIEEELGAIAVYA

SEQ ID NO: 2076 - protein, 295 aa, Zea mays
MSSGKRSFFAPKKKATNPFDSDSDDDKPQQRPARASSVPPPDEQRGSSSLFGAGDRGGLFSSAANHHYRNDFRDAGGLEGQSVQELEGYAAYKAEETTRRTRGCVRIAEEMRDTASKTLVTVHQQGQQIHRTHMMAVDIDQDLSRSEKLLGDLGGLFSKKWKPKKNGAIRGPMLTRDDSFIRKGSHLEQRQKLGLADHPPPSNARQFRSEPSSALEKVEIEKAKQDDDLSDLSNILTELKGMAVDMGSEIERYCYISLSCRLICVVSNSFIFFLLYSQFSRKYPKLPKRKYYLSV

SEQ ID NO: 2077 - protein, 565 aa, Methanosarcina mazei Goe1
MKGDNCKNPMDKNQLGEPLPSRNQTVGDTPELTTVAGAPVESNQDSMTSGRRGPLMLQDIWFLEKLAHFDREVIPERRMHAKGSGAFGTFTVTHDITSYTKAAIFSEIGKQTKMFARFSTVAGERGAADAERDIRGFALKFYTEEGNWDMVGNNTPVFFFRDPLKFPDLNHAIKRDPRTNMRSPNTNWDFWTSLPEALLQLTIIMGDRGLPSSFRHMHGFSSHAYSLINKNNERVWVRFHFRSQQGIRNLTDQEAVIVVGMDRESHQRDLYEAIEKGMFPKWKMYIQVMTEEQANSMKNNPFDLTKMWHKKDFPLMPVGEFELNKNPENYFADVEQAAFSPANVVPGISFSPDRMLQGRLFSYGDAHRYRLGVNHHQIPVNSPQGVKNYHSFHRDGQMRVDGNRGSQLHYEPNSYGNWKDQPQYALPVEKTGSTDILRYDFREDDSDYYTQPGELFRAMTPDQQQVLFENTARNMGDSTLQIKHRHIYNCYQADPKYGEGVAKALEIDISTVDLNLPARTSRKANYEANNKHPELNQPTMKKDSGREIDTNGDPYIEPENDPWLL

SEQ ID NO: 2078 - protein, 58 aa, Zea mays
NNQLFLILETHMHQIGVFNESKLRLQILRCLETFLSVILEDLDQRNVYDYLKGLVTCH

SEQ ID NO: 2079 - protein, 390 aa, Prochlorococcus marinus str. MIT 9313
MATLLEQLSTMTVVVADTGDLDAIRKFTPRDATTNPSLILAAAQIPAYQSLIDEALHSSRQLLGNSAAVEEVVHEALDEICVIFGKEILKIVPGRVSTEVDARLSFNTEATIAKAHKLIGLYNDAGITNDRVLIKIASTWEGIKAAEVLEKDGIHCNLTLLFGFSQAVACAEAGVTLISPFVGRILDWYKASTGRDSYAGPEDPGVISVTKIFNYFKTYDYKTEIMGASFRNLDEIIELAGCDLLTISPKLLDQLGSTEAPLKRKLDAVNPVAAESQIHVDKESFESMMRADRMAFEKLDEGIRGFSKAIETLEAQLAHRLAVLEGGAAFCHVVQEIFMLNDLDGDGCITREEWLGSDAVFDALDHDHDGRLLQEDVRSGLGAALALTTA

SEQ ID NO: 2080 - protein, 230 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDVGTIKSFFDANLALTEQPSKFDFYDPKTPFFTAP

SEQ ID NO: 2081 - protein, 388 aa, Oryza sativa
MAAAAGWLRRAAAAAAAPRLPSGLPILPTPPPAPLTEAQSFVLPGIGTAVAGGMDLMAVPKKKVSKYKKGLRNGPKALKPVPVIVRCSRHRFTKSKALAAPREGVGGERKREREMASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRKYVAEKGVNPWIEVDGGVGPKNAYKVIEAGANAIVAGSAVFGAPDYAEAIKGIKTSKRPVAVPA

SEQ ID NO: 2082 - protein, 436 aa, Zea mays
  unsure (1)..(436): unsure at all Xaa locations
MATAVSGRWTSVRTLGRGASXGAVVSLAADAASGALFAVKSAPAGAAEQLRREGSILSSLRSPHVVPCLGHRPAADGGWQLLLEFAPGGSLADVAARSGGGRIGDERAVAAYAADVARGLAYLHGRSVVHGDXKARNVVVGADGRAKLADFGCARAVGSGRPVGGTPAFMAPEVARGEEQGPAADVWALGCTVVEMATGRAPWSDVDSLPAAVHRIGYTDAVPDAPGWMSAEAKDFLARCFARNPRDRWTAAQLLEHPFLASAGRGVKAEEDAAASPTSTLDAAVWEPDSDDEGDASESPAQRIKALACPCSVLPDWDSDEGDWIEVLDEQCEATNLVPVPTKKAAGDDECQLPSVALETGVDFIDADAEGEDPGCCVAVGYDPGCCVAVGLTTALSVGLLEEQCMGDYSNPTVFLAYSIEISKTSLLRKKKKKST

SEQ ID NO: 2083 - protein, 481 aa, Gracilaria domingensis
AGRFKMNVMSPGVIPYAKMGYWDPDYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAASGEVKGHYMNVTAATMEDMYERAEFAKQLGTVIVMIDLVIGYTAIQTMAIWARKNDMILHLHRAGNSTYSRQKIHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 2084 - protein, 490 aa, Bacillus anthracis str. A2012
MAVPYDVPVVGYETSTVNTLRLWNAEPVPFPQNCKDILKYKRETEAVSEFLYPDDTHDEGKILRLKQQYFLVSASLQNIVRLHRERYGDLRQLHEKIAIHINDTHPVLAIPELMRILLDEEKLAWEEAWHITTQTISYTNHTTLSEALEKWPIHIFKPLLPRIYMIIEEINERFCHELWERYPYEWHRIEEMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANIEIKDRVGDDNCFIFGLTAEELFKLSKWWISCK

SEQ ID NO: 2085 - protein, 457 aa, Ascophyllum nodosum
  unsure (1)..(457): unsure at all Xaa locations
DYNVKETDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPATGVVVERERLDKFGRPLLXATVKPKLGLSGKNYGRVVYEGLTGGLDFLKDDENINSQPFMRWKERFLYCMEGVNRAAAATGEVKGSYLNVTAATMENMYERAEYSHAIGSVICMIDLVVGYTAIQSMAIWARKAEMILHLHRAGNSTYARQKNHGINFRVICKWMRMCGVDHIHAGTVVGKLEGDPLMVKGFYNTLLLTELKINLAEGLFFDMDWASLRKCVPVASGGIYCGQMHQLLYYLGDDVVLQFGGGTIGHPDGIQAGATANRVALEAIVLARNEGRDYVGEGPEILRTAGSTCGPLKAALDLWKDITFEYTSTDTPDFTEVATESN

SEQ ID NO: 2086 - protein, 322 aa, Microbulbifer degradans 2-40
MQNLQGMLRDQRVAQDLQEVIFSIELACKDIAKKVQLGALAGVLGATESENVQGETQKKLDVISNDILKASLAANSNVLALASEEEDNVVAANAGGRYVVAFDPLDGSSNIDINGQIGTIFTIFEALDGVAANSGKHFLQQGNKQVCAGYVLYGASTLMVITVDGPTSCLTLDPATQTFSLTNTALQVPDQTQEFAVNLANERFWLPKFKSYVADLKLGEEGVRGKRFNMRWNASMVGDVHRVLMRGGIFMYPSDTRNPKQPAKLRLLYEANPMALLIERAGGKAFNETQRILDVTPCALHERIAVILGSEQEVATCLEYLN

SEQ ID NO: 2087 - protein, 472 aa, Yersinia pestis KIM
MRECTMKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 2088 - protein, 243 aa, Arabidopsis thaliana
MQTIIISPLVSHRLCLARAVPCNRLLNNHHRAPPSIRLSNHRSTTSLRLFSSAAASRDSEMATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 2089 - protein, 306 aa, Mycobacterium tuberculosis CDC1551
MSRPEVLTPFTAIVPAAGLGTRFLPATKTVPKELLPVVDTPGIELVAAEAAAAGAERLVIVTSEGKDGVVAHFVEDLVLEGTLEARGKIAMLAKVRRAPALIKVESVVQAEPLGLGHAIGCVEPTLSPDEDAVAVLLPDDLVLPTGVLETMSKVRASRGGTVLCAIEVAREEISAYGVFDVEPVPDGDYTDDPNVLKVRGMVEKPKAETAPSRYAAAGRYVLDRAIFDALRRIDRGAGGEVQLTDAIALLIAEGHPVHVVVHQGSRHDLGNPGGYLKAAVDFALDRDDYGPDLRRWLVARLGLTEQ

SEQ ID NO: 2090 - protein, 440 aa, Glycine max
  unsure (1)..(440): unsure at all Xaa locations
MEAERKRLKPRLERRNAMKNIDYQLKDEDADADADAAYLNQRSFRVKGIDGEFDRILRSLGLSGPEDFAIPAAAWEEARAHKARSSVQPREGGIKGVRPPVLEPPLVTSAWTSQQQTERVPPSDSVSRDDDVAVEAQTEEVSGFADDHGSFDIHNLSPNGSGYFRSWQKGDILGKGSFGTVYEGFTDDGXFFAVKEVSLLDDGSQGKQSLFQLQQEISLLSQFRHDNIVRYLGTDKDDDKLYIFLELVTKGSLASLYQKYRLRDSQVSAYTRQILSGLKYLHDRNVVHRDIKCANILVDANGSVKLADFGLAKATKLNDVKSSKGSPYWMAPEVVNLRNRGYGLAADIWSLGCTVLEMLTRQPPYSHLEGMQALFRIGRGQPPPVPESLSTDARDFILKCLQVNPNDRPTAARLFGHPFLRRTLLSPLSFASPHRNIYRL

SEQ ID NO: 2091 - protein, 353 aa, Antirrhinum majus
MEGSGGGGMMAFGENNNNNSNNGFCPSNMMMPQLASNCEGGYSTTPFVPLVPFTNHHHHHQEMNRQRSTVVGGSSMVYEEGHQNNSNAITSTGYYFMDSTNCDESSLKAKIMAHPHYHRLLAAYVNCHKIGAPPEVVSRLEEAAAAMARHGTISVGEDPGLDQLMEAYSEMLSKYEQELSKPFKEAMLFLSRIESQFKALTVSAARGEAMFRNGSSEEEIDVNNSFIDPQAEDIELKGQLLRKYSGYLGSLKQEFMKKRKKGKLPKEARQQLLEWWSRHYKWPYPSESQKLALAESTGLDQKQINNWFINQRKRHWKPSEDMQFVVMDAANPQYYMENILGNPFPMDISPALL

SEQ ID NO: 2092 - protein, 444 aa, Bacillus anthracis str. Ames
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVISNALGDHLLEHFIEAKEIEWDIFRTQVHQWERDQYMSLY

SEQ ID NO: 2093 - protein, 247 aa, Triticum aestivum
MGRSPCCEKEHTNKGAWTKEEDQRLIAYIRANGEGCWRSLPKAAGLLRCGKSCRLRWMNYLRPDLKRGNFTDDEDELIIRLHSLLGNKWSLIAGQLPGRTDNEIKNYWNTHIKRKLLSRGMDPHTHRPLTPVDGAAASRPAHIAVPARAAPPTMFAPLTTKQPPMESSSDDGSSGATSTGEPRCPDLNLDLSVGPPAADTPTSHPVCLCRHLGLRGGAVCSCRQADSPGSQGGGFRYFRPLEEGQYI

SEQ ID NO: 2094 - protein, 469 aa, Vibrio vulnificus CMCP6
MSVENVLSLIQENEVKFVDLRFTDTKGKEQHISIPSHQIDADFFEDGKMFDGSSVAGWKGINESDMVMMPDASSAVLDPFTEEATLNIRCDILEPATMQGYDRDPRSIAKRAEEYMRSTGLADTVLVGPEPEFFLFDDVKFATDMSGSFFKIDDVEAAWNTGSDYENGNKGHRPGVKGGYFPVAPVDSSQDLRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSEMALYYIGGIIKHARALNALTNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLKQALEYLDNDREFLTAGGVFSDDFIDSYIELKTKEVERVNVAVHPLEFELYYSV

SEQ ID NO: 2095 - protein, 54 aa, Escherichia coli K12
MLRHMGWTEAADLIVKGMEGAINAKTVTYDFERLMEGAKLLKCSEFGEAIIENM

SEQ ID NO: 2096 - protein, 584 aa, Ferroplasma acidarmanus
MGLIFHDLTKFQDALEIVKNNMAELKDAEEIPLYNATGRISAETIFSNNNLPLFSRSQVDGYAIIASDIKGASYDSPVSLKLAGETNIGEKAVEFPGSGKCIKVPTGGVIPVGADAMVPFEDTKQEGNAIQFFQQVNRFNELSNAGIDVTKGEKLLDSNSMIDPRNIAVLASTGIGNIKVKRKLNIGIVSTGNELLYPGTPYKEGKIYESNSLSIKAELSKYPAFNVNDYGIIEDNYDKIKSAIDRSIEENDVTLTIGSTSAGDHDMVYKILGDKTPGIIFHGIRVKPGKPAIFAMSGEKIMFGLPGFPVSSMMILYSLVIPNLFRKTGYEFSEVSVDAITGQRFELHQGNTDLLLIKLVKHGETYKAYQVPGNSGSISRISKATGYSIIDSKTSFMDINSRINVKLFTGNIPSILIYGQYLPAMEKLPSPISSISTFVESGFNEIKRSMENADADVYLWNYEELPDNKNYDSSITIEIPYGIAYSEENYTTIAVPYRGSGLYEKSLSLAEGMDTTYLDKPEIICDYIKNGRCGAGITYREYAELYSLKFVENGKITFHVYINKNSTKFNELKDAFNSIAGKTT

SEQ ID NO: 2097 - protein, 207 aa, Serratia marcescens
MDFTGKRVWVTGAARGIGEQIARHFLTQGAEVVGFDREFANPDLPYPCVTLDISRPEQVEAVCRQQLAENPRLDVLVNAAGILRMGNTEDLSVDDWHQCINVNASGAFYLFRAVLPHFKAQRSGAIVSIGSNAAHVPRAQMAAYCASKAALTSLNHCVGLEMAPFGVRCNLVSPGSTDTPMQRGMWQTDDAQQRTIAGFPEMFKLGS

SEQ ID NO: 2098 - protein, 502 aa, Mycobacterium tuberculosis H37Rv
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSPMLTSTLTANAIVAAFSLTMLRVLGGAGVFAVFGTFAVVAFVVVYRFAPETKGRKLEEIRHFWENGGRWPAERSPAADEP

SEQ ID NO: 2099 - protein, 378 aa, GIBBERELLA ZEAE PH-1
MLSRGSLRSAQLLRGVAKQQPQLARSFATVQSDIFKPAKYGGKYTVTLIPGDGIGTEVAESVKTVFKADNVPVEWEQIEVSGLEGAGRTEDAFRESVASLKRNKLGLKGILHTPISRSGHQSFNVAMRQELDIYASISLIKNIPGYETRHKDVDLCIIRENTEGEYSGLEHQSVEGVVESLKIITRAKSERIARFAFSFALANGRSKVTCIHKANIMKLADGLFRSTFHQVAKDYPTLETNDMIVDNASMQAVSRPQQFDVMVMPNLYGGILSNIGAALVGGPGIVPGCNMGREVAVFEPGCRHVGLDIKGKDQANPTAMLLSGSMLLRHLGLDEHANRISKATYAVIADGKVRTPDMGGKSTTHEFTRAILDKLETV

SEQ ID NO: 2100 - protein, 344 aa, Glycine max
MSGLIEGLPDAVAIRCLAWVPFYLHPKLELVSRAWRAVVRGPELFKARQELGSSEDLLCVCAFEPENLWQLYDPLRDLWITLPVLPSRIRHLSHFGAVSTAGKLFVIGGGSDAVDPLTGDQDGCFATNEVWSYDPVVRQWSPRAAMLVPRSMFACCVMNGKIVVAGGFTSCRKSISQAEMYDPEKDVWIPMPDLHRTHNSACSGVVIGGKVHVLHKDMSTVQVLDNAGQWTVEEYGWLHGQMAVIRDALYVISYGLIIKQDKKMRKVVGSASEFRRRIGFAMIGLGDELYVIGGVIGPDRWNWDIKPLSDVDVLTLASDRPTWRQAAPMTRCGGTILGCTLLRI

SEQ ID NO: 2101 - protein, 543 aa, Oryza sativa
MGIVPYISQDKTKSVHFSRFHASDPDAEVIALSPKTLLATNRFVCEVCNKGFQREQNLQLHRRGHNLPWKLKQKNPAQAQRRRVYLCPEPTCVHHDPARALGDLTGIKKHFCRKHGEKKWKCDKCSKRYAVQSDWKAHSKICGTREYRCDCGTLFSRRDSFITHRAFCDALAQESSRLPPTSLSSLTSHLYGASNAGNMALSLSQVGSHLTTSLQDGGGHHHHPSPELLRLGGAGGGGGAGGGSSIAARLDHLLSPSGASAFRPPQPAFFLNAAAAAAATGQDFGDDAGNGQHSFLQAKPFHGLMQLPDLQGMAPGAPARRDLTSSTSASSPTTATARVQLWCRRRRRSDASAAGSPAVTSLVATMFLLQSSTTIKRRCCRRCRRPALLQKAAQMGATSSANGPGSMFRGFVGSSPHMRPAAQHMDQSDAHLNDLMNSLAGGGVNAAAMFGGTNGGGVPGAGMFDPRLCDIEHEVKFSQGGGGGGGAGAGTGDGTRDFLGVGGGGIVHGMSTPRGDHHQSSSDMSSLEAEMKSASSFNGRRMP

SEQ ID NO: 2102 - protein, 356 aa, Cordyceps bassiana
MSRANPPNNASASRKISFNVSEQYDIQDVVGEGAYGVVCSAIHKPSGQKVAIKKITPFDHSMFCLRTLREMKLLRYFDHENIISILDIQKPRGFDSFNEVYLIQELMETDMHRVIRTQVLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVLFRTLFADTSDLALDLLEKLLAFNPVKRITVEEALKHPYLEPYHDPEDEPTAPPIPEEFFDFDKHKDNLSKEQLKQLIYQEIMR

SEQ ID NO: 2103 - protein, 469 aa, Streptomyces avermitilis MA-4680
MFQNADEAKKYIADEDVKFVDVRFCDLPGVMQHFTIPAEAFDPAEELAFDGSSIRGFQAIHESDMALRADLSTARVDPFRRDKTVNINFFIHDPITGEQYSRDPRNVAKKAEAYLASTGIADTAYFGPEAEFYVFDSVRFKTAENESFYHIDSEAGAWNTGAIEDNRGYKVRYKGGYFPTPPVDHFADLRAEISLELANSGLQVERQHHEVGTAGQAEINYKFNTLLAAADDLQLFKYIVKNVAWRNGKTATFMPKPIFGDNGSGMHVHQSLWANGDPLFYDEAGYAGLSDTARYYIGGILKHAPSLLAFTNPTVNSYHRLVPGFEAPVNMVYSQRNRSAAMRIPITGSNPKAKRVEFRAPDSSGNPYLAFSALLLAGLDGIKNKVEPAEPIDKDLYELAPEEHASVAQVPTSLPAVLSALEADHEYLLQGNVFTPDLIETWIDYKRTNEIAPLQLRPHPHEFELYFDV

SEQ ID NO: 2104 - protein, 797 aa, Escherichia coli O157:H7 EDL933
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLKKEWANDLDQLINLEKFADDAKFRQQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 2105 - protein, 386 aa, Vitis vinifera
MESTLAFNSGSNSMNQSFSSSAEFNSPVPETIPKSEEDTFVFATLLTSASVLPMALKSALELDLLEIIAKAGPGAFVSTSEIAAKITKRNPKAPVMLDRILRLLATYDVVKCSLRDSPDGGVERLYGLGPVCKYFTTNEDGVSVAPLLLMNQDKVPMQSKRYHLKDAVLDGGIPFNKAYGMTDFEYHGTEPRFNKVFNNGVSGHPTITMKKILEAYKGFEGLTSIVDVGGGTGATLNMIISKYPTIKGINFDLPHVIDDAPSYPGVEHVGGDMFVSVPKGDAIFMKWMCYEWDDAHCLKFLENCYQALPDNGKVIVAECILPVVPDTSLATKSAVHIDVIMLAYNTGGKARTEKEFEALAKGAGFQGFKVVCCAFNSWIMEFCKTA

SEQ ID NO: 2106 - protein, 245 aa, Zea mays subsp. huehuetenangensis
SIRNNPVQNKLMNGEDPINNNHAQTAGGLGVRLATSSSSRDPSPSDEDMDGEVEILGFKMPTEERMRKRKESNRESARRSRYRKAAHLKELEDQVAQLKAENSCLLRRIAALNQKYNDANVDNRVLRADMETLRAKVKMGEDSLKRVIEMSSSVPLSMPISAPTPSSDVPVQVPVPPPIRDSIVGYFSAPAADDDASVGNGFLRLQAQEPASMVVGATLSATEMNRVAAATHCAGAMELIQTAMG

SEQ ID NO: 2107 - protein, 517 aa, Candida albicans
MKNFNALSRLSILSKQLSFNNTNSSIARGDIGLIGLAVMGQNLILNMADHGYTVVAYNRTTAKVDRFLENEAKGKSILGAHSIKELVDQLKRPRRIMLLVKAGAPVDEFINQLLPYLEEGDIIIDGGNSHFPDSNRRYEELAKKGILFVGSGVSGGEEGARTGPSLMPGGNEKAWPHIKEIFQDVAAKSDGEPCCDWVGDAGAGHYVKMVHNGIEYGDMQLICEAYDLMKRVGKFEDKEIGDVFATWNKGVLDSFLIEITRDILYYNDPTDGKPLVEKILDTAGQKGTGKWTAVNALDLGIPVTLIGEAVFSRCLSAMKAERVEASKALKGPQVTGESPITDKKQFIDDLEQALYASKIISYTQGFMLMNQAAKDYGWKLNNAGIALMWRGGCIIRSVFLAEITAAYRKKPDLENLLLYPFFNDAITKAQSGWRASVGKAIQYGIPTPAFSTALAFYDGLRSERLPANLLQAQRDYFGAHTFKVLPGQENELLKKDEWIHINWTGRGGDVSSTTYDA

SEQ ID NO: 2108 - protein, 210 aa, Triticum aestivum
MDEEEHEVYGQEIPVDGDMEGADVDMTAAGDDAAKELDEMKRRLKEMEEEAAALRDMQAKVAKEMQGGDANASTAEAKEQVDARSVYVGNVDYACTPEEVQQHFQACGTVNRVTILTDKFGQPKGFAYVEFLEQEAVQEALNLNESELHGRQIKVSPKRTNVPGMKQRPPRGFNPYHAYPYRSYGAPYFPPYGYGRVPRFRRPTRYRPYF

SEQ ID NO: 2109 - protein, 145 aa, Streptococcus pyogenes MGAS315
METSDELKQRIGELSYEVTQHAATESPFTGEYDDFFEKGIYVDIVSGEVLFSSLDKFNSGCGWPAFSKPIENRMVTNHDDSSYGMRRVEVKSREAGSHLGHVFSDGPKEAGGLRYCINSAALKFIPYDQMEKEGYAQWLTLFDET

SEQ ID NO: 2110 - protein, 263 aa, Zea mays
MSGVGSGRPPAAQKILQSLRPPLSFSTPSRPPFAAPDDYHRFPTPAAATSPAATSGGVGAGAAPPDTVEEGLVIRTPLKRKATSEENAAADSSSCIITSPMLTPVSAKTVKASKAKAKNSKTGPQTPTSNVGSPLNPPTPVGTCRYDNSLGLLTKKFINLLKQAPDGILDLNNAAEVLEVQKRRIYDITNVLEGIGLIEKTLKNRIRWKALDDSSVQLDNGISALQAEVENLSLQVWAVGELATGANHIVEYHWKRGHCGKAY

SEQ ID NO: 2111 - protein, 412 aa, Oryza sativa (japonica cultivar-group)
MAFDAFTDKNAVFRRLKAKPENKMCFDCSAKNPTWASVTYGIFLCLDCSAVHRSLGVHITFVRSTNLDSWTPDQLKMMAFGGNNRAHAFFKQHGWTDGGKVDAKYTSRAAELYRQILQKEVAKSSADNVLPSSPVAASQPQNPSDDFPEFKLPEAPAENTNGKQEPDVTNSQKAPTQTPKAPTHPTFATSVKKSIGAKKIGGKTGGLGVKKLTTKPSESLYDQKPEEPKPAAPVMTTSTTKSGPSLHSRFEYVENEPAVDSRNGGTQMTGHVAPPKSSNFFQEYGMDNGFQKKTSTAATKTQIQETDEARKKFSNAKAISSSQFFGNQSREEKDAQMSLQKFAGSSSISSADLFGRRDMDDSNLDLSAADLINRISFQASQDLSSLKNMAGETGKKLTSIASNFISDLDRIL

SEQ ID NO: 2112 - protein, 570 aa, GIBBERELLA ZEAE PH-1
MSNSSLQKPIDVAEYLFKRLYEVGVRSIHGVPGDYNLVALDYLPQCNLRWVGSVNELNAAYAADGYARVTKMAALITTFGVGELSAINGVAGSYSEHIPVVHIVGCPSTISQRDQMLLHHTLGNGDFDVFANMSSQISCNVAKLNKPSEIAEQIDTALRTCWLRSRPVYIMVPTDMVQEKVEGARLDTPIDLSEPKNDPGNEDFVVDEILKAMYAAKRPVILVDSCAIRHRVVEEVHQLVDKLDLPVFVTPMGKGAVNEDHPNYGGVFAGDGSHPPRAQTIVEESDLLLTIGALKSDFNTTGFSYRTSQINSVDFHSTHCKVRYSTYPGVAMRGVLRKIIDKVDPKSMPAPSIPEVRNEVEKNNDDSETITQAWFWPRVGEYLIPNDIVVTETGTANFGIWDTRFPRNVTALSQVLWGSIGWSVGACQGAALAAKDAGKDGRTILFVGDGSFQLTAQELSTMIRHGLKPTIFVICNDGFTIERFIHGMDAVYNDINNWKYKDLVSVFGGEKTCKTFQIKTKNELNELLTNKEFNAAECLQFVELYMPREDAPRALVLTAEASARNNAKKH

SEQ ID NO: 2113 - protein, 115 aa, Thermosynechococcus elongatus BP-1
MAQGQGFGFGLGKMKELAAAIQKAQQVQEGAKKLQEDLERMDIEGQAAGGAVKVIMSGTQEPRRVEISPDLLSEGAEVLSDLVTAAMRDAYQKSTATMRERMEELTGSLNVPGLG

SEQ ID NO: 2114 - protein, 290 aa, Triticum aestivum
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNITGFGLNFLLTLFAFHGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASEVKEGKEAWKAPAEDHVVVINVGKTDKGSCAEVRPVTEMASAVDVPRRCAAEAAAAPGVDFARSVDVV

SEQ ID NO: 2115 - protein, 702 aa, Hordeum vulgare
MEREDRYVRFQDCKSEQSVISENAVSPRRHCVFRSLKERTGGLFAFLGNFLRSETLKRSMLEDRKSMQNVFHPQGPFLQRWNKIFVLSCIFAVSVDPLFLYIPVINDKNLCWYLDRKMKITASVLRSFTDIFYILHIIFQFRTGFITSSSTNFGRGVLVEDRYAIAKRYLSTYFLIDVCAVLPLPQVVIWIVLPTLQVSQFMKAKNILMLIVICQYVPRVIRIRPLYLQITRSAGIITETAWAGAAFNLIIYMLASHVLGAVWYLLSIQRKDACWKQNCSLTRDCNPAYLYCGNGGTNAGNAFLQNVCVPNITKDNLPDPLFGIFVPAINNVSQSTDFFAKLFYCVWWGLQNLSSLGQNLKTSTYAWENLFAVFVSISGLVLFSLLIGNMQTYLQSATLRIEETRVKSRDTDQWMSYRLLPDNLKERIRRYEQYRWQETSGVDEEHLLMNLPKDLRRAIKRHLCLSLLKRVPMFEKMDDQLLNALCDCLKPVLYTEGGCIVREGDPVNEMFFITRGNLMSMTTNGGKTGFFNSDVLKSGDFCGEELLTWALDPNSATSLPSSTRTVKSMSEVEAFALMAEDLKFVAMQFRRLHSKQLRHTFRFYSQQWRTWAACFIQAAWHRRCRKKMEDALREKEERLQLAIVNDGSTSLSFGAAIYASRFARNMMRTLRRNATRKARLQERVPARLLQKPAEPNFSAEEQ

SEQ ID NO: 2116 - protein, 200 aa, Burkholderia fungorum
MRSRCLVVSNALPLRRLPSLPCAMLGLALLAAQGPHAFAEGAFALTSASFHAGGTVEAAQVFNQGDCKGGNRSPQLSWHDAPPGTRSFAVTMFDQDAPGRGWWHWAVAGIPATVVSLPENASSSGFLSKVGALEARNDFDTDGYGGPCPPAGKPHRYIITVYALSTADLRLAQGRPALMFDHEISTATLGSARMVVSYGR

SEQ ID NO: 2117 - protein, 415 aa, Oryza sativa
MQPRATSQQVLLQQGVKNRRFRFGLAFEQKAQKVSAWEEQNAMQELLRGNKDVMSLAQGVVYWQPPEAAMNKIKEIVWEPSISKYGSDDGLPELREALLEKLRRENKLTKSSIMVTSGANQAFVNVVLTLCDAGDAVVMFAPYYFNSYMSFQMTGVTDILVGASNPETLHPDVDWLEKVLQENNPIPKLVSVVNPGNPSGAFIPKPMLERISELCRNAGAWLVVDNTYEYFMYDGMEHYCLEGNHIVNLFSFSKAYGMMGWRVGYIAHPNEADGLHAQLLKVQDNIPICASIIGQRLALYALEAGPEWIRERVRDLVKNRELLMEAMSPLGKDSVKGGEGAIYLWAKLPEKCSDDFEVVRWLANKHGVAVIPGSASGGPGYIRVSFGGLKESDTRLAAERLRRGLQELVTEGMVQ

SEQ ID NO: 2118 - protein, 252 aa, Streptococcus agalactiae 2603V/R
MSRKPFIAGNWKMNKNPEEAKAFIEAVASKLPSSELVEAGIAAPALTLSTVLEAAKGSELKIAAQNSYFENSGAFTGENSPKVLAEMGTDYVVIGHSERRDYFHETDQDINKKAKAIFANGLTPIICCGESLETYEAGKAVEFVGAQVSAALAGLSEEQVSSLVIAYEPIWAIGTGKSATQDDAQNMCKAVRDVVAADFGQAVADKVRVQYGGSVKPENVAEYMACPDVDGALVGGASLEAESFLALLDFVK

SEQ ID NO: 2119 - protein, 486 aa, Sinorhizobium meliloti
MNADANTEIKGRERYKAGVLKYAQMGYWNGDYEPNDTDLIALFRITPQDGVHPIEPAAAVAGESSTATWTVVWTDPLTACDQYRAKAYRVDPVPGTPGQYFCYVAYDLILFEEGSIANLTASIIGNVLSFKPLKAARLEDMRLPVAYVKTFKGPPTGIVVERERLDKFGKPLLGATTKPKLGLSGKNYGRVVYEGLKGGLDFMKDDENINSQPFMHWRDRYLYCMEAVNHASAVTGEVKGHYLNVTAGTMEEMYRRAEFAKELGSVIVMVDLIIGWTAIQSMSEWCRQNDMILHMHRAGHGTYTRQKNHGISFRVIAKWLRLAGVDHLHAGTAVGKLEGDPLTVQGYYNVCREMKNAVDLPRGLFFEQDWADLKKVLPVASGGIHAGQMHQLLDLFGDDVVLQFGGGTIGHPMGIQAGATANRVALEAMVLARNEGRDIAHEGPEILRAAAKWCKPLEAALDTWGNISFNYTPTDTSDFVPSVTAA

SEQ ID NO: 2120 - protein, 365 aa, Synechococcus sp. PCC 7942
MTRSYRITLLPGDGIGPEIMAVTVDILRAIGRQFDLNFEFEEALIGGSAIDATGEPLPEATLATCRNSDAVLLAAIGGYKWDSLPRSQRPETGLLGLRAGLGLFANLRPAAILPQLVDASSLKREVIEGVDLMVVRELTGGIYFGEPKGCFADEQGRQRAFNTMVYREDEIDRIGRVAFDIARKRGKRLCSVDKANVLEVSQLWRDRMTLLGSDYADVELSHLYVDNAAMQLVRWPKQFDTIVTGNLFGDILSDIAAMLTGSIGMLPSASLGAEGPGVFEPVHGSAPDIAGQDKANPLAQVLSAAMMLRYGLDEPEAAARIEAAVNQVLDQGYRTGDLYSEGMTLVGCKGMGDALLAALESPVSA

SEQ ID NO: 2121 - protein, 504 aa, Xylella fastidiosa Ann-1
MPTRKKSMDCKVHRLGMPIALADSDCYPNPKRFPLMSLENVEKLVKDKKIEFVDLRFVDMRGVQQHVTFPVNILEPSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFSNDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLAPEEEKLIPQVCSSLDQALEALDKDRDFLKAGGVMSDDFINGYIALKMQEVTQFRAATHPLEYQMYYAN

SEQ ID NO: 2122 - protein, 145 aa, Zea mays
MEAKNGYSYSPLAGDDHEAAAAAAEVISTTGAGFGGDDVKLRLLGYKQQLKRDLSVVANFSVSFSIISVITGVTTLYGTGLQFGGPVTMVYGWPIAGAFTVAVGLAMAEICSAYPTSGGLYFWSARLCTHRRWGPFAAWLTGWVN

SEQ ID NO: 2123 - protein, 798 aa, Lactobacillus plantarum WCFS1
MKLTCAQFKKDFLSEIETLYSTSLSDTSTIGQFIALGQLVRRYNSQSWTRTAKFYRDHHQKQVYYFSIEFLPGRLLASNLLNLNLLTTVKKGLTELGLDFETISQAEPDPALGNGGLGRLAACYMDAMASLKIAGNGNGIRYRYGLFKQVFMDGYQVELPDDWLHHGNVWETRRDNKSCIVQFGGNVWLQPQADGSLQPQSENTEDVLAVPYDVGIVGYHNDITNTLRLWSAELPPSATYSSQDQRDRISEITKVLYPDDSNSAGQQLRLRQEYFFSSAGVQSIVRDFCATHHGIKLLGKKVAIHINDTHPTLVIPEMMRLLMDEHHCSWEVAWTLTTQVMSYTNHTILQEALETWPIDMFKNLLPRIYQIIAEIDRRYREQQTPIFGKALVDQTAPLGNGQVRMAYLAVIGSHSVNGVAPLHTELLKTDVLRGLYQVYPERFNNKTNGIATRRWVQLANQPLAQLIDQTIGSDWRRQPDLLQTLLPYQQDDHFLYQLGQVKLTNKQALAAYVQRTMGIKIRTDAIYDVQIKRLHAYKRQLLHVFEILREYFAIKDHPQQPVVPRVHIFGAKAAPSYHYAKAIIKLINVVADMVNQDPAIGDRLKIVFIPNYGVSIAELIIPAADVSEQISTASKEASGTSNMKLMANGALSLATYDGANIDIMQAAGAENEYPFGLKVNEVYDYYHRGNYHAADFYDADPELKRLLDSLIDGTIPGIPTVGREIYDSLLRYNDEFFVLADYRAYVTQQQQISRDFQNQPTWQQRSLANIAASGHFAADLAVARYADDIWQVPHERLN

SEQ ID NO: 2124 - protein, 326 aa, Methanothermobacter thermautotrophicus str. Delta H
MDTLIAISLILSLYMAFNIAANDIGNSVGTAVGSGSLKMRRALILGAFFVSLGAILLGGNVIKTISEGIIPQGFFSPRMALVITATASIWITFTIIKKIPISGSDAIVSSVIGAGVAAVGIQNMRLDVIGFIVLSWIISPPLAGLLMGFLIYHAIRNMIIKALQGMGLRDRAEKIFSYLQIASSSFSALNLGAIDIAVATGVIFAVGSFGGNWIRILGAIGLVAGILLAGNRVTETIGRRITDLTPSRGFSAQLAAAIIVYLFMGYGMPVSPTQTLVGSVIGVGIAHGTSTVKYDVIGHIAYTWIVTIPTCIILSSAIYIITGFWG

SEQ ID NO: 2125 - protein, 591 aa, Vitis vinifera
MESTLKDIRDGASVLDLDPKATVGGGVEDLYGEDFATEDQLVTPWTVSVASGYSLLRDPRHNKGLAFNDKERDAHYLCGLLPPVVSTQELQERKLMNSIRQYQVPLQKYMAMMDLQERNERLFYKLLIDNVEELLPVVYTPTVGEACQKYGSIFRRPQGLYISLKEKGKILEVLKNWPERRIQVIVVTDGERILGLGDLGCQGMGIPVGKLSLYTALGGVRPSACLPITIDVGTNNEKLLANEFYIGLKQRRATGKEYSEFLQEFMSPVKQNYGEKVLIQFEDFANHNAFDLLAKYGTTHLAFNDDIQGTASVVLAGIVSALRLLGGTLADHKFLFLGAGEAGTGIAELIALEMSKQTKCPIEETRKKIWLVDSKGLIVGSRKDSLQQFKKPWAHEHEPVKDLLDAVKVIKPTVLIGSSGVGKAFTKEVIEAMASCNEKPLILALSNPTSQSECTAEEAYTWTQGRAIFASGSPFDPVEYNGKTFVPGQANNAYIFPGLGMGLVISGAIRVHDEMLLAASEALARQVTQENFDKGLIYPPFSNIRKISAHIAANVAAKAYELGLATRLPQPENLVKYAESCMYSPVYRSYR

SEQ ID NO: 2126 - protein, 499 aa, Aspergillus oryzae
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCLIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMHDLYNMINTVKSDCPDSTLLGTFVENHDNPRFASYTNDIALAKNVAAFIILNDGIPIIYAGQEQHYAGGNDPANREATWASGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 2127 - protein, 177 aa, Glycine max
  unsure (1)..(177): unsure at all Xaa locations
MVLEATMICIDNSEWMRNGDYSPSRFQAQTDAVNLICGAKTQSNPENTVGVLTMAGKGVRVLVTPTSDLGKILACMHGLEIGGEMNLAAGIQVAQLALKHRQNKKQQQRIIGFAGGPVKHEKKMLEMXGRKLKKKNILDLKGISFRKFQCRPVNVNLEHLSPFSLLLIVFFFIRNPL

SEQ ID NO: 2128 - protein, 424 aa, Zea mays
MAARAADENRRPAAGKPAPGVRDMASRRALTDIKNLVGAAPYPCAIAKKPMLQKSRRDEKQPALASSRPMTRKFAASLASKGQPECQPIVADPEPEFCQQKESVGDGTVDIDVELYELVDDSDSDIDMGATENKDIMNEDELLMDIDSADSGNPLAATEYVEELYTFYRENEAKSCVRPDYMSSQQDINSKMRAILIDWLIEVHYKFELMDETLFLMVNIIDRFLEKEVVPRKKLQLVGVTAMLLACKYEEVSVPVVEDLVLISDRAYTKGQILEMEKLILNTLQFNMSVPTPYVFMKRFLKAADADKQLELASFFMLELCLVEYQMLDYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 2129 - protein, 370 aa, Oryza sativa
  unsure (1)..(370): unsure at all Xaa locations
MVRWRRWICCNCQVNESDQLENGHAKVLTSNADGVTKGLKDSATXEKAQPQNSALTINIPVLSLDELVEKTDDFGSSALIGEGSYGRVYYAVLDSGTKIAVKKLDSNENEPTSEFLTQVALVSRLKHEHFVDMLGYCTEGNLRLVAYEFATMGSLHDVLHGRKGVQGAQPGPALDWMQRVRIAVDAAKGLEYLHEKVQPSIVHRDIRSSNILLFEDFKAKVADFNLSNQAPDMAARLHCTRVLGTFGYHAPEYAMTGQLTQKSDVYSFGVVLLELLPGRKPVDHTMPRGQQSLVPWAXPRLTEDKVXRCIDPRLNGEYPPKGVAKLAPVAPLCVQYEAEFRPNMSIVVKALSPLLTSKPTPPAPPPALDG

SEQ ID NO: 2130 - protein, 336 aa, Oryza sativa
MAAPPPPANQFVYIDAAALHSVLPFPSLISHLGAGLPAFAAGIHCPHRVSFPLPTAPSASLLLMPSWSAHPSLPYLALKAVTSFPANSPRLPSVHAAVSLFDSASGVPLASLDGSALTLLRTAAVSALAASLLASPTRPPSTLALAGAGALAPYLAEAHLSALPSISRILIWNRTKAKSAALAARLRDAHPGVAVEEADSMDEAVSAADVVSCATGSQEPIVRGELLKPGAHLDLVGSFTPAMRECDDEALRRGRVFIDFEAAMQEAGELVGALQRGVLRREDVAGTLAELAAGSVAGRRCDDEITVFKSVGTAVVDLLAAQLAYETYIATTTKKT

SEQ ID NO: 2131 - protein, 194 aa, Mucor circinelloides
VISNASCTTNCLAPLAKVINDNFGIVEGLMTTVHATTATQKTVDGPSNKDWRGGRGAGANIIPSSTGAAKAVGKVIPELNGKLTGMAFRVPTPDVSVVDLTVTLDNGATYEEIKAVIKKASENELKGILGYTNDQVVSTDFVGDAQSSIFDAAAGIALNDKFVKLVSWYDNEFGYSNRVIDLLAYAAKVDAAAQ

SEQ ID NO: 2132 - protein, 179 aa, Fritillaria agrestis
MASSATMLSSVATAACAAPAQASMVAPFVGLKSASAFPVTQKTATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTGAAQVVKEAAECKKEYPAAFIRVIGFDNVRQVQCVSFIVEKPE

SEQ ID NO: 2133 - protein, 79 aa, Triticum aestivum
FQRGVGIAIDATTQGDVADWVFAVSMGLATGIFIYVSVNHLLSKGYKPQRPVKADTPLGRWLAVVLGVGVIAVVMIWDT

SEQ ID NO: 2134 - protein, 179 aa, Triticum aestivum
ASIASGDSNRSTASDREQTSQVRRKRGKIAQGIKVPVTLGPKLSETVKGKLTLGARILQAGGVEKVFRQWVSVDKNERLVRASQCYLSTTAGPIAGMLFVSTERVAFRSDRSLAVAAPDGAKLRVPYKVTIPLRKVRRAVPTENKHKPEQRYIEVVTNDGFEFWFMGFVSYHRSLQHLE

SEQ ID NO: 2135 - protein, 180 aa, Triticum aestivum
  unsure (1)..(180): unsure at all Xaa locations
GIRILVTSDAADGCAAEWRSLASLLPRPFAPPDLRPRHAPLLPGPRVNRLGDPVDAAANGFAAGDLEGRLEDAAEPAAXRAAHAPYSGCPSGFAVVDGEGKVYAGGCLESAAYNPTLGPVQTAIIAMIAASGGSAGDVVAAALVEKDGAVAAQEATARVFLAAVAPQASFHVYKYRSSDV

SEQ ID NO: 2136 - protein, 187 aa, Taxodium distichum
ICTYFAQPLHQRDYTRWPEKPEGWREIVDKYSEALMGLASKLLAIISEALGLDPEAVTKACVEMDQKVVINYYPTCPQPDMTLGLKRHTDPGTITLLLQDQVGGLQATKDDGLNWITVQPVQGAFVVNLGDHMHYLSNGKFKTADHQAVVNSNCSRLSIATFQNPSQEAIVYPLKLEEGEQSFMEEP

SEQ ID NO: 2137 - protein, 186 aa, Halobacterium sp. NRC-1
MSTLADTIHIENVVASSDLGQELALDQLSTDLPGAEYNPEDFPGVVYRLQEPKSATLIFRSGKVVCTGAKSVDDVHEALGIVFGDIRELGIDVTSNPPIEVQNIVSSASLEQSLNLNAIAIGLGLEQIEYEPEQFPGLVYRLDDPDVVVLLFGSGKLVITGGQNPDEAEQALAHVQDRLTELGLLD

SEQ ID NO: 2138 - protein, 442 aa, Oryza sativa (japonica cultivar-group)
MSTRSKSVPVPAGGGAATVPLAVLLRREVVSEKTAAERPELQVGLFSQAKKGEDYTFLKPDCERLPGVPSSSFSAFGLFDGHNGNGAAIYTKENLLSNILTAIPADLNREDWLAALPRAMVAAFVKTDKDFQTKARSSGTTVTFVIIDGLFITVASVGDSRCVLEAEGSIYHLSADHRFDASKEEVDRVTESGGDVGRLNVVGGAEIGPLRCWPGGLCLSRSIGDQDVGQFIVPVPYVKQVKLSTAGGRLIISSDGVWDVLTAEVAFNCSRTLPPEAAAEQIVKEAVQQKGLRDDTTCIVVDILPDKANLTMPHTKKQPGMGVFKNMFRKKTPSDSSSHTDREYMDPDIVEEIFEDGCAFLSKRLDSEYPVRNMFKLFICAICQVELKPSQGISVHEDSSQPGNLRRWDGPFLCQGCQEKKEAMEGKRRSRDSSSRNSGSSE

SEQ ID NO: 2139 - protein, 763 aa, Arabidopsis thaliana
MWKLKIGEGNGEDPYLFSSNNFVGRQTWEFDPKAGTPEERAAVEDARRNYLDNRPRVKGCSDLLWRMQFLKEAKFEQVIPPVKIDDGEGITYKNATDALRRAVSFYSALQSSDGHWPAEITGTLFFLPPLVFCFYITGHLEKIFDAEHRKEMLRHIYCHQNEDGGWGLHIEGKSVMFCTVLNYICLRMLGEGPNGGRNNACKRARQWILDHGGVTYIPSWGKIWLSILGIYDWSGTNPMPPEIWLLPSFFPIHLGKTLCYTRMVYMPMSYLYGKRFVGPLTPLIMLLRKELHLQPYEEINWNKARRLCAKEDMIYPHPLVQDLLWDTLHNFVEPILTNWPLKKLVREKALRVAMEHIHYEDENSHYITIGCVEKVLCMLACWIENPNGDHFKKHLARIPDFMWVAEDGLKMQSFGSQLWDTVFAIQALLACDLSDETDDVLRKGHSFIKKSQVRENPSGDFKSMYRHISKGAWTLSDRDHGWQVSDCTAEALKCCMLLSMMPAEVVGQKIDPEQLYDSVNLLLSLQGEKGGLTAWEPVRAQEWLELLNPTDFFTCVMAEREYVECTSAVIQALVLFKQLYPDHRTKEIIKSIEKGVQFIESKQTPDGSWHGNWGICFIYATWFALSGLAAAGKTYKSCLAVRKGVDFLLAIQEEDGGWGESHLSCPEQRYIPLEGNRSNLVQTAWAMMGLIHAGQAERDPTPLHRAAKLIITSQLENGDFPQQEILGVFMNTCMLHYATYRNIFPLWALAEYRKAAFATHQDL

SEQ ID NO: 2140 - protein, 578 aa, Desulfitobacterium hafniense
MPKITMTPSEAICETLVAEGIDHVTGIVGSAFMDLLDLFPTAGIRFIPVRHEQSAGHMEDAFCRVTGRAGVIIGQNGPGITNMVTSVAAANSAHTPMVVICPSAGTPTVGWDGFQEADTVKIFEAITKETIRVPHPSRAADCLRTAFRIAYAERGPVLYDIPRDYFYGEISEQILEPHQYRVDQRGCGDLASLDKAAELLISAQRPVIISGRGVVDTQSKDIVAKIAEILTAPVACTYLHNDAFPYDHPLWVGPIGYMGSKAAMNLVAEADVILAIGTRLSVFGTTPQYDIDYFPESAKIIQVDINPRNIARTHPVEVGLIADAREAAREILKRLEERIAEPKVSQSRLTQIKAQQNAWEEEIVQSAMVDGYPINPRRALYEIQKALPENAIVATDIGNVSSTANSYLKFKGAGKHIAALTFGNTGFAYPAALGAQLAEPDSPVVAIIGDGAWGMSLHEVSTAVEHNLPVVAIVFRNGAWCAEKKNQIDFYNNRFVGVDIPTPESFAPVAIAMGAEGIRVSKAEEVGPALKRALDSRKPTVLEIVCDGTQLAPPFRKDALKLPTRLLPKYKSLDVRNW

SEQ ID NO: 2141 - protein, 231 aa, Triticum aestivum
  unsure (1)..(231): unsure at all Xaa locations
SNGSPSPAAWWSPSRXEKARDGSPVDGVVHQQQSPGTASAQQPQQQQQQVALITLPPPREVARPEMPRDSVLSTGRVDEEEWVTVFGFLPVDANFVLREFEKCGLVLRHVPGPRDANWMHILYQSRHDAQKALAKHGQQLNSVLIIGVKQVDPWQRPYLNENTDDTYNGGMSVPFPSQAVAPSGFATRNALAPLPSNPMQNGNESNRGASGAIASPAKSVLSKVMDVMFGL

SEQ ID NO: 2142 - protein, 269 aa, Zea mays
MDAPFFHELRRQASSYLTGKIRSARLALTDVTPTQLMTEEATNGDASPPNVKTMGLIARQAFEVDEYVRITDILHRRFASFDPRQGQGQWQWREAYKALLLLDHLLTHGPRSVAVEFQKDREAIERMATFQHIDERGFNWGRTVTSKSERVLKLLERGPFLEEERERARKIAREIRGFGSFNLSGASHAAPQPPPGDEGSRGYGRSNSQFEQRWRHKDGDDSDKENLIQSPEPARVAREVEAEPEEPHPHPFHGLGQKQRPEAMLLLSQ

SEQ ID NO: 2143 - protein, 473 aa, Prochlorococcus marinus subsp. marinus str. CCMP1375
MGKSPQDVLRQIKDEGIELIDLKFTDIHGKWQHLTVTSDMVDENSFKEGLAFDGSSIRGWKAINESDMSMVPDSSTAWVDPFYRHKTLSLICSIQEPRSGEAYSRCPRSLAQKALAYLSNTGLADSAYFGPEPEFFIFDDVRYDSKEGTSFYSVDTIEAPWNTGRAEEGGNLAYKIQYKEGYFPVSPNDTAQDLRSEMLLLIGELGIPIEKHHHEVAGPGQHELGMKFASLISAADNVMTYKYVVRNIAKKYGKTATFMPKPVWNDNGTGMHVHQSLWKDGQPMFYGEGTYANLSQTAKWYIGGILKHAPSFLAFTNPTTNSYKRLVPGFEAPVNLVYSQGNRSAAVRIPLTGPSPKAKRLEFRSGDALANPYLAFSAMMMAGIDGIKNQIDPGDGVDVDLFELPEDELSKIATVPSSLNNALEALKADNDYLTAGGVFDHDFINNFIEMKYEEVQQLRQRPHPHEFFMYYDA

SEQ ID NO: 2144 - protein, 393 aa, Lycopersicon esculentum
MPQLVKLPLPFPINGKRTLPILKHFLTSSSPSPSPSHALTSVRSVTYMPRPGDGTPRAVTLIPGDGIGPLVTGAVEQVMEAMHAPVLLWRYDVHGDMKEYASGDVDGISNPGRNKVWFKREGWKTPVGGGVSSLNVQLRKELDLYASLVHCFNLKGLPTRHENVDIVVIRENTEGEYSGLEHEVVPGVVESLKVMTKFCSERIAKYAFEYAYLNNRKVVTAVHKANIMENLLMVYFWESCRRDRKQITLGSSTMRELWTTVACNLYQSLSNLMLWSPLISTEIWLTNTAAGIAGGTGCLCPGGNVGGDHAVFEQGASAGNVGNEKILEQKKANPIALFLSSAMMLRHLQFPSFADRLETSVKRVIAEGKYMTKDLGGDCTTQEITDAVIANLD

SEQ ID NO: 2145 - protein, 204 aa, Haloferax volcanii
MIRLVVVDNFDSFTYNLVEYFSEQTVEGEPLDIEVRKTTASLDEIRDLDPDAIVISPGPGHPKNDRDVGVTNDVLTELSTEIPTLGVCLGLEAAVYAYGGTIGHAPDAIHGKAFPVDHDGAGVFAGLEDGFPAGRYHSLVATDVPDCFDVSATTDHDGEALVMGVRHRDYPIECVQFHPESVLTGSGHGVVRNFLTAVAGFDVA

SEQ ID NO: 2146 - protein, 237 aa, Zea mays
  unsure (1)..(237): unsure at all Xaa locations
VRPASAQRPPPAPGGRRWAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAGKVPVGIGRNTKIRNCIIDMNARIGKNVVITNXEGYYIRSGIVVILKNATINDGSVI

SEQ ID NO: 2147 - protein, 333 aa, Bradyrhizobium japonicum USDA 110
MADVKYDVLGIGNALFDVLVRTDEAFLAKHGMTKGSMSLIDEARAAAIYQDMGPATEVSGGSAANTIVGIGSLGARAAYVGKVKDDQIGKLYVHDIRAAGVAFNTPAAKDGPATGCSYILVTGDGERTMNTYLGAAQDLSPADIDPAEIASAGIVYLEGYLWDPKNAKEAFVKAAKIAHDARRKVALTLSDSFCVDRYRDEFLSLMRNGTVDIVFANESELHSLYMTSDFDTALKQLRNDVNLGVVTRSEKGCMVVSAEDAVAAPAAPIAKLVDTTGAGDLFAAGFLYGLARNLPYKQCGELGALAAAEVIQHIGARPQVSLKELAEQRGLTA

SEQ ID NO: 2148 - protein, 684 aa, Enterococcus faecalis V583
MEFTFLIIVFALSITFSNIFNRIVPVIPLPIVQIIVGVLIGLTKMGQEIEFEPEVFLVMIIAPLLFREGELINLKAMMKNFGMILFLAFFGVLITLVGVGWTLHMILPTLPLAACFAFGAALGPTDAVAVGSLSGRIDIPERSMNILSGEGLINDASGVTAFQFALAALLTGSFSPVEAAGTLVISSIGGAVVGIVLVLLKQQIVHLLETAVAKDVTGYLLIELLLPFIAYLISELIGVSGIIAAVIAGIMQASSLKKVSLFEAELSNVGESIWSLIEFTLNALVFLFLGIELSQVFSPIWIDQQYSNWFLLLVVLIISAVVFLIRFLAIFSVYTLQHGLKKVKNAMNEMLILTFGGVKGTVSLATIFILPTAINGEHFKERPLLLFITACVILVTLIGGILVLPFLTDSETEVENEESVEIDLLRDVIDVLKQQNEENPRGEMNAVIENYQDRLKELYTEQLSAERKQEVQELRTLIVSIERDGLEESLKQGEISVRSYRMYQRLITRMQRSIAKQLLSIVGFWLLFARQIISILLHPKLFFNRGEASEEEKELRNEELENIRQVFLRNSQVILKSLDNLRGVYDDDLIDFFIDGRLDLAHKFEKGEFIDSYIVHTETDYVKDLLLGFQEERRMIDHYEQSERISIIEANELRKNVNLLESYSISGEVNNVPLKRFVKNFNKE

SEQ ID NO: 2149 - protein, 235 aa, Triticum aestivum
  unsure (1)..(235): unsure at all Xaa locations
GGSSTRPANGAVTVNSAATTVGSANARFHSQQPHQDRQSRWASCFPGLSCFGSQKGGKRIVPAARMPDGNASTNRGNALQSGRNSNQNGAMNLSLLAPPSSPASFSNSALPSTAQSPNRFLSISANSPGGPTSNMFAVGPYANEPQLVSPPTAFSTFTTEPSTAPLTPPPELAHATTPSSPDVPYXXRFFHSYTGLKTAGKEHSMHYLSTTXXSGGLGLQGSYPLYPXSPSSSLI

SEQ ID NO: 2150 - protein, 303 aa, Guillardia theta
MDNYKRIEILGQGAYGKVYKAQDLRNGNLVALKKALSSSDEEGIPPTTLREISILKSVSECEFIVKLLDVVNTKSKNGKISIYIVFQYLDSDLKSYMISNYGKGRGMDENSAKKFCFQLLIGMYHCHKLGIIHRDLKPQNILIEKGEKLKIADFGLSRNFSIPVGKYTHEVVTLWYRAPEILLGARTYSSPVDIWSIGCIFAEMLTGNPLFCGESEIEQLLSIFKTIGTPTSQTWPEVLNFKDWHEFPIWPQINLKYSFENISEETLEFIQVFLRLNPNKRISILGAITNTYFEHFFKDYNLY

SEQ ID NO: 2151 - protein, 496 aa, Mentha spicata
MELDLLSAIIILVATYIVSLLINQWRKSKSQQNLPPSPPKLPVIGHLHFLWGGLPQHVFRSIAQKYGPVAHVQLGEVYSVVLSSAEAAKQAMKVLDPNFADRFDGIGSRTMWYDKDDIIFSPYNDHWRQMRRICVTELLSPKNVRSFGYIRQEEIERLIRLLGSSGGAPVDVTEEVSKMSCVVVCRAAFGSVLKDQGSLAELVKESLALASGFELADLYPSSWLLNLLSLNKYRLQRMRRRLDHILDGFLEEHREKKSGEFGGEDIVDVLFRMQKGSDIKIPITSNCIKGFIFDTFSAGAETSSTTISWALSELMRNPAKMAKVQAEVREALKGKTVVDLSEVQELKYLRSVLKETLRLHPPFPLIPRQSREECEVNGYTIPAKTRIFINVWAIGRDPQYWEDPDTFRPERFDEVSRDFMGNDFEFIPFGAGRRICPGLHFGLANVEIPLAQLLYHFDWKLPQGMTDADLDMTETPGLSGPKKKNVCLVPTLYKSP

SEQ ID NO: 2152 - protein, 468 aa, Triticum aestivum
  unsure (1)..(468): unsure at all Xaa locations
AQHHFLASPGSGRVCVCVDRGVASSLFLPPPIPISPPPPQFGGSEGSRPIGLVARRDGDRTPARADRSSVFARKLRAKSDXKMCFDCNAQRTPPGPPLPYGVFLCIDCSAVHRSLGVHVSFVRSTNLDSWTPEQLKMMVYGGNXNRAQSFXLKQHGXWTDGGKIEAKXTLLRAADLYRQLLXKEVSKSSTEDGNNSGPPSPVAASQTSSQAAAFPXIFKLVEVPERSCEMRPESEIIRSPKAPTHSFKKPIGGKKPGSKTGGLGARKLTXKPSESLYEQKPEEPAPALPSVAESTTARSKSHTSRFEYVENVPSAGSSSAENQAFGHVAPPKSSNFFGEYGMDSGYHKKSTSGASKMQXEESSEARQKFSNAKSISSSQFFGXQTNLEKEGQISLQKFSGSSAISSADLFGQQANNSNADLSASDLINRIXPFQATQDLTSLKSMAGQTGKKLTSMASNIISDLDRIL

SEQ ID NO: 2153 - protein, 175 aa, Glycine max
LHERCSCTFVLSTENGVNGFTLDPSLGEFILTHPNIKIPSKGKIYSVNEGNARNWDEPTTKYVQMCKFPQDGSPPKSLRYIGSMVADIHRTLLYGGIFMYPADAKSPNGKLRLLYEVFPMSYLMEQAGGQAFTGKQRALDLIPKKIHERSPVFLGSYDDIEQMKELYAASKEDDA

SEQ ID NO: 2154 - protein, 226 aa, Yarrowia lipolytica
MEPETKKTKTDSKKIVLLGGDFCGPEVIAEAVKVLKSVAEASGTEFVFEDRLIGGAAIEKEGEPITDATLDICRKADSIMLGAVGGAANTVWTTPDGRTDVRPEQGLLKLRKDLNLYANLRPCQLLSPKLADLSPIRNVEGTDFIIVRELVGGIYFGERKEDDGSGVASDTETYSVPEVERIARMAAFLALQHNPPLPVWSLDKANVLASSRLWRKTVTRVLKDEF

SEQ ID NO: 2155 - protein, 398 aa, Prochlorococcus marinus str. MIT 9313
MATSRRLGRLGRGVFDRNDRRKQAYRLANAGPQSLPLLDLSLGSTDLSPPAVALEAIEVALRAPESSSYCLHASTRPFREAVAAWSQRRFGVSVDPDREVLLLVGSQEGTAHLPLAVLDPGDSALILDPAYPSHRGGLILADARIERLLLRPEQEWRPDFKALSNSQWDQLRMMVFGFPHNPTAQVGEQSWLAEAMDRGIRHQVVVAHDNPYVDLALDGEAPALLRCPGWRECGIEFFSFSKAWCLGGFRLAFAIGAEHLITALRELKGVVDFNQSLALQRGAIAALTDAQDWPQEILGVYRERRDRTLAALHALGWHAPCPSMALYLWLPIPAWAKQQNYNDETLAADLLDQTGVALTPGSGFGSGGDGWLRLALVHPVEDLEAAVARMWPWWHAHI

SEQ ID NO: 2156 - protein, 325 aa, GIBBERELLA ZEAE PH-1
MSQTFKQAAESARSKARGDSAAIANDLLHTPLMRAALPFINGGIAGMVATTVIQPVDMVKVRIQLAGEGTATGPKPSPLAVTRQIIASGKFLDLYTGLSAGLLRQAVYTTARLGMFDTLMGNLSARAKTEGRTVGFKERATAGLTAGGIAAMIGNPADLALIRMQSDGLKPLAERKNYKSVIDALSSIAKSEGVGALWAGAAPTVARAMALNFGQLAFFSEAKVQLKKNTDLSARTQTLTASAVAGFFASFFSLPFDFVKTRLQKQSKGPDGKLPYRSMIDCFSKVAKQEGLGRFYRGFGTYYVRIAPHAMVTLIVADYLGFITK

SEQ ID NO: 2157 - protein, 545 aa, Azotobacter vinelandii
MQLLYTILIMLLVVGGTRITAQFIPIPLPLIQIAIGALLALPGFGLHVRLDPELFLLLFIPPLLFVDGWRMPKGEFWRLRTPILLLAFGLALFTVLGAGWLIHLLFPGIPLAAAFALAAVLSPTDAVAVSAIAHGRLPRTLMNILQGEALMNDASGLVAFKFAVAAALTGSFSLTEAGLEFVLVALGGLAVGVALSYALGRFRAWMIALGWEEPAPHVMFMLLLPFAAYVAAEHLGVSGILSAVAAGMMQSRLDLLPRQTTTRLLNRSVWALLEFTFNGLIFLLLGLQLPDIVKATLKEGELFWTSAVELGLLVGQVFLALILLRFVWTWLYWLVSGALRRWRGLPSSFAGQSSLRLAALLTLGGVRGAVTLAGVLSLPLLLSNGEAFPQRDLLIFVAAGVILLSLLVATLGLPLLLRGLPADNEEAREQELRRNRVKTVEAAIRALEAQSEEPGLSPEEMALAAEVKAKIMAEYRQQLERDDSVEARTRLRQMDALEQRLRLQALRSQRLELYRLRRRHQVDDDLLGEILRELDISEARLFRST

SEQ ID NO: 2158 - protein, 484 aa, Saccharomyces cerevisiae
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 2159 - protein, 182 aa, Streptomyces avermitilis MA-4680
MTELVNITELLLSRIRDVRDYPEPGVVFKDITPLLADPAAFTALTGALAELTVRHGATKIVGLEARGFILGAPAAVQAGVGFIPVRKAGKLPGATLSQSYDLEYGSAEIEVHAEDLVAGDRVMVVDDVLATGGTAEASLQLIRRAGAEVAGVSVLMELGFLGGRARLEPALAGAPLEALLQI

SEQ ID NO: 2160 - protein, 332 aa, Listeria monocytogenes EGD-e
MEGMFLITLVIVLAALAFDLINGFHDTANAIATSVSTKALKPRHAIILAAVMNFVGAISFTGVAKTITKDIVNPFDLDHGELVILAALLSAIAWNLITWYFGIPSSSSHALIGSIAGAAIASAGFAAIEYSGFTKIIIGLLVSPVLAFVVGYTIYSLFKVFLKNLNLATTNRRFRMIQVGTAALQSYTHGTNDAQKSMGIITMALIASGFQTTDDVQLWVQVSCAIAMAIGTSIGGWKIIKTVGGKIMKIKPVNGVAADLSSVIIIFGATFIHLPVSTTHVISSSILGVGTAHRVKGVKWDTAQRMIITWVITLPISATIAALIFYVLRFIL

SEQ ID NO: 2161 - protein, 414 aa, Archaeoglobus fulgidus DSM 4304
MVREKGFWKRERVDEALYRLLKKIKALETEDVSVYNLQGRVLAEDIVAGFDVPKFNRAAMDGYAVKAEDTFGASVSNPIMLQLAGSVEIGEVPKVVVESGMAVRIMTGAMMPEGTNAVVMLEHTRLNGNFVEVLKSVTPMKNVSRVGEDIAAGEVVFRKGEILQPQDAGVIASLGIESVRVYRKPRVAVITTGNELAEVGEPLEGAKIYNSNNPMICNALLEFGFEAISLGIARDDEEELRNKLQKALEFDAAVITGGTSVGAKDLVPDVVGEFGEIVFHGVSMKPGMPTGAAVVEGKPVFMLPGSPAAALLGFYTFAIPALYRMMNVRIIARKWSRQKGVLQGRIPSEIGVRSNVRVLWEDGKVYPIRISGSGILSSFVRANALLVVPEDKEGYEEGEEVEVTLLRDVTEVFE

SEQ ID NO: 2162 - protein, 434 aa, Streptomyces coelicolor A3(2) [sequence omitted]

SEQ ID NO: 2163 - protein, 320 aa, Listeria monocytogenes EGD-e
MAKVALITTGGTIASKKTASGKLASGELSGEELAALCQLPTEIQIDIYSTFQLPSMHITLPDLISLKQLIESIFMDETYDGIVVTHGTDSLEETAYFLDLAVTDARPIVVTGSQRAPEEPGTDAYVNIRHAIYTACEINLRQAGTVVVFNERIFAARYVKKVHASNIQGFSAFGFGYLGIIDNDQVFLYQKPLEHECFDIRLDLPEVVVIKCYIGADGLFIDAAIDSGVSGIVLEGVGRGQVAPKMMPAIIRALDAGIPVVITTSAEEGNVYTTYDYEGSTFDLYNRGVILGKDYDSKKARMKLMVLLASQEEINQTNFR

SEQ ID NO: 2164 - protein, 323 aa, Zea mays
MRPALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINALVNMISNPVNSTVPIAAEVFKKAGTYDEKKLFGVTTLDVVRAKTFYAGKAGVPVTEVNVPVVGGHAGITILPLFSQATPASNSLSQEDIEALTKRTQDGGTEVVEAKAGKGSATLSMAYAGAVFADACLKGLNGVPDIVECSFVQSTVTELPFFASKVRLGKNGVEEVLGLGELNEFEKKGLENLKGELKSSIDKGIKFAHGN

SEQ ID NO: 2165 - protein, 339 aa, Thermobifida fusca
MTETDSYDVICIGETMGQLSPASAVPLVEQPPLLPRIGGAESNVACGLAGLGHRVAWMSRVGDDPFGAIITRTLARYGVDTSLVEVDQERPTGLYLKDPAPKGTRVYYYRRESAASAIGPRLAERPELRTARLLHLSGITPALSTSCAAFVQRLFVSRPAHGPLLSFDVNYRPALWPADDAAPVLLDLARAADLVFVGRDEAEQLWQASTADQVRALLPDVPLLVVKDADVGATSYTGARRVFVPAPRVDVVEAVGAGDAFAAGFLSGLLDDRTPEECLRLGHIMAAATLLSVADLAPFPPREARERLLALSPAAWAALCIPDPDLFPLDPSDPLFSGA

SEQ ID NO: 2166 - protein, 505 aa, Rhodobacter sphaeroides
MTLPPTRPAETAGTPETGAPINQWKTLDKDLKRIVQLEQAGQFVGRPLLSLGIALVFIVLAGVAASVIVGGTPNALVIVAAAAFGAYMALNIGANDVANNMGPAVGANALTMTGALAIAAVFETAGALIAGGDVVSTISGGIVDPASVAEAGIFVWAMMAALIAAAVWLNVATAIGAPVSTTHSIVGGVMGAGMVAAGLGAVNWPVMGQIAASWVISPVLGGVFAALFLAFIKHRLIDAEDKIAAARFWVPLLIGVMAAAFSAYLVLKGLRKLMEVDLPAALLIGLVFGVLTVFLTRPLVRRQSEGLENRKKSLKKLFGLPLVVSAALLSFAHGANDVANAVGPLAAIVHAVSDGDTAAKVSIPLWVMIIGAGGISFGLVLFGPKLIRMVGSEITKLNPMRAYCVALSAAITVIVASGLGLPVSSTHIAVGGIFGVGFYREWQAERRSRALGLIKGKPLPPEERKRRKLVRRAHFLTIGAAWVVTVPATAALSAAIFLGLRTLGN

SEQ ID NO: 2167 - protein, 488 aa, Vaucheria pseudogeminata
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNATAGTMEEMYERAEYAKKIGTIIVMIDLVVGYTAIQTMAIWARKADMILHLHRAGNSTYARQKNHGINFRVICKWMRMAGVDHIHAGTVVGKLEGDPLMVKGFYNTLLDTKLEINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 2168 - protein, 342 aa, Haemophilus influenzae Rd
MKERIKAICLEKPNNVVVKEVPYPEKSDNDVLIQVESMGICGSDIGAYRGTNPLVTYPRILGHEIVGRVIESGIGMSDGVRVGDRVIVDPYVCCGQCYPCSIGRTNCCESLKVIGVHIDGGMQEVIRHPAHLLTKVPDNLPIHQLPLAEPLTIALHALHRTTLKSGEHIVIIGAGAIGLMAALAAVQYGAIPILVDILEQRLEYAKSLGIEHIVNPHKEDDIKRIKEITSGRMAEVVMEASGANISIKNTLHYASFAGRIALTGWPKTETPLPTNLITFKELNIYGSRTSKGEFEEALDMLATNKINASHIITKCIKFEEIPSFISDLSDHPENYLKINAVF

SEQ ID NO: 2169 - protein, 144 aa, Zea mays
MINAKKIAHLAKKWQRMACIRRRCLTLGAASANGADECCSSVARKGHCAVYTADGARFEVPLACLSTPVFVELLQMSEEEFGFAGGDGRITLPCDAAVMEYALCLLRRGASAELEQAFLSTMAISCHCASHLAPYVGATQQIAV

SEQ ID NO: 2170 - protein, 669 aa, Schizosaccharomyces pombe
MTVLAPLRRLHTRAAFSSYGREIALQKRFLNLNSCSAVRRYGTGFSNNLRIKKLKNAFGVVRANSTKSTSTVTTASPIKYDSSFVGKTGGEIFHDMMLKHNVKHVFGYPGGAILPVFDAIYRSPHFEFILPRHEQAAGHAAQAYSRVTKKPGVVLVTSGPGATNVITPIADALADGTPLVVFSGQVATSAIGSDAFQEADMVGISRSCTKWNVMVKDVADLPRRIDEAFEIATSGRPGPVLVDLPKDVTASVLKEPIPILSSVPSMNRRMKEVLEEGSKNVTAKIDRVANLLKLAKKPVIFCGHGVLANPECPTLLRKFSERLQIPVTTSLLGLGAVDERSDLSLHMLGMHGSGYANMAMQEADLILALGVRFDDRVTGNVSLFAPQARLAAAEERGGIIHFDISPKNIGKVVQPTEAIEGDVYESLKLLDSATKNIKIPSRFDWLSQIQTWKERFPFTFTRSAPGELVKPQEVIQELDKQTSDIKDKVTITTGVGAHQMWAATFYRWTKPSSLVTSGGLGTMGFGLPAAIGASVAAPKDIVIDIDGDASFSMTGMELATVRQFDIPVKILILNNEEQGMVTQWQNLFYEKRYSHTHQKNPNFVKLADAMGIKALRVEKREDLAKKMKEFLSTKGPVLMEVLVAQKEHVYPFVPGGKALHQFILHESLS

SEQ ID NO: 2171 - protein, 520 aa, Pseudomonas fluorescens PfO-1
MRVSLISTTAKENIMRYAHPGTEGAKVSFKSKYGNYIGGEFVAPVKGQYFTNTSPVNGQPIAEFPRSTAEDIEKALDAAHAAADAWGSTSAQARSLILLKIADRIEQNLETLAIIETWDNGKAIRETLNADIPLAADHFRYFAGCLRAQEGSAAEIDGNTVAYHIHEPLGVVGQIIPWNFPILMAAWKLAPALAAGNCVVLKPAEQTPLGISVLLELIGDLLPPGVLNVVQGFGKEAGEALATSKRIAKIAFTGSTPVGSHIMKCAAENIIPSTVELGGKSPNIFFEDIMQAEPSFIEKAAEGLVLAFFNQGEVCTCPSRALVQESIYPQFMEAVMKKVSQIKRGDPLDTDTMVGAQASEQQFDKILSYLEIAKGEGAELLTGGKVEKLEGSLATGYYIQPTLLKGTNKMRVFQEEIFGPVVSITTFKDEAEALAIANDTEFGLGAGLWTRDINRAYRMGRAIKAGRVWTNCYHLYPAHAAFGGYKKSGVGRETHKMMLDHYQQTKNLLVSYDINPLGFF

SEQ ID NO: 2172 - protein, 412 aa, Zea mays
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDSKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKNASYDDVKAAIKAASEGALKGILGYTDEDVVSNDFVGDSRSSIFDAKAGIGLSSSFMKLVSWYDNEWGYSNRVLDLIAHMALVSAAAKL

SEQ ID NO: 2173 - protein, 512 aa, ASPERGILLUS NIDULANS FGSC A4
MSFFKNSRVYMLSAVAYMGSFLFGYDTGVMGSVLALDSFKHDFHMATGSTGFASSKEAEISSNVVALLTAGCFFGAIAGAIANDRYGRKNSLLVLSVIFMIGAAVQTGGRGTIAYIYGGRVIAGFGIGGMSAITPIYVSENCPPNVRGRIAGLFQEFLVIGVTVSYWLCYGVEKNIAPSTKQWRIPIGFQLVPSGLMFIGLWFLKESPRWLMKQGRREEATASLAFTRRADPNSDEVQQELAEIRASIEEELRSTEGVTWREVLLPGNRLRFLNAFLIMFWQQFSGTNSIGYYAPQLFQTIGVASTDTSLFTTGIYGVVKVVSTGLFLLIGIDRFGRKWSLVGGGWAMAVFMFILGAVLVSYPPVNTDTISNASIAMIVMIYLYVISYSASWGPIPWVYISEIFPTRLRAYGVGMGSATQWLFNFVVTKFTPSAISNIGWRTFIMFGVFCFAMGLWVCIFIKETKGKRLEDMDDIFGGKTVEQMQKDIEQADVEEQTEVEKTQTRHEEQVVR

SEQ ID NO: 2174 - protein, 174 aa, Triticum aestivum
MWSFASNAIAGSIKKKVQPSKGSLSNHDCSDDDGSSCASREEGLECPICCESFNIVENVPYVLWCGHTMCKNCILGLQWAVVKFPTLPIQLPLFVSCPWCNLLSFRLVYKGNLKFPRKNYFLLWMVESMNGDRAKFHSSGHEERQSVCPSSGGTSSSQHHRRTPRMRRRPRRQR

SEQ ID NO: 2175 - protein, 183 aa, Shigella flexneri 2a str. 301
MKKLIVSSVLAFITFSAQAAAFQVTSNEIKTGEQLTTSHVFSGFGCEGGNTSPSLTWSGAPEGTKSFAVTVYDPDAPTGSGWWHWTVANIPATVTYLPTDAGRRDGTKLPTGAVQGRNDFGYAGFGGACPPKGDKPHHYQFKVWALKTDKIPVDSNSSGALVGYMLNANKIATAEITPVYEIK

SEQ ID NO: 2176 - protein, 350 aa, Methanosarcina acetivorans C2A
MSVFTINWRNSILKTATCWLQLVERPDGRFTCGRDFLRQYLRNLIKTKRMTFMDFEKLRHGTELIKRGFARMQKGGVIMDVTTPEQARIAEEAGAVAVMALQAVPADIRKAGGVARMADPEIVQQIIETVTIPVMAKARIGHFVEAEILEALGVDMVDESEVLTPADPFYHIDKTQFTVPFVCGARNLGEALRRINEGAAMIRTKGEAGTGDVSQAVKHMKQIQGEIRALAGKTKEELIMVAREIEAPIELVVETAKMQRLPVVNFAAGGVATPADAALMMRLGADGVFVGSGIFKAENPEKMAKAVVEAVNNYDNPVKLAEISKGVGAGMKGISADMIPAQEALQERGW

SEQ ID NO: 2177 - protein, 240 aa, Zea mays
  unsure (1)..(240): unsure at all Xaa locations
PGDSIAAGSFPEWTLYVQVMDPDTXEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPXPTPLPPRPVAGRREKATIRKPNDFKQPGERYRSWDADRQDRFVRRFADSLGHPKVSQELRSIWIDLLAKCDASLGMKIATRLNMKPNM

SEQ ID NO: 2178 - protein, 506 aa, Glycine max
  unsure (1)..(506): unsure at all Xaa locations
MASLSCSANDLAPLFNDTAAANYLCAQFDSISRKLNVTTYAVDNTYLLFSAYLVFAMQLGFAMLCAGSVRAKNTMNIMLTNVLDAAAGGLSYYLFGFAFAFGGPSNGFIGRHFFGLRKFPKDSPPSGDYSFFLYHWAFAIAAAGITSGXSIAERTQFVAYLIYSSFLTGFVYPIVSHWFWSSDGWASATRSHGNVLFGSGVIDFAGSGVVHMVGGIAVLWGALIEGPRIGRFDRSGRSVALRGHSASLVVLGSFLLWFGWYGFNPGSFLTIAKGYGSGGYYGQWSAIGRTAVTTTLAGSTAALTTLFSKWLLAGHWNVIDVCNGLLGGFAAITSGCAVVEPWAAIVCGFVAAWVLIWLNKLAAKVEYDDPLEAAQLHGGCGAWGVFFTGLFAKKVYVEEIYGVGRPFGALMGGGGRLLAAQVIQILVVCGWVTATMAPLFYGLHKMKLLRISRDDETAGMDLTRHGGFAYAYHDDEDGSSRGVGFMLRRIEPAASTTPSPPAAPQV

SEQ ID NO: 2179 - protein, 477 aa, Zea mays
MADEKLAKLREATAGLTQISDKEKSGFLSLVGRYLSGDEEHIEWAKIHTPTDEVVVPYDTLESPPEGTEATKKLLDKLAVLKLNGGLGTTMGCTGPKSVIEVRNGFTFLDLIVIQIESLNKKYGSNVPLLLMNSFNTHDDTLKIVEKYTNSSIEIHTFNQSQYPRVVADEFLPWPSKGKTDKDGWYPPGHGDIFPSLMNSGKLDLLLSQGKEYVFIANSDNLGAIVDMKILNHLIHKQNEYCMEVTPKTLADVKGGTLISYEGRVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNSARTNPSNPSIELGPEFKKVGSFLGRFKSIPSIVELDSLKVSGDVWFGSGIVLKGKVTITAKPGVKLEIPDGAVIGNKDNFGKGKRKQYQMPYNLN

SEQ ID NO: 2180 - protein, 240 aa, Oryza sativa
MHNGTRTTGAGIIDGKKEWWAYKNKSNSILLEVELISTVYFKGQVRWTGTAGTTGDCCSTASSSLAGKGHSAVYTADGARFEVPLVYLGMMVFGELLAMSQEEFGFASDDGRITLTCDALVMEYVMCLISIDASEEVERVFLSFMASSCHCVGGTSHQFYDVGERRAVRDRLPRLAEVGLHAAAGRGAAEEVIVGVDAAVLEREAGGAGLGGDGVLLAVEGRRMMMSQCWKTAVTSPKMS

SEQ ID NO: 2181 - protein, 397 aa, SYNECHOCOCCUS SP. WH 8102
MSETPMKAMILAAGKGTRVQPITHVIPKPMIPILQKPVMEFLLELLKEHGFNEVMVNVSHLAEEIENYFRDGQRFGVEIAYSFEGRIEDGELIGSALGSAGGLKKIQDFQNFFDDTFVVLCGDALIDLDLTEAVRRHREKGALASLVTKRVPKEQVSSYGVVVTDAEDRISHFQEKPKVEEALSDTINTGIYIFEPGIFDHIPSGVSFDIGSDLFPKLAELGAPFYAIPMDFEWVDIGKVPDYWQAIRSVLLGDVRQVGIPGKEIQPGVYTGLNVAANWDKINVSGPVYVGGMTKIEDGATIVGPAMIGPSCHICEGAVIDNSIIFDYSRIGAGVQLVEKLVFGRYCVGKDGDHFDLQEAALDWLITDARRQDLVEPSPQQKAMAELLGTELTQAAS

SEQ ID NO: 2182 - protein, 690 aa, Ruminococcus flavefaciens
MLVEKYLDEALSDLERAEDITDRLSTEEKAEQQKYDAPAEERLGKDAYNWWSEGLHGVARAGTATMFPQTIGMAAMFDDEAVHRAGETTSREARAKYNEYSAHDDRDIYKGLTLWSPNVNIFRDPRWGRGQETYGEDPYLTSCLGVAYAKGLQGDGKVLRTAACAKHFAVHSGPEATRHEFDAKANMKDMTETYIAAFEALVKDAKVESVMGAYNRVNGEPACASDFVMNKLEEWGFDGHFVSDCWAIRDFHTNHGVTKTAPESAALALKKGCDLNCGNTYLHLLAAFNEGLINEEDLRRSCIKLMRTRVRLGMFDKSTEYDGLDYDIVACDEHKEFSLRCSERSMVLLKNNGILPLDGSKYKTIGVIGPNADSVPALEGNYNGKADEYITFLSGIREAHDGRVLYTEGSHLYKDRCMGLALPDDRLSEAEIITRTLRCSGSLCWLDATIEGEEGDTGNEFSSGDKNDLRLPESQRKLVKTVMAKGKPVIIVTAAGSAINVEADCDALIQAWYPGQLGGRALANILFGKVSPSGKLPVTFYEDASKLPDFSDYSMKNRTYRYSEGNILFPFGYGLTYSETECSELSFENGVATVKVTNTGSRFTEDVVQIYIKGYSENAVPNHSLCGFKRVALDAGESRIVQITLPERAFMAVNEKGEWIKEGSEFTLYAGTSQPDELSKKLTGKECTTL

SEQ ID NO: 2183 - protein, 493 aa, Zea mays
MDPYKHRPSSAFNAPYWTTNSGAPVWNNDSSLTVGARGPILLEDYHLVEKLANFDRERIPERVVHARGASAKGFFEVTHDITHLTCADFLRAPGVQTPVIVRFSTVIHERGSPETLRDPRGFAVKFYTREGNWDLVGNNFPVFFIRDGIKFPDMVHALKPNPRTHIQDNWRILDFFSHHPESLHMFSFLFDDVGIPADYRHMDGSGVHTYTLVSRAGTVTYVKFHWRPTCGVRSLMDDEAVAVGGANHSHATKDLTDAIAAGNFPEWTLYIQTMDPEMEDRLDDLDPLDVTKTWPEDAFPLQPVGRLVLNRNIDNFFAENEQLAFCPGLIVPGIYYSDDKLLQTRIFSYSDTQRHRLGPNYLLLPANAPKCAHHNNHYDGSMNFMHRTEEVDYFPSRYDAVRNAPRYPIPTAHIAGRREKTVISKENNFKQPGERYRAMDPARQERFITRWVDALSDPRLTHEIRTIWLSNWSQADRSLGQKLASRLSAKPSM

SEQ ID NO: 2184 - protein, 297 aa, Xanthomonas axonopodis pv. citri str. 306
MSQRIRKAVFPVAGLGTRFLPATKTVPKEMLPIIDKPLIQYAVDEAIQAGCDTLIFVTNRYKHSIADYFDKAYELEQKLERAGKLEQLELVRHALPDGVRAIFVTQAEALGLGHAVLCAKAVVGNEPFAVLLPDDLMWNRGDAALTQMANVAEASGGSVIAVEDVPHDKTASYGIVSTDAFDGRKGRINAIVEKPKPEVAPSNLAVVGRYVLSPKIFDLLEATGAGAGGEIQLTDAIAELLKEEQVDAFRFEGRRFDCGAHIGLIEATVHFALEHEKHGGPAKEILREALAQADVRG

SEQ ID NO: 2185 - protein, 244 aa, Deinococcus radiodurans
  unsure (1)..(244): unsure at all Xaa locations
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDAXVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 2186 - protein, 525 aa, Phaseolus vulgaris
MASSSVTLKANAHLANSEKGHLFRQESSFLGERVKVGPNNSAFVTNQLARCSRSQKRVNHGVASAILTSNDAKESLSLQVPSFMRRRVDPKNVVSIILGGGPGKQLFPLTQRAATPAVPVGGCYRLIDIPMSNCINSGINKIFVLTQFNSASLNRHIARTYFGNGINFGDGTVEVLAATQTPGEAGKKWFQGTADAVRQFTWVFEDAKNTHVENVLILAGDHLYRMDYMDLIQSHVDRNADITVSCAAVGNSRASDYGLVKVDDRGRIIQFSEKPKGDDMTAMQADTSLLGLSPPDALKSPYIASMGVYVFKTDVLLNLLKCRHPTSNDFGSEIIPAAVRDHNVQSYFFRDYWEDIGTIKSFYDANLALTEESHEFEFYDPKTPIYTSPGFLPPTKIDKSRIVDAIISHGCFLRECTVQHSIVGERSRLDYGVEIQDTVMMGADYYQTESEIASLLAEGKVPIGIGRNTKIRNCIIDKNAKIGKDVIIKNKDDVQEADRPEDGFYIRSGITIIAEKATIEDGTVI

SEQ ID NO: 2187 - protein, 394 aa, Neurospora crassa
MASNRPAAFNTLRMGEVIREKVQDGVTGETREIQYTQCKIVGNGSFGVVFQTKLSPSNEDAAIKRVLQDKRFKNRELQIMRIVRHPNIVQLKAFYYSNGERKDEVYLNLVQEFVPETVYRASRFFNKMKTTMPILEVKLYTYQLFRALAYIHSQGICHRDIKPQNLLLDPTTGVLKLCDFGSAKILVENEPNVSYICSRYYRAPELIFGATNYTTKIDVWSTGCVMAELMLGQPLFPGESGIDQLVEIIKVLGTPTREQIRTMNPNYMEHKFPQIKPHPFNKVFKKADADAIDLIARLLEYTPTERLAAIDAMVHPFFDELRDPSTRLPDSRHNSGTVRDLPPLFDFTRHELSIAPQLNHKLVPSHMRPVLASKGLDIDNFTPMNKSEMMAKLD

SEQ ID NO: 2188 - protein, 264 aa, Zea mays
PGHAQQAAPACSVQGCDADLSQCRDYHRRHKVCVAHSKAPFVTVAGQQQRFCQQCSRFHLLEEFDEVKRSCRKRLDGHNRRRRKPQPDPLNPAAGLFGNHHHGGVTRFTSYPHRFTKSIAKPEWAVVKTETDAFQDQYYPAVHLNGAGAGALFHDKDRKHFPFLTNHDNGCQPLFTVTTTASSESSSKHSNGNYALSLLSDNPTPAQAQTAMIPTAQPLVATASQYGRLPGGDVSLTGMSYMRVKKQTAGFQSDNVLTRSCRWR

SEQ ID NO: 2189 - protein, 130 aa, Zea mays
MADPELEAIRKRRMEELMAKHGGGGANQQNASQQKAQEDAKQEAEERRQMMLAQILSSEARERISRIALVKPDKARGVEDVLLRAAQTGGISEKVSEERLISLLEQINTHTSKQTKVTIQRRRSVLDDDD

SEQ ID NO: 2190 - protein, 401 aa, Triticum aestivum
MVLESTMICIDNSEWMRNGDYSPSRFQAQADAVNLICGAKTQSNPENTVGVMTMAGKGVRVLVTPTSDLGKILACMHGLEVGAEANLAAAIQVAQLALKHRQNKRQQQRIIVFIGSPVTYDKKVLETIGKKLKKNNVALDVVDFGETDDEKPEKLEALIAAVNSSDSSHIVHVPPGDHALSDVLISTPIFTGEEGGSGFAASAAAAAATGATGYDFGVDPNVDPELALALRLSMEEERARQEAIAKKAAEDNKDQASSSTDAIMAEAELTLNAPADVDADLLKDDDDAQLLQQALAMSMDEGASGAAAVADAAMAEAAADDQDLALALQMSVQDAEAAGQSDMSKVFEDRSFVTSILNSLPGVDPNDPSVKDLLASLHGQGEQEEKKDTEDKPDKPEDGKN

SEQ ID NO: 2191 - protein, 145 aa, Zea mays
  unsure (1)..(145): unsure at all Xaa locations
PPKFLSPSVPLVSVTAGMHGSYIGVKGEPIFLPPPQWVAVDPCGAGEAYAFGFLFGVPRGVFALKGIGLLGSRVTSVVVGQQGPRFGVQDPDKLVGLFXPPLDSLGFCSDVLINPSANVWFDCICFFPQPLKFFWSCSYLPNLGL

SEQ ID NO: 2192 - protein, 427 aa, Saccharomyces cerevisiae
MHHNSQSLSSGHIRSPEDENVAPIGNLKHRTGSLSHISSAHPRVALSRVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 2193 - protein, 340 aa, Capsicum annuum
MGHHCCSKQKVKRGLWSPEEDEKLIKHITTHGHSCWSSVPKLAGLQRCGKSCRLRWINYLRPDLKRGCFSEQEERIIIDVHRILGNKWAQIAKHLPGRTDNEVKNFWNSCIKKKLISQGFDPNTHNLLSRAAAAATPPHRNNKKKTNNNHTTSSVFTIETSLSPSSTKELVSMDMIKASLAALSPFPHTNSSTTVLTMPQFQTSWSHLYESACNYYNHVPIKTNIVYQNHSTSTGTFGIINENCMWGVTGFEPHHEFGPSNNIGHEEMQQGAQVQLQEENCLEEVYKVNDLHEFNKHGRIAENVTFDDSSDFDFEFVDSELIPCGIYTNVNSIDQLAWDC

SEQ ID NO: 2194 - protein, 427 aa, Batrachospermum antipodites
IEASAAVAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTVVERERMDKFGRPFLGATVKPKLGLSGKNYGRVVYEGLRGGLDFLKDDENINSQPFMRWRERYLFSMEGVNRAQAATGEIKGHYLNVTAGTMEDMYERAYFAKELGSIICMIDLVIGYTAIQTMAVWARKTDMILHLHRAGNSTYSRQKSHGMNFRVICKWMRMAGVDHIHAGTVVGKLEGDPIMIRGFYNTLLLSHLDINLPQGIFFEQNWASLRKVTPVASGGIHCGQMHQLLDYLGDDVVLQFGGGTIGHPDGIQAGATANRVALESMVMARNEGRDYVNEGPQILRDAAKTCGPLQTALDLWKDISFNYTSTDTADFV

SEQ ID NO: 2195 - protein, 428 aa, Arabidopsis thaliana
MATAFAPTKLTATVPLHGSHENRLLLPIRLAPPSSFLGSTRSLSLRRLNHSNATRRSPVVSVQEVVKEKQSTNNTSLLITKEEGLELYEDMILGRSFEDMCAQMYYRGKMFGFVHLYNGQEAVSTGFIKLLTKSDSVVSTYRDHVHALSKGVSARAVMSELFGKVTGCCRGQGGSMHMFSKEHNMLGGFAFIGEGIPVATGAAFSSKYRREVLKQDCDDVTVAFFGDGTCNNGQFFECLNMAALYKLPIIFVVENNLWAIGMSHLRATSDPEIWKKGPAFGMPGVHVDGMDVLKVREVAKEAVTRARRGEGPTLVECETYRFRGHSLADPDELRDAAEKAKYAARDPIAALKKYLIENKLAKEAELKSIEKKIDELVEEAVEFADASPQPGRSQLLENVFADPKGFGIGPDGRYRCEDPKFTEGTAQV

SEQ ID NO: 2196 - protein, 403 aa, Zea mays
MASSMLSATTVPLQQGGGLSEFSGLRSSASLPMRRNATSDDFMSAVSFRTHAVGTSGGSRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 2197 - protein, 309 aa, Vibrio parahaemolyticus RIMD 2210633
MNPISRVAIIGECMVELKKHDGVLQQGFGGDTLNTAVYLSRLTKQHGVETSYVTGLGHDPFSREMLTAWREEGINTDMVYLSEDKLPGIYAIETAEDGERSFFYWRNDAAAKYWLRERALLSLVKDLCQHQMIYLSGISLAIISDDCRQMLIELLTMCRKEGVKIAFDNNFRPKLWPNIEQARDFYSKILSVTDMAFLTFDDEVMLWGDKHEDEAISRTKNFGVKEIIVKRGADDCFVVTQDQQHTVAALKVDAVVDTTAAGDSFSAGYLAKRILGGDVAESALAGHKVAGTVIQHRGAIIPSQAMPTI

SEQ ID NO: 2198 - protein, 194 aa, Glycine max
MQTSLLQIVGTPVISATYDQLQKSVNRYLPGPATQCQYSTTTSKQMRLRTNISETVKRKISLGARILRVGGVEKVFKQFFSMEEGERLLKVSQCYLSTTSGPLAGFLFISTDKVAFCSERSMKVFTRKGHMLRIRYKVAIPLKKVKCVNQSANAQKPTQKYIEIVTEDNFDFWFMGVLKYQKTFKYLEQAVSQA

SEQ ID NO: 2199 - protein, 475 aa, Grateloupia ramossissima
ERYESGVIPYAKMGYWDPDYVIKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAMVMARNEGRDYVAEGPQILQDAAKTCGPLQTALDLWKDITFNYTSTDTADFVETPTANV

SEQ ID NO: 2200 - protein, 159 aa, Glycine max
CKIFKILLEYCQLQFIGKKAAYALSQGLGVIACIGELLEEREAGKTFDVCFQQLKAYADAVASWDNIVIAYEPVWAIGTGKVATPQQAQEVHVAVRDWLKKNVSDEVASKTRIIYGGSVNGGNSAELAKQEDIDGFLVGGASLKVHGFFKICLTKVSKA

SEQ ID NO: 2201 - protein, 463 aa, Bacillus anthracis str. A2012
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNRQKLSYKMPLYPLSSYFSLAFLVLVLGIMAYSEDTRIALIVGPIWLIGLAIVYYMKGFHKIDETPNSKIS

SEQ ID NO: 2202 - protein, 68 aa, Triticum aestivum
TTEGRVADWIYAISMGLATGIFVYVSINHLLAKGYMLQRPVAADTPVGRWLSVVLGVGVIAVVMIWNA

SEQ ID NO: 2203 - protein, 142 aa, Staphylococcus epidermidis ATCC 12228
MIKKNKEELNDMEYLVTQENGTEPPFQNEYWNHFEKGIYVDKLSGKPLFTSEDKFESNCGWPSFSKALNDDEIVELVDKSFGMIRTEVRSEKANSHLGHVFNDGPKEKGGLRYCINSAAIQFIPYDKLEELGYGDLIKHFKK

SEQ ID NO: 2204 - protein, 148 aa, Zea mays
MSVPMYNKQNSLGTPPPHKSNPFSDSEGPSRAQSVPVRRTNQSVQELEDYAITKARETTHKVNDCVRAAEAIREDATQTMLTLHRQGEQIMRSHQVAADIEQDLTVSEKLLGSLGGLFSKSWRPKRNHQIKGPVSGNNYSAAVWLESL

SEQ ID NO: 2205 - protein, 355 aa, Buchnera aphidicola str. Sg (Schizaphis graminum)
MTANINKLARKNIQKLNPYQSARRIGGKGDTWLNANESPISVPFKGKVKVFNRYPECQPNNLLSSYANYVGLLNNQILVTRGADEGIELLIKAFCEPGKDAIIYCPPTYDMYAINAKIANVEIKEIPTFKNTWKIDLLNIRSNLNKVKLIYICNPNNPTGNIVSQEDLKSLLKVTLGQSLVIIDEAYIEFSPKNSMVNYLKTFPNLIILRTLSKAFALAGIRCGFTLAQKEVIDILHKVISPYPISTLIADIAVQSLEKKAIDDMKNRVLKLNMNRIWLIDELKKISCVKKVFDSHANYILVEFYMFKKIFQSLWQKGIILRNQNHKNNLKNCLRISIGSKSECMRLVQELKNFI

SEQ ID NO: 2206 - protein, 355 aa, Nitellopsis obtusa
LELRDGGKEFMGKGVLKAVSNVNDIIAPAVIGMDPADQTKIDELMVQQLDGTQYEWGWCKQKLGANAILAVSLAVCKAGAGVLNVPLYQHIANLAHNPNLILPVPSFNIINGGSHAGNKLAMQEFMILPTGASSFKEAMKMGTEVYHNLKSIIKKKYGQDATNVGDEGGFAPNIQDNKEGLELIKEAIAKAGYTGKVTVGMDVAASEFYTEASKTYDLNFKTDNNDGSGKISGQQIIELYQSFCEDYPMVSIEDPFDQDDWEHYAKFTALIGEKVQIVGDDLLVTNPKRVAKAIAEKSCNALLLKVNQIGSVTESIEAVRMAKKAGWGVMTSHRSGETEDSFIADLAVGLATGQI

SEQ ID NO: 2207 - protein, 463 aa, GIBBERELLA ZEAE PH-1
MNVNDWYEFFSLITRERLFFYSGLARRKSALSLIWLSVMSAAVTTFQWFFWGFSLTFSHTAGPFIGDLANFGFRDVLARPSVGSAHLPDMMFAVYQGMFSALTVALATGAVAERGRMLPCIIFIFVWATIVYDPIACWTWNPNGWSNKMGGLDFAGGTPVHIASGSAALAYSMMLGKRSGHGTHELNYRPHNATHIVTGTVFLWVGWFGFNAGSALSANLRGVMAAVVTNLAACVGGITWCLLDYRLERKFSTVGFCSGVVAGLVCITPGSGYVPPWAAVIFGVLGAAGSNYATKVKFLLGIDDALDIFAVHGVGGLIGNICTAFFASPTIAALDGYSRIKGGWVEHHWAQMGYQLADSICGGLYSFTVTCLILFLMNLIPGLRLRVDGEAELQGIDDAEIGEFAYDYVELTREVVSDMDNESGSRYSADPTAFQHYEKNHIPMIDARMFGGQPAHAPVAFPQ

SEQ ID NO: 2208 - protein, 1166 aa, Capsella rubella
MKQKWLFVLILCFFTALGIHGKRLINSDFDETALLMAFKQFSVKSDPNNVLGNWIYESGRGSCSWRGVSCSDDGRIVGLDLRNGGVTGTLNLANLTALPNLQNLYLQGNYFSSSSGGDSSSGSYCYLQVLDLSSNLISDYSLVDYVFSKCSNLVSVNFSNNKLVGKLGFAPSSLKSLTTVDFSYNILSEKIPESFISEFPASLKYLDLTHNNFSGDFSDLSFGMCGNLSFFSLSQNNISGVKFPISLPNCRFLETLNISRNNLAGKIPGGEYWGSFQNLKQLSLAHNRFSGEIPPELSLLCKTLETLDLSGNALSGELPSQFTACVWLQNLNIGNNYLSGDFLSTVVSKITRITYLYVAFNNISGSVPISLTNCTNLRVLDLSSNGFTGNVPSGLCSQQSSPVLEKLLIANNYLSGTVPVELGKCKSLKTIDLSFNELTGPIPKDVWMLPNLSDLVMWANNLTGSIPEGVCVKGGKLETIILNNNLLTGSIPQSISRCTNMIWISLSSNRLTGKIPTGIGNLSKLAILQLGNNSLSGNVPRQLGNCKSLIWLDLNSNNLTGDLPGELASQAGLVMPGSVSGKQFAFVRNEGGTDCRGAGGLVEFEGIRAERLERFPMVHSCPATRIYSGMTMYTFSANGSMIYFDISYNAVSGLIPPGYGNMGYLQVLNLGHNRITGNIPDSLGGLKAIGVLDLSHNDLQGYLPGSLGSLSFLSDLDVSNNNLTGPIPFGGQLTTFPVSRYANNSGLCGVPLRPCGSAPRRPITSSVHAKKQTLATAVIAGIAFSFMCLVMLFMALYRVRKVQKKELKREKYIESLPTSGSCSWKLSSVPEPLSINVATFEKPLRKLTFAHLLEATNGFSAETMVGSGGFGEVYKAQLRDGSVVAIKKLIRITGQGDREFMAEMETIGKIKHRNLVPLLGYCKVGEERLLVYEYMKWGSLETVLHEKSSKKGGIFLNWTARKKIAIGAARGLAFLHHSCIPHIIHRDMKSSNVLLDEDFEARVSDFGMARLVSALDTHLSVSTLAGTPGYVPPEYYQSFRCTAKGDVYSYGVILLELLSGKKPIDPGEFGEDNNLVGWAKQLYREKSGTEILDPELVTEKSGDAELFHYLKIASQCLDDRPFKRPTMIQVMAMFKELKADTEEDESLDEFSLKETPLVEESRDKEP

SEQ ID NO: 2209 - protein, 187 aa, Triticum aestivum
  unsure (1)..(187): unsure at all Xaa locations
MAPTVMASSATSVAPFQGLKSTAGLPVSRRSNGASLGSVSNGGRIRCMQVWPIXEGIKNSKTLSYLPPLNTXGLLKQVDYLDPAPXVPCLQFNKVXXLPVEHNASPGVLTMAGYWTMWXLPNVXGCTGRTQVINEVEXVKKXIPDPYVRIIXSTNAQGACVNLPLNQRARSKAKSSQHIKCNFARAL

SEQ ID NO: 2210 - protein, 261 aa, Triticum aestivum
CIFLSRGGDLVTAFAELMGRQVGCSRGKGGSMHFYKKDANFYGGHGIVGAQVPLGCGLAFAQKYRKGDSVSFSLYGDGAANQGQLFEALNISALWKLPAILVCENNHYGMGTAEWRAAKSPSYYKRGDYVPGLKVDGMDVLAVKQACKFAKEHAIANGPIVLEMDTYRYHGHSMSDPGSTYRTRDEISGVRQERDPIERVRKLLLAHDLATPAELIDMQKEIGKEVHAAIAKAKESPMPDPSELFTNVYPNAFLLQPLPRP

SEQ ID NO: 2211 - protein, 673 aa, Eremothecium gossypii
MAENTQLRRKRTRAFDLNGSRAVGAQNGRMGAAGVEMGDATGTARNGLYIEEEPDPLVNDMLQRQMFLLGSNSGNSGDSGSLVRDADDADSSLAFMGDVGDMVGELALGGTHAGSNYTARRFKKQRTVSLPQLPHAKLFYRLDARGPAASKAVPRRSQNDDELLHISGSSSRTLDGNRMVTLPVIRSESPSSLLPPTQLEQQTALNGSAITKATSLLTGQQKLPKLITRRQRSIRRDNFNTDKEGHYVFHGNDIFANGRFMTEELLGQGTFGKVVKCVDNAEPTKKHVAVKIIRALDRYRQAAKTELRVLQTIRDNDPLGQFQCLLLRDCFDYRNHICLVTDLFGKSIYDFMCNNGNPRFPGSHVQAISRQLIRSVCFLHDLGIIHTDLKPENILICDESFVETPLPDTVLATLSTRRKQVSGGKHKVLTNPEVKLIDFGSAVFCEEYHPPVISTRHYRAPEIVLGLGWSFPCDLWSIGCVLVELVTGESLYPIHENLEHMAMMQRVNGQSFPRKMISKMFYKVEHKLGNLPTDLMTTVVRHFDKTSMALQWPERNYKGEIVTKEKSMKRVMATCDRLDKHISTKLQRDYGEWLIIDWDYTPEQNWSMIESKFYNRTMRIDRETFLFWYWFVDLCRKMFEFDPTKRITAKDAMDHEWFTYGILDEGISSFGQT

SEQ ID NO: 2212 - protein, 486 aa, Nostoc punctiforme
MNKHIRPWQRLLALAIGSMVFAVFAPTIVQATDPPTVQSLSETTTKLQISIDTIWVLITGFLVFFMQTGFAMLEAGLNRQRGVVNALLENFINAAVTILVWWGIGFGIAFGTSAGGLVGIDTFFLSQLPGADGSYILAAPGSTAAINTYTLFFFQFAFAATATTIATGSMAGRTDFIGDLIYSAIMGAIAYPIVVHWVWNSDGWLSKLSYHDFAGSSVVHTVGGWTALVGAYLLGSRPGRPAWGTLPPAHNLGLATLGTMILWFGWYGFNPGSTLSTGNTGLIGLVTVNTTLSAGAGALSAIIFQYTRKGKWDLVYSLNGSLAGLVAITAPCAYVAPWASVLIGLTSGILVTVGMDLIESVHIDDPVGAFAVHGINGMMGTLSVGFLGQAELTLNQKAGLFLGGGFELLGIQLLGVVAIAVFTVAFSFLMFGGLKAVGHLRVNSEADRIGIDAYEHGASVWSDVYAIEKKEINCAETTEIEALDSE

SEQ ID NO: 2213 - protein, 530 aa, Blumeria graminis f. sp. tritici
MGIPESFMSPYLQPLLQFGFSIALASGIISLLLLLTFLNVLKQLLFKNPNEPPIVFHWIPIIGSTISYGMNPYKFFHETQAKYGNIFTFILLGKKTTVYLGRQGNNFILNGKLRDVNAEEVYSVLTTPVFGTDVVFDCPNSKLMEQKKFMKAALTTEAFRSYVPIIQNEVESFINKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 2214 - protein, 283 aa, Sphagnum cuspidatum
  unsure (1)..(283): unsure at all Xaa locations
GVKQASHLLKYDSMLGTFNADVKVDGNDGISVDGKIIKVVSDRNPLNLPWGELGIDLVIEGTGVFVDKEGAGKHLQAGAKKVLITAPGKGAIPTYVVGVNEEQYSHRDEIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFRDASAGALKGILAVCDEPLVSVDFRCSDVSSTVDSSLTMVMGDDMVKVVAWYDXEWGY

SEQ ID NO: 2215 - protein, 249 aa, Phytophthora infestans
MDRDSLVFLAKLAEQAERYDEMVDHMKAVANNHNVELTVEERNLLSVAYKNVIGSRRASWRVISSIENKGDSERSEHIKAYRQKIEGELVDICNDILTIIENNLIPNSSSEEGKVFYYKMKGDYHRYLAEFQVDDERKESSDKALESYKQASTIAMAELPPTHPIRLGLALNFSVFYYEILNSPDRACNLAKQAFDDAIAELDTLSEESYKDSTLIMQLLRDNLTLWTSDQEPDNADANQGDMNVQDVE

SEQ ID NO: 2216 - protein, 552 aa, Zea mays
  unsure (1)..(552): unsure at all Xaa locations
GGAAMAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMFEYANMKTRGAFIAAVFAMQGFGIMAGGLVAIVVSAWFKASFPAPAYAVDPAASTPPQADFVWRIILMLGAMPAALTYYWRTKMPETARYTALVAKNAKQAAADMSKVLQVEISAGAAEEGAAAAAATATEPAPASASASFGLFSGEFLRRHGLHLLGTSSTWFLLDIAFYSQNLFQKDIFSAVGWIXPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIVGSFGFLYLAQNRDPAKTDHGYPAGIGVRNSLFLLAGCNLLGLAFTFLVPESKGKSLEEMSGENDEAAAAAATPNYNNRTVPV

SEQ ID NO: 2217 - protein, 265 aa, Arabidopsis thaliana
MADGSTSSSESTTACAGSGTRREIMLFGVRVVLDPMRKCVSLNNLSDYEQTAETPKIDGEDRDEQDMNKTPAGYASADEALPMSSSNGKIERKRGVPWTEEEHKLFLLGLQRVGKGDWKGISRNFVKTRTSTQVASHAQKYFLRRSNLNRRRRRSSLFDMTTDTVIPMEEDHQVLIQENTSQSSSPVPEINNFSIHPVMQVFPEFPVPTGNQSYGQLTSSNLINLVPLTFQSSPAPLSLNLSLASSNLNEPSPSMHPAFNTIGVA

SEQ ID NO: 2218 - protein, 221 aa, Glycine max
VVYFRRALKLNKNFLSAWTLMGHEFVEMKNTPAAVDAYRRAVDIDPRDYRAWYGLGQAYEMMGMPFYALHYFKKSVFLQPNDSRLWIAMAQCYETDQLRMLDEAIKCYRRAANCNDREAIALHNLAKLHSELGRPEEAAFYYKKDLERMESEEREGPKMVEALLYLAKYYRAQKKFEDAEVYCTRLLDYTGPERETAKSILRGMRSTQSNFPSMDVEHFPP

SEQ ID NO: 2219 - protein, 488 aa, Asperococcus fistulosus
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLQINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 2220 - protein, 811 aa, Oryza sativa
MPPPSHFPSIAVTPVWDPHVSSILSLLPSPSLSGKQQQHVVDEQQQQVAGNSTDRAPTPFTVVCTKDSCSAALCPTPKIKSHHRQEIQVQSLICFDDLQSRGCSLLIVRSLALLFELAHDDDSHHADDNHDDDEGGAARKQQLLRAGEPAADGLHHGPALERHRSGGSRHKLRRDGGGDGLAAIAGLGIPWRRSWPSPPSLAGCCCRRHRRRAKSTGHGQVGYHSCAYIYRGISRAIAVPRELDTNTGGLVFFPELCEQSRSAMARQEQQQHLQVLSALDAAKTQWYHFTAIVVAGMGFFTDAYDLFCISLVTKLLGRIYYTDLAKENPGSLPPNVAAAVNGVAFCGTLAGQLFFGWLGDKLGRKSVYGMTLLMMVICSIASGLSFSHTPTSVMATLCFFRFWLGFGIGGDYPLSATIMSEYANKKTRGAFIAAVFAMQGFGILAGGIVTLIISSAFRAGFPAPAYQDDRAGSTVRQADYVWRIILMLGAMPALLTYYWRMKMPETARYTALVAKNAKQAAADMSKVLQVEIQEEQDKLEQMVTRNSSSFGLFSRQFARRHGLHLVGTATTWFLLDIAFYSQNLFQKDIFTSINWIPKAKTMSALEEVFRIARAQTLIALCGTVPGYWFTVFLIDIVGRFAIQLLGFFMMTVFMLGLAVPYHHWTTKGNHIGFVVMYAFTFFFANFGPNSTTFIVPAEIFPARLRSTCHGISAAAGKAGAIIGSFGFLYAAQDPHKPDAGYKPGIGVRNSLFVLAGCNLLGFICTFLVPESKGKSLEEMSGEAEDDDDEVAAAGGGAAVFLDKFVEISISD

SEQ ID NO: 2221 - protein, 367 aa, Zea mays
MFEQAVADFCWHAREVVSSGMGLWGWPWGRRGPSGFGSASTAEEVTAGVDASNITAIVTGATNGIGKETARVLALRGAKVIIPARTLESGLKLKESLADEVPSSKVHVMEMDLSCLSSVRDFARSFNSSHKHLNLLINNAGIMACPYQLSKDGIELQFATNHVGHFLLTSLLLDKMKSTAAETGVQGRIINVSSVAHKRSDGTCFELNKLNDKARYKPFIAYAHSKLANILHTNELSRRFQEEGCNLTANSLHPGVIITNIIRYVAGNSALISALSPVANLVLKSVPRGAATTCYLALHPNVKGVSGKYFADCNEATPTAVARDSELAKRLWSFSEELVKIYADMSQTTQASEEEETTVTKDVFQDK

SEQ ID NO: 2222 - protein, 125 aa, Triticum aestivum
  unsure (1)..(125): unsure at all Xaa locations
MGGGKDKHDESDKGLFSNMMHGVAGGHGYPPHQGYPPQXGYPPPPGAYPPPPGAYPPPPGAYPPPPGGIPPQHGYLSLVVPPLVVPPNGVPPAVPGYLAQGAWIPWRNDNLVRRSQWKNSAWEMV

SEQ ID NO: 2223 - protein, 487 aa, Oryza sativa (japonica cultivar-group)
MAGNQQLRVLHALDIARTQLYHFIAIVIAGMGFFTDAYDLFSISLVADLLGHVYYHGELPRNIHAAVTGIALCGTVPGQLVFGWLGDKMGRKRVYGITLLLNGCLLSRLRTLLHIGGDYPLSATIMSEYANKRTRGAFIAAVFAMQGFGNLAAGIIGMIVSAAFKHSSASKIDYAWRIILMFGAIPAALTYHWRMKMPETARYTALISKNAKKAAKDMSAVLNVNITPDDEVINELARQDEYGLFSFEFLHRHGLHLLGTTVCWFVLDVTFYSLNIFMKNIFTEVGLLPRLDSEYHHTLQRMITMTAVHTFISLCGALPGYFFTVAFVDRIGRVKIQLIGFTMMTVFMLCLAIPYDQWLRHKNKYGFAVMYGLTFFFANFGPNTTTFIIPAEIFPARLRSTCHGISGAVGKIGAIVGVFGFLYTEYHIRIFLFVLIGCNLVGFIFTLLLPESKGKSLEDLTGEIEEFQEEDEGSEVALSRPIHTVPL

SEQ ID NO: 2224 - protein, 594 aa, Neurospora crassa
MAIFAMGWQKPDNVAGSSAPAIMVGLFVATGGLLLGYDTGTINGILAMKSFKDHFSTGYIDGNGQPGIYPKESALIVAMLSAGTAIGALLAAPLGDHYGRRRSLIGAIGIFVIGAILQVCAYNIDLLVAGRTVAGVGIGIVSVLVPLYQSEMAPKWIRGTLVCTYQLSITMGLLAAAVVNILTYKLKTAAAYRVPIGLQLTWACVLALGLTVLPETPRYLIKRGDKNAAALSLSRLRRLDITHPALVEELAEIEANHQYEMALGPDSYKDILFGEPHLGRRTFTGCCLQMLQQLTGVNFIMYYGTTFFNNAGVGNPLKISLIMQVINTASTIPGLFVVESWGRRRLLMVGAIGMAICQLLIAAFATASGSNNLSAHNKVLITFVAIYIFFFAASWGPVVWVVTSEIYPLKVRAKSMSITTASNWFLNFGIAYGTPYMQTNSAASDESSIDLGSKVFFVWGAFCIVAVGFVWCMVYETSKISLEQIDEMYERVDHAWHSRRFEPSWSFQEMRDLGFSDGGIPPTQQLQQQPQQPQQQQQQHHQQQQHQLQVDLQQSQSRTSNSSTSQTDTGGSNNTGASQDDKLVASLGNIDLSY

SEQ ID NO: 2225 - protein, 499 aa, Escherichia coli K12
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 2226 - protein, 665 aa, Camelina microcarpa
MAAATTTSSSSIPFSTKPSSSKSPLPISRFTLPFSLNPNKSSSRRRGIKSTSLSISAVLNTTTNVSTTTPPSKPTKPEKKKFVSRFAPDQPRKGADILVEALERQGVETVFAYPGGASMEIHQALTRSSSIRNVLPRHEQGGVFAAEGYARSTGKPGICIATSGPGATNLVSGLADALLDSVPLVAITGQVPRRMIGTDAFQETPIVEVTRSITKHNYLVMDVEDIPRIVEEAFFLATSGRPGPVLVDVPKDIQQQLAIPNWEQSMRLPGYMSRMPKPPEDSHLEQIVRLISESKKPVLYVGGGCLNSSEELGRFVELTGIPVASTLMGLGAYPCDDELSLHMLGMHGTVYANYSVEHSDLLLAFGVRFDDRVTGKLEAFASRAKIVHIDIDSAEIGKNKTPHVSVCGDVKLALQGMNKVLENRGEELKLDFGVWRSELNEQKQKFPLSFKTFGEAIPPQYAIQVLDELTDGKAIISTGVGQHQMWAAQFYKYKKPRQWLSSAGLGAMGFGLPAAIGASVANPDAVVVDIDGDGSFIMNVQELATIRVENLPVKILILNNQHLGMVMQWEDRFYKANRAHTYLGNPATEDEIFPNMLQFASACGIPSARVTKKAELREAIQKMLDTPGPYLLDVICPHQEHVLPMIPSGGTFNDVITEGDGRTKY

SEQ ID NO: 2227 - protein, 357 aa, SYNECHOCOCCUS SP. WH 8102
MALVPLRLLLDHAAENGYGIPAFNVNNLEQVQAIMEAADETDSPVILQASRGARNYAGEIFLRHLILAATETYPHIPVVMHQDHGNAPDTCYSAAINGFTSVMMDGSLEADAKTPASYEYNVAVTKQVVDFAHSVGVSVEGELGCLGSLETGKGEAEDGHGFEGELSKDMLLTDPAEAADFVAKTKCDALAIAIGTSHGAYKFTRKPTGEVLAISRIAEIHKAIPNTHLVMHGSSSVPQEWLEMINKHGGAIPETYGVPVEEIQEGIRNGVRKVNIDTDNRLAFTAAVREAAMADPANFDPRHFNKPARKYMKQVCLDRYQQFWAAGNASKIQQQTINYYAGLYAKGALDPKAAVAA

SEQ ID NO: 2228 - protein, 418 aa, Bradyrhizobium japonicum USDA 110
MAQLSDDCFAFGGPMMSVDEAVGLITTRVNAIADLETVALVDADGRVLARDIAAPLPLPPFTNSAVDGYAVRDADLPDSAERAFPLDGRIQAGGLVQAPIRPGHTARIFTGAPMPPDAGTVFMQEDVRIDDAARIVLPPGLKPGANVRPAGEDIPQGHVALRAGQRLRPQHVALAAAFGLTRIDVVRRIRVAVFSTGDELASPGEPRAASQLFDSNRFMLMAMLRRLGCEVSDLGILRDERTSLANGLKQVAGSHDLILTTGGVSTGEEDHVKAAVESIGSLVLWRMAIKPGRPVAMGIIGGTPLIGLPGNPVASFVTFVHVVRPTVLALMGGLPEPLLPIPVRAAFTYKKKIGRREYIRVSLRRGQDGALEAIKFPREGAGLLSSLVETDGLVELGEDITRVEPGQSVGFLSYADLL

SEQ ID NO: 2229 - protein, 592 aa, Medicago sativa
MNHLPRIFGYRNKSTTEMNSKKKKQPKLQRRNAVKNFNYDAQPSSSSPESSESASSSASILCTRSMDFHDRKSFRVEGVDGEFDIICRSLGLNGPEDFSIPAAAWEAMKFRSSSDVLPRLNVSEFDETKTSGEIDQVGVVDCDDRVLVRDSPAESSGGEVNVSIRDSPAKSSGCCTGGEIRVPVRGFDETSNCSTGSGGIKGIRPPMLKPPPGVRVSVVDDTCSTWDILRDFAPEGEGKEREEQEEEEEKVDEVEEKEEVGELELKVEEEENGDIIGEFSRSCSFTTSQEDDSSSTTTDTRSNSISPNVRLKPVITPGSWQKGELLGRGSFGTVYEGISEDGFFFAVKQVSLLDQGSQGKQSVVQLEHEIALLSQFEHENIVRYIGTEMDESNLYIFIEFVTKGSLLSLYRRYKLRDSQVSAYTRQILHGLKYLHDRNIVHRDIKCANILVDANGSVKVADFGLAKAIKLNDVKSCQGTAFWMAPEVVRGKVKGYGLPADIWSLGCTVLEMLTGKIPYSPMECISAMFRIGKGELPPVPDTLSRDARDFILQCLKVNPDDRPTAAQLLDHKFVQRSFSQSSGSASPHIPRRG

SEQ ID NO: 2230 - protein, 364 aa, Ipomoea batatas
MVTTISATVPSRVERLAGSGIERIPKEYIRPEEERPSIGDIFAEEKMGGGPQVPTVDLKRINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRQTDQEGADTPKPDE

SEQ ID NO: 2231 - protein, 380 aa, Zea mays
MAKLGPGQGLGVRGWRRASLVPSRKREYKPCGKHTEGKRPLYAIGFNFMDARYYDVFATVGGNRVTTYRCLENGSFALLQAYVDEDKDESFYTLSWARDHVDGSPLLVAAGSNGIIRVINCATEKLAKSFVGHGDSINEIRTQPLKPSLIISASKDESVRLWNVHTGICILIFAGAGGHRNEVLSVDFHPSDIERFASCGMDNTVKIWSMKEFWLYVDKSYSWTDLPSKFPTKYVQFPVLIAAVHSNYVDCTRWLGDFILSKSVDNEIVLWEPKTKEQSPGEGSIDILQKYPVPECDIWFIKFSCDFHFNQLAIGNREGKIYVWEVQSSPPVLIARLYNQQCKSPIRQTAVSFDGSTILGAGEDGTIWRWDEVDHPSSRN

SEQ ID NO: 2232 - protein, 348 aa, GIBBERELLA ZEAE PH-1
MESHHRAAVVTRSDTGFKFDIQNVPIPKPQPWEILVKLSATGVCGTDMTLAGGYLGPCRDILGHEGVGRVVQIGSGVDPSTIKVGDRIGIAWVRDACGQCSCCREPGGEVRCLEQQNSGRKWDGTFADHCIVPSRYVLTLPDDPKLPDEIVAPILCGGVTAYKALKACEATPGDWVAIVGAGGGVGGLGIQYAKAMGYRVAAVDVGPAEDFCLKMGADAYFDGSSPDTPAKLKKLTPNGAGAKTVIVTAGSGRAYQNALDLVAVFGTLVCVGIPPPDQAMNLHPLTLIDRGIKLLGTLVGTRTETLEALEFVRRGVVEPIVQTVNFNEIEDLAARFLTLPVSRYYVDY

SEQ ID NO: 2233 - protein, 333 aa, Neurospora crassa
MSSSSGVPESWIASFCSLLGHEYFAEVSEEFIEDDFNLTGLQTQVAMYKEALEMILDVEPEDDDDEEEEDEEDEEDMSGGDGINKPHGERRHHSRIASDLSVIESSAEMLYGLIHQRFICSRAGIQQMSEKYELGHFGICPRTNCNQTRTLPVGLSDTPGEDTVKLFCPSCLDVYVPPNSRFQTVDGAFFGRTFGALFLMTFPEYDLTKTGAESVSNLTRSGSDDTTVINGMYARNIAPGLGRGKIYQPKIYGFKVSEIARSGPRMQWLRSKPDDLSVLDEARRYAEQQGSDDEDESMGVSSRTASRRRGPPRRQKQNGSPMAIEQNGAESEL

SEQ ID NO: 2234 - protein, 240 aa, Glycine max
MDTDSFVSFDHVSPEDSHEVHVLAVDDSLVDRKVIERLLKISACKVTAVDSGIRALQFLGLDEQRRTSESDGFVPDLKVDLIITDYCMPEMTGYELLKKIKESTMFREIPVVIMSSENILPRIDRCLEEGAEDFIVKPVKLSDVKRLKGYMTPKEVIKMRSQEDRRSDGYVNGGDGGVVEINNKRKLEEQDTSDVSLSPPSTSTLSSSPSVSSPSPSSSPTSSASVLASPIRRLKMTSTD

SEQ ID NO: 2235 - protein, 198 aa, Triticum aestivum
KPAIKTVLEAYLPQIVLIVFLALLPTLLMFLSKQEGIPSQSHAVRAASGKYFYFIVFNVFLGYTLGSTLFKSLTTIIDHPAGIVTMLANSLPGSATFFLTFVALKFFVGYGLELSRLVPLIIFHLKRKYLCKTEEDVKAAWAPGDLGYNTRVPNDMLIATVVLCYSVIAPLIIPFGVAYFALGWLIAKNQILRVYVPS

SEQ ID NO: 2236 - protein, 380 aa, Zea mays
LKSAMNCSYVKDYEFVVIFDADFQPQPDFLKRTVPHFKGNEDVGLVQARWSFVNKDENLLTRLQNINLCFHFEVEQQVNGIFLNFFGFNGTAGVWRIKALEDSGGWMERTTVEDMDIAVRAHLKGWKFLFLNDVECQCELPESYEAYRKQQHRWHSGPMQLFRLCFVDIIKSKIGFWKKFNLIFLFFLLRKLILPFYSFTLFCIILPMTMFIPEAELPAWVVCYIPATMSLLNILPAPKSFPFIVPYLLFENTMSVTKFNAMVSGLFQLGSAYEWVVTKKSGRSSEGDLIALVEKQPKQQRVGSAPNLESLTKESSSLKRDSKRKKHNRIYRKELALSFLLLTAAARSLLSVQGIHFYFLLFQGVSFLVVGLDLIGEQVE

SEQ ID NO: 2237 - protein, 637 aa, Oryza sativa (japonica cultivar-group)
MAAEAAAEIVREIAAVGAADLAAAAEPLRADCLRLARKVSLLSHLVAEVAEAGAGGGDADAADSWLGDLVRALQAARRFVELGRAPARPSRASDQDAVCNNVAVQFKFVTWQLQTVLARLPQSCFQISDEVQEEVDLVRAQLRREMEKKGDIDVNIFSKFHDILALHVSTVGSQSEQSHGQPDTPQMENLCNGHLELQNIIMLVSEISGVPKSDAERITSQLIEGLENMRVTDSKKPVSVSQSSDETKASPETHKKSDAVAIPEDFRCPISLELMRDPVIVSTGQTYERAFIQRWIDCGNRTCPKTQLKLQNITLTPNYVLRSLILQWCEEKGIEPPTRSKNDGAYLEVGGERVAIETLVRNLSSSSLDERKSAAAEIRSLAKKSTDNRILLAESGAISALVKLLSSKDLKTQEHAVTALLNLSIYDQNKELIVVAGAIVPIIQVLRKGGMEARENAAAAIFSLSLIDDNKITIGSTPGAIEALVELLQSGSPRGRKDAATALFNLCIYQANKVRAVRAGILAPLIQMLQDSSRNGAIDEALTILSVLVSHHECKIAIAKAHAIPFLIDLLRSSQARNKENAAAILLALCKKDAENLACIGRLGAQIPLTELSKTGTDRAKRKATSLLEHLSKLQVL

SEQ ID NO: 2238 - protein, 310 aa, Shigella flexneri 2a str. 301
MKIRSQVGMVLNLDKCIGCHTCSVTCNNVWTGREGMEYAWFNNVETKPGIGYPKNWEDQEEWQGGWVRDVNGKIRPRLGSKMGVITKIFANPVVPQQIDDYYEPFTFDYEHLHSTPEGKHIPTARPRSLIDGKRMDKVIWGPNWEELLGGEFEKRARDRNFEAMQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEASSTEREVDLYRVGSLTAAACHGLQLPL

SEQ ID NO: 2239 - protein, 508 aa, Hordeum vulgare
MVTTPRLVSLLLLLALCAAAAGALRLPPDASFPGAQAERLIRALNLLPKDSSSSSGRHGARVGEGNEDVAPGQLLERRVTLPGLPEGVADLGHHAGYYRLPNTHDARMFYFFFESRGKKEDPVVIWLTGGPGCSSELAVFYENGPFTIANNMSLVWNKFGWDKISNIIFVDQPTGTGFSYSSDDRDTRHDETGVSNDLYDFLQVFFKKHPEFIKNDFFITGESYAGHYIPAFASRVHQGNKKNEGTHINLKGFAIGNGLTDPAIQYKAYTDYALEMNLIQKADYERINKFIPPCEFAIKLCGTNGKASCMAAYMVCNTIFNSIMKLVGTKNYYDVRKECEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKEAVPEEESSTTSFYAAM

SEQ ID NO: 2240 - protein, 262 aa, Cladonia mitis
  unsure (1)..(262): unsure at all Xaa locations
EHGAXKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTD

SEQ ID NO: 2241 - protein, 181 aa, Hordeum vulgare subsp. vulgare
LDAICDKLRQNLYISGSDILYQGGPVDKMIFIVRGKLESISADGSRAPLQDGDVCGEELLTWYLEHSSTNKDGGKSRFHGMRLVAIRTVRCLTNVEAFVLRASDLEQVTAQFARFLRNPRVQGAIRYESPYWRTIAAARIQVAWRYRKRRLKRAERSRPSEEHECLPDTRSHYAFQPGQRG

SEQ ID NO: 2242 - protein, 100 aa, Glycine max
  unsure (1)..(100): unsure at all Xaa locations
KAQMVVQVGSLWMQEWLXAWESAGYCEGXELVQVAQFGGQHLVSTVVCMAAMVLXSGGHCLFIIEASEDARLXSVLAIKPRMNGLGMRXAIPPGLSEGFK

SEQ ID NO: 2243 - protein, 337 aa, Synechocystis sp. PCC 6803
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPIAKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 2244 - protein, 377 aa, Prochlorococcus marinus subsp. marinus str. CCMP1375
MDLRNNYSEHIYYQNSLQHGGNLEQEAKRLGVHISSLIDASASLVPFSLSSPLHRCLINALKDLDLKIYPDRSHSALREAIAKHHKVHPSMVLPGNGASELITWAGRDASQNGLSILPSPGFSDYKRALKCWNGKYLYSPLPLKWTSKLPQLFPLKPSKHVIWVTNPHNPTGQCWSRDSLELLLKTHSLVICDEAFLPLVPNGEKESLIPLVENYSNLIVIRSLTKLFSIAGLRIGYAISTSKRLQQWQELRDPWPLNGLAISIGKMIMTDEKILHNRINQVHKWINEEGPWLQSNLQNLKGIIAHPSSTNFQLIESSQSLAIFRERLAKKNILLRDCSSFEGLGENWLRISLQKKSDNRRIIEAMQQVLKHIFEEC

SEQ ID NO: 2245 - protein, 369 aa, Pseudomonas aeruginosa PAO1
MSDFLALAQPGVQKLSPYVPGKPVDELARELGIDPAAIVKLASNENPLGASPKALEAIRAELAELTRYPDGNGFELKRKLAERCAVDAAQVTLGNGSNDILDLVARAYLAPGLNAVFSEHAFAVYPIATQAVGAEGRAVKARAWGHDLEAMLAAIDGQTRVVFVANPNNPTGTWFGADALERFLAQVPAEVLVVLDEAYIEYAEGDELPDGLDYLARHPNLLVSRTFSKAYGLASLRVGYALSSKAVADVLNRVRQPFNVNSLALAAACAALDDHDYLAQSRRLNDSGMAQLEDGFHALGLSWIPSKGNFIAVDLARDAGPVYQALLREGVIVRPVAGYGMPTFLRVSIGLPEENDRFLQALGKVLAHD

SEQ ID NO: 2246 - protein, 195 aa, Zea mays
GRPCPEPIFTPSRCPNPRLRLRRRDPGGLLPSSLCLRAVPPTLLNPRRATRVQAGRPPGCEGGTGAGEPQSAPPHSAPSEAPSRAGAAKQASVSGRLAESRGGGSNQQGSTMKVKILQWHAVASWTWDAQDETCGICRMAFDGCCPDCKFPGDDCPLIWGVCNHAYHLHCILKWVNSQTSTPLCPMCRREWQFKG

SEQ ID NO: 2247 - protein, 433 aa, Escherichia coli
MVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 2248 - protein, 191 aa, Lycopersicon esculentum
GDSMSTWTRDDDKLFEHGLVLYPENSADRWQLIADHVPGKTADDIMAHYDDLVHDVYEIDSGRIDLPSYTDDPVELEGDCQITSGSNKKSNEIERKKGTPWTEDEHRLFLIGLDKYGKGDWRSISRNVVVSRTPTQVASHAQKYFIRQQAMKKERKRSSIHDITTAVDTNPVPPQSSFQNQSGSQNFNFAM

SEQ ID NO: 2249 - protein, 257 aa, Zea mays
MSTACSSPPSLRPRNSIAFLALSTAMTWNEPAEGVMRVLVVDDSPVDRRVAQLLLSSDSCAGSFHVIAVDSARKAMEFLGLKDGGEEQAVDMVLTDYCMPEMTGYDLLKAIKALNPLEPIPVVVMSSEDEPQRISRCLSAGAEDFIVKPLQSKDVQRLRNCSAAARPSKGATQCEAAVVAKRNHKPHPAAAGAGAASPSGRRASLAGVAMVLHSSGVEYLPLLLKLVVLAYAALCLGELLHRWASSDGRCSLSPWCA

SEQ ID NO: 2250 - protein, 152 aa, Zea mays
KFPTKYVQFPVLIAAVHSNYVDCTRWLGDFILSKSVDNEIVLWEPKTKEQSPGEGSIDILQKYPVPECDIWFIKFSCDFHFNQLAIGNREGKIYVWEVQSSPPVLIARLYNQQCKSPIRQTAVSFDGSTILGAGEDGTIWRWDEVDHPSSRS

SEQ ID NO: 2251 - protein, 456 aa, Zea mays
RASVGSLGNVTAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMEMIQKDVNPSMRAILIDWLVEVAEEYRLVPDTLYLTVNYIDRYLSGNEIRRKRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPSLEFFRDATCLD

SEQ ID NO: 2252 - protein, 83 aa, Zea mays
  unsure (1)..(83): unsure at all Xaa locations
GGGTVDTTKFRGGSSHDTTVTTTNAGAPVWNDNEALTVGPRRPILLEDYHPVXDXGAPLRASAFPERVVDTRGAPGKGFFECP

SEQ ID NO: 2253 - protein, 438 aa, Nicotiana tabacum
CLSKKFEVAEFAGLRSSGCVTFSNKESSFFDVVSAQLTPKTTRSTPVKGETVAKLKVAINGFGRIGRNFLRCWHGRKDSPLDVVVVNDSGGVKNASHLLKYDSMLGTFKADVKIVDNETISVDGKHIKVVSSRDPLKLPWAELGIDIVIEGTGVFVDGPGAGKHIQAGAKKVIITAPAKGADIPTYVVGVNEQDYSHEVADIISNASCTTNCLAPFVKVMDEELGIVKGTMTTTHSYTGDQRLLDASHRDLRRARAAALNIVPTSTGAAKAVSLVLPQLKGKLNGIALRVPTPNVSVVDLVVNVAKKGITAEDVNAAFRKAADGPLKGVLAVCDEPLVSVDFRCSDVSSTIDSSLTMVMGDDMVKVVAWYDNEWGYSQRVVDLAHLVANNWPGSCSTRKWRSHWMSFARQILLMRNAKSMNNRFCYVSSFEMDDFRSQ

SEQ ID NO: 2254 - protein, 333 aa, Ralstonia metallidurans
MSVLLPRIVVLATGGTIAGSSANPASSAHYQAATVPVSQLVQAVPALADVARVEAEQVAQVDSKDMMFDLWRMLAARIGYWSAQDDVAGIVITHGTDTLEETAMFLHLTQACPLPVVMTAAMRPSTSLSADGPLNLLDAVRVAASPVAVGKGALVVLNQQIHAARDVVKAHTSAVDAFHSPVAGPLGFVQDTYVHFSRTPGPDQAPRLPVPAAWPLVEIVASYAQPGRVGIDAMVAAGVLGFVVAAAGNGSVHETLTAALVDAAACGVAVARSSRTGAGHVAIPAPPRPAGGVFVSAGDLNPYKARVLLLLALAGDPSLGRDAARLQALFERY

SEQ ID NO: 2255 - protein, 518 aa, Oryza sativa (japonica cultivar-group)
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKDGTVI

SEQ ID NO: 2256 - protein, 546 aa, Triticum aestivum
MGLDLGALALKYTGLAVSDHDSIVAINIFIALLCGCIVFGHLLGGNRWVNESTAALVLGLITGGVILICTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFGLLQFIGKFLYLFFTSTVLGVAAGLLSAYIIKKLCFARHSTDREVAIMILMAYLSCMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSAHRVWRKFDDKFMRPMFGGRGFVPFVPGSPIERSVHGPGLLGTVTEAEDRS

SEQ ID NO: 2257 - protein, 132 aa, Glycine max
ALSPFQEGLVFRTPFRAIPENPSLELGPQFKKVSHFLTRFQSIPRFVELARLKVPAHVWFGPGVTLKGKPGFFPNPGVNLEIPSGPVFPPKEIYGPWALLKKPFFEFLNPCGCAIFGFSPPLTKIWVLLLVW

SEQ ID NO: 2258 - protein, 362 aa, Pseudomonas putida KT2440
MNAALKTFAPSALALLLILPSSASAKEAETQQKLANVVILATGGTIAGAGASAANSATYQAAKLGVDKLIAGVPELADIANVRGEQVMQIASESISNDDLLKLGKRVAELAESKDVDGIVITHGTDTLEETAFFLNLVEKTDKPIVVVGSMRPGTAMSADGMLNLYNAVAVASDKQSRGKGVLVTMNDEIQSGRDVSKAVNIKTEAFKSAWGPMGMVVEGKSYWFRLPAKRHTVNSEFDIKQISSLPQVDIAYGYGNVTDTAYKALAQNGAKALIHAGTGNGSVSSRVVPALQELRKNGVQIIRSSHVNQGGFVLRNAEQPDDKNDWVVAHDLNPQKARILAMVAMTKTQDSKELQRIFWEY

SEQ ID NO: 2259 - protein, 128 aa, Zea mays
MKIVAKRIAYVVCGALYGLHYDIHAAQSGTAGTPEGARMERTYAHATKYSDEVEHSYSFVQVLTACTASFAHGANDIGNSVGPWAVIYSAWSTGNAAAAKAPVPVWQLAVLALVISLGLVTYGYNIMK

SEQ ID NO: 2260 - protein, 579 aa, Arabidopsis thaliana
MASTTREKFVSFINNRWLVFVAAMWIQSCAGIGYLFGSISPVIKSSLNYNQKELSRLGVAKDLGDSVGFIAGTLSEILPLWAALLVGAVQNLIGYGWVWLIVTGRAPILPLWAMCVLIFVGNNGETYFNTGALVSGVQNFPKSRGPVVGILKGFAGLGGAIISQIYTMIHSSNPASLILMVAVTPAVVVVCLMFFIRPVGGHKQIRPTDGASFTFIYGVCLLLAAYLMSVMLIQDLVVVSHNVITVFTIVLFVILVVPILVPIMTSFFTETNEPDDTIEEPLVPKREDQEPGLQTPDLILSEVEDEKPKDVDLLPASERHKRIAHLQAQLMQAAAEGAVRVNRRRGPHRGEDFTLTQALVKADFWLIFFSLLLGSGSGLTVIDNLGQMSQSLGYDNTHVLVSMISIWNFLGRIGGGYFSELVVRDYAYPRPVAMAVAQLIMSVGHIFFAYGWPGAMYIGTLLIGLGYGAHWAIVPATASELFGLKKFGALYNFLTLANPAGSLVFSGMIASSIYDREAERQAHGSVFDPDDALRCNGSICFFLTSLIMSGFCIIACMLSMILVRRTKSVYTHLYGKTRT

SEQ ID NO: 2261 - protein, 348 aa, Oryza sativa
MKISEGRSVVGPTKQERGVWGPPCRATHSTTTIREDELTIPPPPALCFASGLRSPPPNSGRSPARRSRAPTIRRGEADDGAPLLLPGEPPPVAAAAAAAACSEEKGAAGTLGLCRMPLWGTGSSAPSAAAEGSAAGGDGAARSSSGGAAVIRSLLPTRRRLRLDPPSKLFFPYEPGKQVRSAVKIKNISKSHVAFKFQTTAPKSCFMRPPGGILAPGESIIATVFKFVEHPENNEKPLDQKCKVKFKIVSLKVKGPMEYVPELFDEQKNQVAVEQILRVVFLDAERQTPQMDKLKRQLAEAEAALEARKKPPEDTGPRIVGEGLVIDEWKERRERYLARQQIEGVDSA

SEQ ID NO: 2262 - protein, 425 aa, Glycine max
MLLYQPLKEEVETTIMMKGDNVLDLKTLIEELESSTIEVPSVFICPISLEPMQDPVTLCTGQTYDRSNILKWFSLGHNTCPTTMQELWDDSVTPNTTLYHFILSWFSQKYLVMKKKLEDVQGTALELLDTLKKKVKGQNIVRALKKLRQLVDSHVSTRKTVEENNGSSLISSLLGPFTSHAVGSEAIGILVNLELGSELKRNLMHPAKVSLLVDIMNEGTIQTKMNCAKLIQTLLVEGNPSETVVLSSLSLLVGVLRLVRDKKHPTSVLTGLILLKIVCSREPVRSSIISIGAVPQLIQLLPTLNNECLEIALHILEVLSTLPEGRLALKECPNIIPNVVKLLMRVSESCTQFALSILWAIYKLAPEECASKAVEAGLAAKLLLVIQSGCNPVLKQKSTEFLKMCSLDYSTSIFISKCMLTATIQ

SEQ ID NO: 2263 - protein, 249 aa, Emericella nidulans
MPRKFFVGGNFKMNGNAESTTSIIKNLNSANLDKSVEVVVSPPALYLLQAREVANKEIGVAAQNVFDKPNGAFTGEISVQQLREANIDWTILGHSERRVILKETDEFIARKTKAAIEGGLQVIFCIGETLEEREANKTIDVVTRQLNAAAKELSKEQWAKVVIAYEPVWAIGTGKVATTEQAQEVHSAIRKWLKDAISAEAAENTRIIYGGSVSEKNCKDLAKEADIDGFLVGGASLKPAFVDIVNARL

SEQ ID NO: 2264 - protein, 402 aa, Ferroplasma acidarmanus
MLIGQKIIFSYKGQEYAGTYISSGKNTITVKLGSGYNITVDASSIEIKKEYSMEKGDKPGAETKNSGCGENGVCILTTGGTIASSVDYTTGAVKPVKDISYLYNFVNNISQFKLYHESIDNILSENVNAEKWVQFARKARDAMKKGNSVIIFHGTDTMQYSASALSFMFEEQTEPIIFTGSQRSSDRPSSDAFLNIEGSIHFASTDMGEVGIAMHTDTSDDSISLYRATRARKMHTSSRDAFKSISEPPLGLYADGKVKEIKNIRHKSDSIILKDRLDKNIGLIYFYPGMAEEDFYNLSYNKKAVIIMGTGLGHTSTGIIDVIRKLSRETHFFMTSQCIYGNVNMNVYSTGRELIDAGVIPLQNMLAETAMVKAMYLSANYPDNFVELMQKNLRGEFEDTVK

SEQ ID NO: 2265 - protein, 150 aa, Triticum aestivum
  unsure (1)..(150): unsure at all Xaa locations
RAPTRPLVYIEQSFDKHDWEHSEXTTLELCEDARDDLLMXDPERIKRAVNEYTCDALTLKASQVGTVTEAIEAVKQAKDAHWGVMVSHRSGDTDDSFIADLAVGAAAGQIKAGAPCRGECLTKYNQLLRIEEEFGSEGVYAGENWRTTAS

SEQ ID NO: 2266 - protein, 263 aa, Oryza sativa
  unsure (1)..(263): unsure at all Xaa locations
FFTDAYDLFCISLVSKLLGRIYYTDIASDTPGSLPPNVSAAVNGVALCGTLAGQLFFGWLGDKLGRKSVYGFTLVLMVVCSVASGLSFGRTAKGVVATLCFFRFWLGFGIGGDYPLSATIMSEYANKRTRGAFIAAVFAMQGFGILFGAIVALVVSAGFRNAYPAPSYADGRAASLVPEADYVWRIILMFGTRPGGAQLLLAHENARRTARYTGSXAQTPSKAGRXHXQGVXTRXFQXGXXAPGXRGXXRRXXPRXXKXGXFF

SEQ ID NO: 2267 - protein, 516 aa, Neurospora crassa
MSSNDAPVYTLAEGRPVQDPSAATVLMGSKPRGGALSLLADTQLIETLAHFPRERIPERVVHAKAAGAWGEFECTEDVSDFTSVDFLNKVGKKTKVLARISTVAGEKGSADTVRDIRGFAVKFFTEEGNWDFVGNDLPVFFIRDPVKFPSLNRSHKRHPQTNVPDSTMFWDFHNNNQEGVHCLMQLFGGRGIPASLRNVNAFGNHTYKFGKPEDGTFKYVKIHLKPDAGIKNLESDEALRLAGEEPDFHIKDMYNAIERGDYPTWTMYFQIMDPKDAETYRYNIFDITQTWSHRDYPLRPIGKLRLNKNPENHFQDIEQAAFSPSTMVPGIGPSADPMLQARMFSYPDAARYRVGPNYQQLPCNRALHVYSPYQRDGPMRVDGNYGGDPDYVRSSFRPMRFGPPDVAHDEWAGKVALFTSEVTDLDFEQPRDLWKIFKETGEDKRFAKNVAAHVGKALPEVQKKTIEMFSKVDQEVGEAIQRELDELEKKGGAGIEHDKAPVKGKGMRCKDSKDDE

SEQ ID NO: 2268 - protein, 166 aa, Glycine max
KKSLRYPLPLLCSLSIFPSLSPSSALRRLLAPPRSPRALARPMASGDSKPRSEEEWRAVLTPEQFRILRLKGTELPGTGEYNKFYGDGAYKCAGCGTPLYKSTTKFDSGCGWPAFFEGLPGAIHRTPDPDGRRVEITCASCGGHLGHVFKGEGFKTPTDERHCVNS

SEQ ID NO: 2269 - protein, 478 aa, Glycine max
MDTKSAVELMESSSEVHFSGFHMDGFEQRKASIEQPTTSETDMYKQPFVIGVAGGAASGKTTVCDMIIQQLHDQRVVLVNQDSFYNNLTEEELTRVQDYNFDHPDAFDTKQLLRVMDKLKHGEAVDIPKYDFKSYKNDVFPARRVNPSDVIILEGILVFHDPRVRELMNMKIFVDTDADVRLARRIRRDTTEKGRDIGAVLDQYSKFVKPAFDDFILPTKKYADIIIPRGGDNHVAIDLIVQHIRTKLGQHDLCKIYPNLYVIQSTFQIRGMHTLIRDAKTTKHDFIFYSDRLIRLVVEHGLGHLPFTEKQVITPTGSVYTGVDFCKRLCGVSVIRSGESMENALRACCKGIKIGKILIHREGDNGQQLIYEKLPNDISDRHVLLLDPILGTGNSAVQAISLLIKKGVPESNIIFLNLISAPKGVHVVCKSFPRIKIVTSEIEIGLNEDFRVIPGMGEFGDRYFGTDDDDEQVVVSSQ

SEQ ID NO: 2270 - protein, 214 aa, Aquilegia alpina
IENTTNRQVTFCKRRNGLLKKAYELSVLCEAEVALIVFSNRGRLYEYANNSVRKTIDRYKKTCGEGSSTLTVSEANLLFYQQESSKMKQQIEILQNSNRHLMGEALSCLSIKELKQLESRLEKGISRIRSKKNEMLLAEIEFMQKREIELHNDNIYLREQITANERAQQHMNSLPGNVYEAITSAPYNSRDFLQVNLRESKPNQYCDSTALQLC

SEQ ID NO: 2271 - protein, 638 aa, Zea mays
MATTAAASTALTGATTAAPKARRRAHLLATRRALAAPIRCSAASPAMPMAPPATPLRPWGPTEPRKGADILVESLERCGVRDVFAYPGGASMEIHQALTRSPVIANHLFRHEQGEAFAASGYARSSGRVGVCIATSGPGATNLVSALADALLDSVPMVAITGQVPRRMIGTDAFQETPIVEVTRSITKHNYLVLDVDDIPRVVQEAFFLASSGRPGPVLVDIPKDIQQQMAVPVWDKPMSLPGYIARLPKPPATELLEQVLRLVGESRRPVLYVGGGCAASGEELRRFVELTGIPVTTTLMGLGNFPSDDPLSLRMLGMHGTVYANYAVDKADLLLALGVRFDDRVTGKIEAFASRAKIVHVDIDPAEIGKNKQPHVSICADVKLALQGMNALLEGSTSKKSFDFGSWNDELDQQKREFPLGYKTSNEEIQPQYAIQVLDELTKGEAIIGTGVGQHQMWAAQYYTYKRPRQWLSSAGLGAMGFGLPAAAGASVANPGVTVVDIDGDGSFLMNVQELAMIRIENLPVKVFVLNNQHLGMVVQWEDRFYKANRAHTYLGNPENESEIYPDFVSIAKGFNIPAVRVTKKNEVRAAIKKMLETPGPYLLDIIVPHQEHVLPMIPSGGAFKDMILDGDGRTVY

SEQ ID NO: 2272 - protein, 361 aa, Triticum aestivum
  unsure (1)..(361): unsure at all Xaa locations
CFFYCFWWGLQSLSSLGQNLKTSTYTWENLFAVFVSISGLVLFALLIGNVQTYLQSASVRIEEMRVKRRDTEQWMAHRLLPENLXRILRHEQYRWQETRGVDEEGLLMNLPKDLRREIKRHLCLSLLMRVPMFENMDEQLLDAMCDRLKPMLYTEDSCIIREGDPVNEMLFVMRGYLESMTTNGGQSGFFNSNVLKGGDFCGEELLTWALDPAAVSNLPSSTRTVKTLSEVEAFVLRADDLKFVATQFRKLHSKQLQHTFRFYSQQWRTWAACFIQAAWHRYCRKKLEDSLFEKEKRLQAAIVSDDSTKLSLGAALYASRFAGNMMRILRRNATRKARLQDRVPARLLQKPAEPNFFAVGE

SEQ ID NO: 2273 - protein, 530 aa, Blumeria graminis
MGISESFMFPYLQPLLQLGFGIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVFDCPNSKLMEQQKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPVKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 2274 - protein, 221 aa, Oryza sativa (japonica cultivar-group)
MADVFEGYERQYCEISASLARKCTAASALQGEKLKQKASEIKSGIDGAEALIKKMDLEARNQQPSVRAGLLAKLREYKSDLNNLKGTLKRVTTGNAQQGSREELLESGMAETLGVSADQKSRLLRITEKQNKTTDRIRDSHRTMLETEDLGVSLLQDLHQQRERLIHAHGTLDNVDDNIGKSRRIMGAMVRRMDRNKWIIGFIIALLVLVILVILYFKFVH

SEQ ID NO: 2275 - protein, 655 aa, Klebsiella oxytoca
MKRNRFFNTSAAIAISIALNTFFCSMQTIAAEPEETYLDFRKETIYFLFLDRFSDGDPSNNAGFNSATYDPNNLKKYTGGDLRGLINKLPYLKSLGVTSIWITPPIDNVNNTDAAGNTGYHGYWGRDYFRIDEHFGNLDDFKELTSLMHSPDYNMKLVLDYAPNHSNANDENEFGALYRDGVFITDYPTNVAANTGWYHHNGGVTNWNDFFQVKNHNLFNLSDLNQSNTDVYQYLLDGSKFWIDAGVDAIRIDAIKHMDKSFIQKWTSDIYDYSKSIGREGFFFFGEWFGASANTTTGVDGNAIDYANTSGSALLDFGFRDTLERVLVGRSGNTMKTLNSYLIKRQTVFTSDDWQVVFMDNHDMARIGTALRSNATTFGPGNNETGGSQSEAFAQKRIDLGLVATMTVRGIPAIYYGTEHYAANFTSNSFGQVGSDPYNREKMPGFDTESEAFSIIKTLGDLRKSSPAIQNGTYTELWVNDDILVFERRSGNDIVIVALNRGEANTINVKNIAVPNGVYPSLIGNNSVSVANKRTTLTLMQNEAVVIRSQSDDAENPTVQSINFTCNNGYTISGQSVYIIGNIPQLGGWDLTKAVKISPTQYPQWSASLELPSDLNVEWKCVKRNETNPTANVEWQSGANNQFNSNDTQTTNGSF

SEQ ID NO: 2276 - protein, 404 aa, Blastocladiella emersonii
APAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 2277 - protein, 842 aa, Vicia faba
MGFKVETNGGDGSLVSAKVPPLANPLAEKPDEIASNISYHAQYTPHFSPFKFQLQQAYYATAESVRDRLIQQWNETYLHFHKVDPKQTYYLSMEFLQGRALTNAIGNLNIQDAYADALRKFGLELEEITEQEKDAALGNGGLGRLASCFLDSMATLNLPAWGYGLRYRYGLFKQIITKEGQEEVAEDWLEKFSPWEIVRHDVLYPIRFFGQVEVNPDGSRQWIGGEVIQALAYDVPIPGYQTKNTISLRLWEAKACADDFDLFLFNDGQLESASVLHSRAQQICSVLYPGDATEGGKLLRLKQQYFLCSASLQDIISRFKERRQGPWNWSEFPTKVAVQLNDTHPTLSIPELMRLLMDDEGLGWDEAWAVTSKTVAYTNHTVLPEALEKWSQPVMWKLLPRHMEIIEEIDRRFVALISKTRLDLEDEVSNMRILDNNLQKPVVRMANLCVVSSHTVNGVAQLHSDILKSELFASYVSIWPTKFQNKTNGITPRRWINFCSPELSRIITKWLKTDKWVTNLDLLTGLREFADNEDLQAEWLSAKRANKQRLAQYVLQVTGENIDPDSLFDIQVKRIHEYKRQLLNILGVIYRYKKLKEMSPEERKSTTARTVMIGGKAFATYTNAKRIVKLVDDVGSVVNSDPEVNSYLKVVFVPNYNVSVAEVLIPGSELSQHISTAGMEASGTSNMKFALNRVLIIGTLDGANVEIREEIGEENFFLFGATADEVPRLRKERENGLFKPDPRFEEAKKFIRSGVFGSYDYNPLLDSLEGNSGYGRGDYFLVGYDFPSYMDAQEKVDEAYRDKKRWLKMSILSTAGSGKFSSDRTIAQYAKEIWNIEECRVP

SEQ ID NO: 2278 - protein, 357 aa, Zea mays
MGCSFSGLNALYDTVGGRGGDVWVNDYHFRVLRRLGDAGPAGSSVFLVKEVVAAATASDGTAGSEPGASGIAGKKGIDPSHISADGTYALKKVLVQSDQHLELVQQEIRVSSQFSHPNLLPLLEHAIVAVKGVQDGSQNYEAYLLFPVHLEGTLHDITKTMLEKKEFFPTITVLQIFRQLCSGLKHMHSFDPPYAHNGVKPDNVLITQRKQSHLAILMDFESAGPARKTIRSQAEALQLQEWASEHCSSHYRAPELWECPSHADIDERTDIWSLGCTLYAMMYGKSPFDYELDESSGESLHSVIKNVQIKWPEEAGSTYPDSLRQFITWMLQPHPAVRPHIDDIIIHVDKLVMKYSN

SEQ ID NO: 2279 - protein, 150 aa, Oryza sativa
MGYLDEQFNQLEELQDESSPNFVEEVAALFFKDSSRLLTNIEQAIDKYPQDFYRLDSLVQQLKGSGSSIGALRMKNECSVFKVNCNDRNLEGCRRSLQKMKREHATLKQKLESYFQHCYMAKQLGYLLFLLLMQLLRQVGPRDYAVSSRK

SEQ ID NO: 2280 - protein, 375 aa, Eremothecium gossypii
MYGARAGNENSGAGAAGSRAGRRGSGGSGGPRVALGDVTAQVNNRGPRAGGKDARAGKPQGDAAVQGGENVEETVRAVGPVWDAAAEAAVAAAAAEYGGAPDPADEDTWDAVMVAEYAPEIFAYLRGLEVRFAPAADYMRGQPELRWEYRATLVDWLVQVHCRFQLLPETLYLTVNIIDRFLSRKTVTLNRFQLVGAAALFIASKYEEINCPTLRELLYMLDNAYTADEVLKAERYMIDTLEFEFGWPGPMSFLRRVSKADNYEYDIRTLAKYLLETTIMDPRLVAAPPSWLAAGAYYLSRIIIGYNTWTRQHVFYSGYTAEQLVSLATVILENCRHAETRHQAIFEKYSKSRHRRSAQVVARWIAMAEENLQPA

SEQ ID NO: 2281 - protein, 306 aa, Ipomoea batatas
GDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLFRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 2282 - protein, 176 aa, Triticum aestivum
  unsure (1)..(176): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCXTDATQVINEVEEVKKEYPDAYVRIIGFDNMRQVQCVSFIAFKPPGCEESGKA

SEQ ID NO: 2283 - protein, 180 aa, Triticum aestivum
MEDVLDSAVGAHFSGLRRDLRRLSSSSSLPSSPSSATCNGAADAPSGLASPAPRQPFVIGVCGGTASGKTTVCDMIIQQLHDHRVVLVNQDSFYRGLTAEESARAQDYNFDHPDAFDTEQLLECMGQLKRALPVNVPIYDFKNHRRCSERFRKVNASDVIILEGILVFHDQRVRNLMDMK

SEQ ID NO: 2284 - protein, 268 aa, Pneumocystis carinii
MTSRENLVYLAKLAEQAERYEEMVESMKKVASSDQELTVEERNLLSVAYKNVIGARRASWRIVSSIEQKEENKGNLSQAGLIKEYRSKIESELTSICNDILAVLDAHLIASASTGESKVFYYKMKGDYYRYLAEFAVGDKRKAPSDASLAAYKEASDIAGTDLPPTHPIRLGLALNFSVFYYEILNSPDCACHLAKQAFDDAIAELDTLSEESYKDSTLIMQLLRDNLTLWTSDMQDSNEKNDSKEAVSEVPDPGKPSETEASKTDDI

SEQ ID NO: 2285 - protein, 274 aa, Glycine max
MSATVTLTLNLCRSSIVASCPHYSHKPNPNFNAFFSFSLSLSLSHHRRIVIYKKPFPSRRTWLYGYMNRDRDYELENGLALFGSDEELATQIPTQAQSLVEGSGSIRIAEFKPVPDVDYLQELLAIQQQGPRAIGFFGTRNMGFMHQELIEILSYAMVITKNHIYTSGASGTNAAVIRGALRAEKPELLTVILPQSLSKQPPESQELLSKVKNVIEKPHNDHLPLIEASRLCNMDIISHVQQVICFAFHDSRLLMETCQEAKNLRKIVTLFYLD

SEQ ID NO: 2286 - protein, 288 aa, Escherichia coli
  unsure (1)..(288): unsure at all Xaa locations
IGQALALLLKTQXPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVXCAYVEGDGQYARFFSQPLLLGKNGVEERKSIGTLSAFEQNALEGMLDTL

SEQ ID NO: 2287 - protein, 251 aa, Oryza sativa
MGRSPCCEKAHTNKGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPVTHRPINDSASNITISFEAAAAAARDDKAAVFRREDHPHQPKAVTVAQEQQAAADWGHGKPLKCPDLNLDLCISLPSQEEPMMMKPVKRETGVCFSCSLGLPKSTDCKCSSFLGLRTAMLDFRSLEMK

SEQ ID NO: 2288 - protein, 154 aa, Triticum aestivum
  unsure (1)..(154): unsure at all Xaa locations
HPHPLQLASPLSTSAACSLTTCYLPAGLGLVKPMEEMLMGAPSANQQVQGSNPNPPAQAPSSAPGAGGPMRGGTPAMAVAGSGAGAGSTERRPRPQKEKAINCPRCNSTNTKFCYYNNYSLQQPRYFCKTCXRYWTEGGSLRNVPVGGGSRKNK

SEQ ID NO: 2289 - protein, 518 aa, Pichia angusta
MLRTSLRSLAKPASRVSLRYYSSYPLSTTVTLPNGKSYEQPTGLFINNEFVPSKQHKTFEVINPATEEEICHVYEARKEDVDVAVDAAEKAFKGSWSTADPAIRGKALWNLAELLEAHKDTLAAIESLDNGKALQLAQGDVALVINYIRSCAGWADKLTGQYIDTGDTHHTYTKREPIGVCGQIIPWNFPLLMWSWKVGPALAAGNTVVLKTAESTPLSALYASQLVKEAGIPAGVVNIVSGFGKITGDAIASHPKIKKLAFTGSTATGRHIMKVAADSNLKKVTLELGGKSANIVFDDADVKTAISALVAGIFYNSGEVCSAGSRVFVQEGIYEEILREFKAAAETLKVGDPFDLSTFQGAQTSQMQLNKILGYVDIAHQEGGRLITGGERLGNKGFFVKPTIFADVTPDMRAYKEEIFGPFAVITPFKTADEVIELANDSEYGLAAGVHTKSLDTATYVSNKLEAGSVWINTYNDFHQMVPFGGYKQSGIGREMGAQALDNYTQWKAVRIGLQKPT

SEQ ID NO: 2290 - protein, 573 aa, Prochlorococcus marinus str. MIT 9313
MTGADALMDALRRNGVEIIFGYPGGAILPIYDAVYKAEQQGWLKHILVRHEQGGAHAADGYARATGRVGVCFGTSGPGATNLVTGIATAQMDSVPMVVITGQVPRPCIGTDAFQETDIFGITLPIVKHSWVVRDPGDLASVVAQAFFIAASGRPGPVLIDIPKDVGQEEFDYQPVEPGSVVPAGFHRFPAPELSSIEAALDLIDDAQRPLLYVGGGVISAGAHESLKGFAERHQIPVTTTLMGKGAFDERHPLALGMLGMHGTAYANFAVTECDLLIAVGARFDDRVTGKLDTFAPRARVIHFEIDPAEVAKNRRPDVAVLGDVGVSLVKLFDLSKQKSVELRTSAWLTRIESWKNLYPLMTPPEEGPIYPQEVLLAIRDLAPEAYITTDVGQHQMWAAQYLRNGPRQWISSAGLGTMGFGMPAAIGVQVALPDEQVVCIAGDSSILMNIQELGTLIEYNIPAKIVIVNNHWQGMVRQWQQSFYEDRYSATDMLPGMPDFVALAKAFRVGGVLITERKDLRSSLKQALATPGPMLIDVHVRRDENCYPMVPPGKSNAQMVGLSNHPELSGVSL

SEQ ID NO: 2291 - protein, 794 aa, Nicotiana tabacum
MAILDKKTHLFFSLVLLCFLISLSPISSLSTVAISKTSNQTLICALISSSSFPQQSSLNCTSFPEGIQIPLNPSVYFSGIVGGNGFLCGLTSSYSSSTSIMVCWRFLNNGTNLSYKSIYLGPLITNLDSGNSHICGIVNGTNNRLECWQWHEFNSSNRSLMTSNLAVGEDFVCGLLTFGQIQCLGSFRNVTDAIPSGNYSEIASGSQHVCAISKNNSLVCWGNMVGEKPIGQFKSLALGDNRSCALRINGKVVCWGETGFSLPSSLSGEFFETLEAKQDIFCGIVTSNYSLFCWGNDIFNSNPAVFNGVGVVPGPCTTSCPCVPLPNYESFCGRGLMICQHCVGQDSSVNPPIVNGSGPSLPPLPPQPMPSPTPSQTSGRSDPWSRRNVAFLVVGCVGSLMMLSVLVILFFKYCKIRGCRVHDSGRLDEAGSPPQQGSQTSRVQDQQGTPQPPVLEKRLSQLISIGNGGHLDEFSLQVLLQVTNNFSDEHKIGSGSFGAVYHATLEDGREVAIKRAEASASSSYAGGTKYRQEDKDNAFLNELEFLSRLNHKNLVKLLGYCEDNNERVLIFEYMNNGTLHDHLHGLESSPLMSWVGRIKVALDAARGIEYLHEYAVPTVIHRDIKSSNILLDVTWNAKVSDFGLSLMGPQDDETHLSMRAAGTVGYMDPEYYRLQQLTTKSDVYSFGVMLLELLSGYKAIHKNENKVPRNVVDFVVPYIVQDEIHRVLDRRVPPPTPFEIESVAYVGYLAADCTTLEGRDRPTMTQVVNTLERALKACLATPIFSRSNTDDSST

SEQ ID NO: 2292 - protein, 223 aa, Oryza sativa
MARRPAPWEQGGDEYDYLFKIVLIGDSGVGKSNLLSRFTRNSFSLDSKSTIGVEFATRTIQVEGKIVKAQIWDTAGQERYRAITSAYYRGAVGALLVYDVTKATTFENVKRWLKELRDHADSNIVVMLIGNKIDLKHLRSVSLEDATSFAEREGLSFVETSALDATNVDKAFQTVLTEIYRIISKKALAADEAGAGAGAVREGQSIQVSATDSSSFTSRCCSF

SEQ ID NO: 2293 - protein, 848 aa, Prochlorococcus marinus subsp. pastoris str. CCMP1378
MSNLMNSNEPFDLRLPTPGCYLDPEKAGMDSDALFKGMTEHLFFTLGKLATSASPHDLYMALSYAVKDRLMTRYLASQEVIRKKPQKTVAYLSAEFLIGPQLSNNLLNLGITKEAEDALKRFGIESLSTILEVEEEPGLGNGGLGRLAACYMESLASLQVPAVGYGIRYEFGIFNQLIRDGWQVEVTDKWLKGGWPWELPQPDESCFVGFGGRTESYRDDKGKYRSRWVPSEHAIGVPHDVPVLGYRVNTCDRLRLWRADATESFDFYAFNIGDYYGAVEEKVASETLSKVLYPNDGTDEGRRLRLKQQHFFVSCSLQDMLRSLEKRSIPVTEFANHWTVQLNDTHPAIAVAELMRLLIDQYQIGWDKAWNITTSSVAYTNHTLLPEALEKWDLSLFSDLLPRHLEIIYEINWRFLQQLRLRYPGDDKILQKLSIIDEEGSKSVRMAHLATIGAHHINGVAALHSDLIKRQLLPEFAELWPEKFTNVTNGVTPRRWVALANPSLSNLLEKEVGPDWITNMELLKKLENKKDDANFLQEFEETKLRGKRKLASFIHTKTGILVDPSSLFDVQVKRIHQYKRQHLNALQIIAQYLRIKNGTSNYKAPRTVIFGGKAAPGYFMAKLIIRFINGIADVVNSDPDMEGLLRVVFLPDYNVKLGEIVYPATDLSEQISTAGKEASGTGNMKFAMNGALTIGTLDGANVELRDLVKKENFFLFGKTESEIMHLKNNSYSPKTFIEKCPELQEVIRLIEIGHFSNGDKELFKPLLNSLTGNDPFFVMADFEDYLNKQDEVSNFWNNKKAWNKMALLNTARSGYFSSDRSIREYCESIWKVSPMPVEITCDIEEITT

SEQ ID NO: 2294 - protein, 466 aa, Gigartina cf. tuberculosa
YAKMGYWDPDYVVKDTDVLALFRVSPQPGVDPVEASAAVAGESSTATWTVVWTDLLTACDLYRAKAYKVDIVPNTTDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEAVNRSIAASGETKGHYLNVTAATMEEMYERAEFAKQLGSIIIMIDLVIGYTAIQTMGVWSRKNDMILHLHRAGNSTYARQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVTEGPQILQDAAKTCGPLQTALDLWKDITFNYTSTDTADFVETPTANV

SEQ ID NO: 2295 - protein, 335 aa, Enterococcus faecium
MGKVVTLGEIMLRLSTEQGTRIDSSERFAAHYGGGEANVAISLANYGHEAIFATKVPDNALGKAVKKHLQCYGVDTKQVLSGGSRLGTYYMETGSGERAASVIYDRAGSSFAEMDHLEWSLEELFQGIDIFHVSGITPALSKKWQKMTKQVIEAAKKAGCLISFDINYRGKLWTQQEASEVIHQLLPLVDICSAGKMDALYLLGIEKAPEAEEQPLIYYYQKMQEKFPNIQVFYSTKRTVHSASENELKGTLWMNHEYVESQVHRITPIVDRVGGGDAFAGGVLHGILSNMSPQEIIDFATAASALKHTIHGDCNQFSQEEVAQFLACGSGKIIR

SEQ ID NO: 2296 - protein, 172 aa, Lactobacillus plantarum WCFS1
MALDLKKYVASIPDYPEPGIIFRDISPLMADGEAYREATDQIVQFARDKHVDMIVGPEARGFIVGCPVAYELGVGFAPARKKGKLPRETVKATYDLEYGQSALYLHKDAIKPGQNVLVTDDLLATGGTISATIQMVEELGGNVVGTAFLVELKELHGRDKIKDYDMLSLMQF

SEQ ID NO: 2297 - protein, 484 aa, Pseudomonas sp.
MTILNFIDGSYREGSEGKSFSNVNPATGAEIGVVHEASQAEVEDAVEAAKAALTGPWGKMTTARTGQADHRVATEIERRADDFLAAEVADTVKPRHVVSHIDIPRGAANFRMFADVVSTMPGESFNTPTPDGGQAFIYTVSKPKGVDAAVCPRNFPLLLMIWKVGPELACGNTAVVKPSEEIARTAALLGDVIDAGVNHHGVFNVAQRFGPASAGEFLTSNPDVDAITFTGETGTGQAIMQKAATGVRDISFELGGKNPAIVFADADLDKAVEGLSRSVFLNTGQVCLGTERVYVERPIFDAFVARMAAAAQDFKPGVTGDRAYLGPLISAEHREKVLAYYPRAVEDGPTVFTGGGVPEISGAETGGFFVEPTLWIDVAHGDTVMREEIFGPCCDILPFDSEDEVIALANDTVYGLCASVWTENLSRGHRVAAAMEVGVCWVNSWFLRDLRTAFGGSGHSGIGREGGVHSLEFYTEITNICVKL

SEQ ID NO: 2298 - protein, 638 aa, Anemia phyllitidis
MAQVMQAQQAPTIATPISGSSPYVAPSLYVGDLDPDVSESELYEVFNQIGQVVSIRVCRDLMTKKSLGYAYVNYGTHQDASQALELLNFTLVKGKPIRIMYSHRDPSIRKSGAANIFIKNLEKSIDNKALHDTFSAFGTILSCRVVMDDAGNSKGYGFVQFEKEESAQIAIEKVNGMLINDRQVSVAPFIRKQERDMASSKNFNNVYVKNLAEATTDEDLRKVFAGFGPISSAVVMRDADGKSKCFGFVNFENVDDAANAVENLNGKLINEKEWYVGRAQKKSEREAELKAKFEQVRKEKEEKFQGVNLYLKNIDDSIDDEKLRELFAVFGTVTSCKVMKSPQGQSMGSGFVTFSAPEEAMQAVNDMNGKMVGSKPLYVALAQRKEERRARLQAQFAQMQIVAPNAPPMAPNPPSMYHPGPQGMGHQMFYGQPAPGLLPSQANGFGYQQPMVPTMRPTSAGVPNYFMPVQRPGQQIQRPVNRRGGVGPLQPQHHQPPPQQFPRGGNRSMRYSQFSRTMPDSTMQGFGMMGAANASNIGLMPALASALASASPEEQRVMLGEQLYPLVDRLEHDHAGKVTGMLLEMDQPEVLHLIDLLRQLKAKVAEAMDVLRMAQGSISSNSPLDQLASLSLTESLTS

SEQ ID NO: 2299 - protein, 182 aa, Mycobacterium tuberculosis CDC1551
MMKVAAQCSKLGYTVAPMEQRAELVVGRALVVVVDDRTAHGDEDHSGPLVTELLTEAGFVVDGVVAVSADEVEIRNALNTAVIGGVDLVVSVGGTGVTPRDVTPEATRDILDREILGIAEAIRASGLSAGIVDAGLSRGLAGVSGSTLVVNLAGSRYAVRDGMATLNPLAAQIIGQLSSLEI

SEQ ID NO: 2300 - protein, 255 aa, Oryza sativa (japonica cultivar-group)
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMEVVAAQTKAIAEKISDWTNVVLAYEPVWAIGTGKVATPAQAQEVHDGLRKWLVTNVSPAVAESTRIIYRGSVNGANCKELAAKPDVDGFLVGGASLKPEFVDIIKSATVKSSA

SEQ ID NO: 2301 - protein, 593 aa, Paracoccus pantotrophus
  unsure (1)..(593): unsure at all Xaa locations
MKMTTEESFVKVLQLHGIEHAFGIIGSAMMPVSDLFPRAGITFWDCAHETNAGMMADGFTRSTGRMSMAIAQNGPGVTGFVTXVKTAYWNHTPLLLVTPQAANRTIGQGGFQEMEQMRIFADCVCYQEEVRDASRIPEVLNRVIMQAWRNSAPAQINIPRDFWTQVIDVELPQVVAFERPAGGEQAVAEAAKLLSGAEFPVILSGAGVVLSGAIPELARLAERLDAPVCSNYQHNDSFPGSHPLAMGPLGYNGSKAAMEIIARADVVLALGTRLNPFSTLPGYGIDYWPKDARIIQVDINADRIGLTKKVTVGIQGDAAKVARGILAQLAPTAGDAGRAERKALVAQTRSRWAQELSSLDHEEDDPGTEWNEDARRRDAGLMSPRQAWRAIMQAVPKEAIVSSDIGNNCAIGNAYPSFEAGRKYLAPGLFGPCGYGFPAILGAKIGNPDVPVIGFAGDGAFGISMNEMTACGREDWPAITMVIFRNYQWGAEKRNTTLWYDNNFVGTELDRDTSYAKIAQACGLVGVQVKSQEELTAALHDAVERQMKNRETTFIEVLLNQELGEPFRRDAMKKPVVVAGIDPADMRPQQGAA

SEQ ID NO: 2302 - protein, 183 aa, Triticum aestivum
  unsure (1)..(183): unsure at all Xaa locations
MAPTVMASSATSVAPFQGLKSTAGLPVSRRSNGASLGSVSNGGRIRCMQVWPIEGIKKFETLSYLPPLXSTEALLKQVDYLIRSKWVPCLEFSKVGFIFREHNASPGYYDGRYWTMWKXLPMFGCTGPTGYSTKVEGGQKRSYPGRVISQSRIPTTRPCAFKFPPSSQPSGSPGKGKLHNANI

SEQ ID NO: 2303 - protein, 454 aa, Porphyra lanceolata
  unsure (1)..(454): unsure at all Xaa locations
IKETDILXLFRXTPQPGXXPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSXICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESIVMARNEGRNYVAEGPQILRDAAKTCGPLQTALDLWKDISFNYTSTDTADFVETPTANI

SEQ ID NO: 2304 - protein, 299 aa, Ralstonia metallidurans
MENRVTKAVFPVAGLGTRFLPATKASPKEMLPVVDKPLIQYAVEEAMAAGITEMIFVTGRSKRAIEDHFDKAYELEAELEAKNKQALLDVVRSIKPANVECYYVRQPEALGLGHAVLCAAKLVGDTPFAVMLADDLLDGGKDLPVMKQMVDIYNHYNCSVLGVEEIAPEQSRSYGVIDGREWDDRVIKMSAIVEKPAPEKAPSNLGVVGRYILTPRIFDHIRELKPGAGGEIQLTDAIQSMLDQEQVLAYRYKGVRYDCGSKLGYLKATVEFALRHPEVRDEFSAYLSQRCTSPSSVPA

SEQ ID NO: 2305 - protein, 431 aa, Euglena gracilis
MPVIKTVKARQILDSRGNPTVEVDVILDNGLLGRGAVPSGASTGEYEAVELRDGDKAVYLGKGVLKSVEAVNTIVAPKLVGLDPTEQLKIDNLMRELDGTPNKGKIGANGILGVSMAVCRAAALVKGVPLYRHIGDLHGNKTFQMPVPMCNIINGGKHADNKIDFQEFMVMPVGAANFSEGLRWCAEIFHHLKSILKKAGHVTSVGDEGGFAPNLDNDEALDFVIAAIKAAGFEPGKQIAIALDCASSELFDEGDRKGYKYWKSNPDRLFSAAEMIEKYAGWVAKYPIVSIEDPLDQNDWDGYVNMTKQLGGKIQIVGDDFFVTNPTRFKKGIELAACNSILIKVNQIGTVSETLECIKMAQAAGYTAVASHRSGETEDAFIADLAVGTAAGQIKTGSLSRTDRMAKYNQLIRIEEELGGEAKWTTAMLRK

SEQ ID NO: 2306 - protein, 772 aa, Oryza sativa (japonica cultivar-group)
MSDQERDDIPMLLRNVELPTFPPRSTSMCIPVRDDEYEEDTFVPHTGPLFVQPPTQTAAAGIPFTNTPDMPPRPPQGKQVNKPHAIMPEEIGGNRWSYSGNVPKNEHLMMSGPLGQCDDPDCVNCPPACKNKRHFHRGSSTLDSKFHNFLCEHGGGWKKEIERFLSRIPVMNPHAKVVQQWNQFFVISCLVAIFIDPLFFFLLSVQKDNKCIVLNWHFATALAVVRSVTDAIYFLHMLLQFRLAYVAPESRVVGAGDLVDEPKKIAVRYLRGYFLLDFFVVLPLPQVMILLVIPKYVGLSTANYAKNLLRITVLLQYVPRIIRFVPLLGGQSDSSANGFIFESAWANFVINLLMFVLAGHVVGSCWYLFGLQRVNQCLRNACSASKIPSCDGFIDCGRGINIGKQNQLSRQQWFNDSASTACFDTGDNGFHYGIYEQAVLLTTEDNAVKRYIYSLFWGFQQISTLAGNLVPSYFAWEVLFTMAIIGLGLLLFALLIGNMQNFLQALGRRRLEMQLRRRDVEQWMSHRRLPEDLRRRVRRAERFTWAATQGVNEEELLSNLPEDIQRDIRRHFFRFLNKVRLFTLMDWPILDAICDKLRQNLYISGSDILYQGGPVEKMVFIVRGKLESISADGSKAPLHEGDVCGEELLTWYLEHSSANRDGGRMRFHGMRLVAIRTVRCLTNVEAFVLRASDLEEVTSQFSRFLRNPRVQGAIRYESPYWRTIAATRIQVAWRYRNRRLKRAGMSKLNDQSYNSALERGARECDARQHGRV

SEQ ID NO: 2307 - protein, 253 aa, Oryza sativa (japonica cultivar-group)
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKENPCSFLQLVEKQKVQKQQVQWDQTQPQTSSSSSSFMMREALPTTNISNYPAAAGERIEDVAAGQPQHVRIGLPPWMLSHING

SEQ ID NO: 2308 - protein, 489 aa, Zea mays
MAMRKENPVLNACQASNGRITRAQAAANRRSFGAFPSVPLPAKTERKQTAQGKAKRGSSYDNTSASVALSGPQPKRRTVLRDVTNLSNANSNKSFAAAPKLQTKPSLRTGRTVSKSKPCAKKIPKKPPPAGNGSALTNVLNIAEETQAEKILAERVEPVLLLENRGPLSLQNVERNRDSACHEVFFEERNLRDKCEPSVSKNGDSYVLDIVDIDKDNGNPQMCASYVVEIYSNLMASELMRRPSPNYMEGLQRDITKGMREILIDWLVEVSEEYKLVPDTLYLTVYLIDRFLSRNYIERQRLQLVGITSMLVASKYEEICAPRVEEFCFITDNTYTKAEVLKMESQLLNDLGFNLSVPTTKTFLRRFLRAAQASRKTPSMTLGFLANYLAELTLTEYEFLKFLPSLVAASAVFLARWTLDQSDLPWNQTLEHYTSYKCSDIQLCVCALRELQHNTSNCPLNAIREKYRHQKFECVANLTSPEFPRSFFS

SEQ ID NO: 2309 - protein, 374 aa, Zea mays
MAPTTATKDDSGYGDERRRELQAFDDTKLGVKGLVDSGVKSIPSIFHHPPEALSDIISPAPLPPSSSPSAAAIPVVDLSVTRREDLVEQVRHAAGTVGFFWLVNHGVAEELMGGMLRGVRQFNEGPVEAKQALYSRDLARNLRFASNFDLFKAAAADWRDTLFCEVAPNPPPREELPEPLRNVMLEYGAAVTKLARFVFELLSESLGMPSDHLYEMECTQNLNVVCQYYPPCPEPHRTVGVKRHTDPGFFTILLQDGMGGLQVRLGDGQNGGCWVDIAPRPGALMVNIGDLLQLVTNDRFRSVEHRVPANKSSDTARVSVASFFNTDVRRSERLYGPIPDPSKPPLYRSVRARDFIAKFNTIGLDGRALDHFRL

SEQ ID NO: 2310 - protein, 312 aa, Oryza sativa (japonica cultivar-group)
MVSLMKLLFSALHGCHFCPILFFKWSAILGEHLFEMLYDPLRDKWITLPVMPSQIRNIARFGVASVAGKLYVIGGGSDRVDPLTGDHDRIFASNEVWSYDPLCRLWVQRAPMLVARAMFACCALDGNIIVAGGFTNCRKSISKAEIYNPEADTWEPLPDLRQAHSSACSGLVIKGKMHVLHKGLPTVQILEDGNAWAVEDYSWLQGPMAMVRGELYVLSNSCIMKQRGVNFPDKMVSCASEFQSRIGFGMIGLGDNIYLVGGVIGPGPRNQCIKPLSDVDILNVTSERPTWLPGSPMTHCRGSISGCALLRI

SEQ ID NO: 2311 - protein, 185 aa, Zymomonas mobilis
MERILRENPNFVAEPFLGEKEPHISFEFFPPKNEEADKLLWQSVERLAPLKPRFMSVTYGAGGSTRERTRATVTRIARETTIPAVAHLTCVNASRDEIDDIARDYWDAGIRHIVALRGDPPGGERFQARPDGYANAVELVEGLKRIAPFEISVACYPETHPQALSPEADIEFLKRKFDAGATRAI

SEQ ID NO: 2312 - protein, 238 aa, Zea mays
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTAARPSNKGGATLPCEENAVAKWSNNKLPPSAGATSPSGRRANLAGVAMRQVLHSSSVEISQYLPLLLKLVVLAYAALCLGELLHRWSSGGSCSLSPWCA

SEQ ID NO: 2313 - protein, 505 aa, Helicobacter pylori 26695
MVNKDVKQTTAFGAPVWDDNNVITAGPRGPVLLQSTWFLEKLAAFDRERIPERVVHAKGSGAYGTFTVTKDITKYTKAKIFSKVGKKTECFFRFSTVAGERGSADAVRDPRGFAMKYYTEEGNWDLVGNNTPVFFIRDAIKFPDFIHTQKRDPQTNLPNHDMVWDFWSNVPESLYQVTWVMSDRGIPKSFRHMDGFGSHTFSLINAKGERFWVKFHFHTMQGVKHLTNEEAAEVRKYDPDSNQRDLFNAIARGDFPKWKLSIQVMPEEDAKKYRFHPFDVTKIWYLQDYPLMEVGIVELNKNPENYFAEVEQAAFSPANVVPGIGYSPDRMLQGRLFSYGDTHRYRLGVNYPQIPVNKPRCPFHSSSRDGYMQNGYYGSLQNYTPSSLPGYKEDKSARDPKFNLAHIEKEFEVWNWDYRADDSDYYTQPGDYYRSLPADEKERLHDTIGESLAHVTHKEIVDKQLEHFKKADPKYAEGVKKALEKHQKMMKDMHGKDMHHTKKKK

SEQ ID NO: 2314 - protein, 533 aa, Glycine max
MAGELGVLNALDVAKTQWYHFTAIVIAGMGFFTDAYDLFCISLVTKLLGRLYYTEPGAPKPGSLPPRVQASVTGVALCGTLAGQLFFGWLGDKMGRKRVYGLTLILMVVCSLASGLSFGSTPEGVMASLCFFRFWLGFGIGGDYPLSATIMSEYANKKTRGAFIAAVFAMQGFGILAGGVVALIVSYAYDQKYKLPSYEQNPEASLDPAFDYVWRIVLMFGAVPAALTYYWRMKMPETARYTALVAKNAKQAAADMSKVLQVELEAEEEKVKKLTENESNKYGLFTKEFVKRHGLHLLGTTTTWFLLDIAFYSQNLFQKDIFSAIGWIPPAKEMNAIHEVYKIARAQTLIALCSTVPGYWFTVALIDYMGRFAIQLLGFFFMTVFMFALAIPYDHWSEKENRIGFVVMYSFTFFFANFGPNSTTFVVPAEIFPARLRSTCHGISAAAGKAGAIVGAFGFLYAAQSKDPSKTDAGYPTGIGIKNSLIMLGVINFIGMLFTLLVPESKGKSLEELSGENGENDAEHAVSARTVPV

SEQ ID NO: 2315 - protein, 276 aa, Methylobacterium extorquens
MQHATDLISIIALGLVCAFIGGMLAQRMRLPPLVGYLVAGIAIGPFTPGFVGDPALASQLAELGVILLMFGVGLHFSIGDLLAVRTIALPGAIVQITVATAMGAGLAWGFGWGAGAGLVFGLALSVASTVVLLRALEGQGLLDSDKGRIAVGWLIVEDLAMVVALVLLPALAPSLGGEAMQAAGHHGPPEHGLWVTLGLTLAKVGVFVAVMLVGGRRLIPYLLGLAARTGSRELFTLAVLASAVGIAFASSELFGVSFALGAFFAGMVLAESDLSH

SEQ ID NO: 2316 - protein, 156 aa, Glycine max
  unsure (1)..(156): unsure at all Xaa locations
ASSMIYSPTVTTVNRAGAGMVATFTGLKSMAGFPTKNTNNDITSIASNGGRVQCMHVWPPVGKNKDETHCYLPDLDDAQLAKEVEYLFRKGWIPRLEFXVXHGFMYGEHTRSPGYYDGHYWTMWKLPMVCCTDASKVLNDLXDAKTAYPNGFIRII

SEQ ID NO: 2317 - protein, 256 aa, Clostridium thermocellum ATCC 27405
  unsure (1)..(256): unsure at all Xaa locations
MSRKVIAAGNWKMNKTPKEAVEFVQALKGRVADADTEVVVGVPFVCLPGVVEAAKGSNIKVAAQNMHWEEKGAFTGEVSGPMLAELGVDYVIIGHSERRQYFGETDETVNKKVHAAFKYGLKPIICVGESLTQREQGVTAELVRYQVKIALLGLSAEQVKEAVIAYEPIWAIGTGKTATNEQAEEVCGIIRECIKELYGQDVAEAIRIQYGGSVNAANAXXXXXXXXXXXXXXXXXPNKTIEKGNCIICSFLFCFL

SEQ ID NO: 2318 - protein, 181 aa, Leptospira interrogans serovar lai str. 56601
MKIKWFIFVFLFSVSWLQAEPFQLKSPELTSVKLIANEQVFNGFGCSGGNISPSLSWTGLPKDTKSIALTVYDPDAPTGSGWWHWVVFNLPSTITSIPANAGNLEKNLLPKEAIQSRTDFGTSGYGGPCPPKGHKPHRYYFTVYALKDKIPADQNSSGALIGFYINQLKIGEAQILAKYGR

SEQ ID NO: 2319 - protein, 738 aa, GIBBERELLA ZEAE PH-1
MTEQVTGAIKHAVMGHKNDKIDQLKANMVEPNENSRITSDYGVKQNNTDQWLRVASEDQTGPSLLEDAFGREKIHRFDHERIPERVVHARGAGAHGTFRLFESAADVTKAGLFTDTSRETPVFVRFSTVLGSRGSADTVRDVRGFAIKFYTQEGNFDIPGNNIPVFFIQDAMKFPDVIHAGKPEPNNEVPQAQTAHNNFWDFMFEHPEATHMHTWAMSDRTIPRSYRMMQGFGVNTYTLVNEKGERRFVKFHWTPELGVHSLVWDEALKLAGQDPDFHRKDLQEAIENGAFPKWKFGIQVLDESQEHDFDFDILDATKVWPEDLIPVRYIGELELNQTVDEYFTQTEQVAFCTSHLVPGIGHSDDPLLQGRNFSYQDTQLSRLGTNWEELPINKPVCPVMNFNRDGAMRHTITKGKVNYWPNRFSHQPPATESEGAYVDYAAKIVGMKQRTLSKKFKDHFTQAQLFYNSLSEIEKSHVQAAYSFELDHCDEAIVYERLTERLGEIDGDLANTIAEMVGGKKPANPKPNAGKKAKNLSQLDFVPETPTIKSRRIAIIIADGYDPVAFNAMYGAIKAQSALPFVIAPRRAPIFSAAEDSSSSKGIFPDHHLEGQRSTMFDAIFVPGGAKSIETLSKNGRALHYIREAFGHLKTIGGTGEAVEFINKAIQLSEVALSSTDGSGVVDSYGVVTLKNASPDTLKEIATVASDAKGFLEKFVYNVSCHRNWQRELDGLSTMVAY

SEQ ID NO: 2320 - protein, 88 aa, Zea mays
  unsure (1)..(88): unsure at all Xaa locations
LAPRRPIILDLVLLAELSTRIQLKPEGTDKFHSFHPVATILSYLTKAXLVPPGTPVVNALAKQRAMLENIMRACVGLAPENNMILEYK

SEQ ID NO: 2321 - protein, 304 aa, Helicodiceros muscivorus
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSFYVGEGFVGDVPLSKKILAGLTTGALAITVANPTDLVKVRLQAEGKLSPGIPRRYSGALNAYSTIVKQEGLGALWTGLGPNIARNAIINAAELASYDQVKQTILKIPGFSDNIFTHILAGLGAGFVAVCIGSPVDVVKSRMMGDSTYKSTLDCFIKTFKNDGPLAFYKGFIPNFGRLGSWNVIMFLTLEQVKKVFIKEAP

SEQ ID NO: 2322 - protein, 298 aa, Schizosaccharomyces pombe
MGNVQSQEGETRAHAVPSQDATTTPDNANNVPKEPRAQSMISIAADDLNQEGEMSDDNQQEGGNNRTSQNGTSGSSGHTKRRSQTSGKKTHQPYSGPCVPTIIRWRGGGEVVYVTGSFSRWKKKIQLLKSEDYTVLLQLRPGTQRFKFLVDGIWCCSSDFPTATDAEGNLYNYLEVEANEKLGASIDERLSQVHTDLPMEEKSESEQYSTEIPAFLTSNTLQELKLPKPPSLPPHLEKCILNSNTAYKEDQSVLPNPNHVLLNHLAAANTQLGVLALSATTRYHRKYVTTAMFKNFDV

SEQ ID NO: 2323 - protein, 428 aa, Chlamydophila pneumoniae J138 [sequence omitted]

SEQ ID NO: 2324 - protein, 300 aa, Amphidinium operculatum
RIGRQVARIAMKDPETDLKLINASYDADYLAYMFKYDTIHGQYDGTIEVDGDSLVVDGQKIALSHTRDPGEIPFGKEGAEYVCESTGVFLTADSVKPHLKAGAKKIVFSAPAKDDSHTIVMGVNEDTYKTSMTEVSCASCTTNGLAPAVRVLEEGWGVKRGLMTTCHAMTASQPTVDGTSKKDWRGGRAGPGNIIPSSTGAAKAVAKVIPAVAGKLTGMALRVPTIDVSVVDLTVELEKETTYEEICAEMKRRSEGDMKGYLGYTDEALVSTDFETCPISCTFDSKAGIMLDPTFVKVVC

SEQ ID NO: 2325 - protein, 724 aa, Saccharomycopsis fibuligera
MLKSSLYRGAALRAAIKSSSGSRASLYKAAAITLHNTNASSFAIRSNSSQAALREEPSPAFNQTTPEESRKALNSFLSQQQSKSASASASASSAASAAAAGAESAAEKNASAAAAAMDDSFVGLTGGEIFHEMMLRHKVDTVFGYPGGAILPVYDAIYESKNFNFVLPRHEQGAGHMAEGYARATGKPGVVLVTSGPGATNVITPMADALMDGVPLVVFTGQVPTSAIGTDAFQEADVIGISRSCTKWNVMVKSVSELPRRINEAFEIATSGRPGPVLVDLPKDVTAAILRDPIPTNSTLPSKTLASITKHAVTQFAEESIKEASDLLNVAKKPVLYVGAGILNHPDGPKLLKELSEKAQIPVTTTIQALGAFDQRGEKSLDMLGMHGSAFANLAMQNADLIIALGARFDDRVIGAVSKFAPNAKLAAANHRGGIIHFEISPKNINKVVEADVAVEGDVTRNLRKFLPLINQVEATDPARAAWFKQIASWKAQYPYAYLKETPESKIKPQTLIQELSDKCLELDKDVVVTTGVGQHQMWAAQHFTWTQPRTFITSGGLGTMGYGLPAAIGAQVGRPDAVVIDIDGDASFNMTLTELSTAAQFNIPVKIIVLNNEEQGMVTQWQSLFYEHRYSHTHQSNPDFVKLAEAMGVKAMKLTKQGELHSTLDEFLQYSAGPVLLEVEVEKKVPVLPMVPGGKGLDEFIYFDPEVERQQNELRRKRTNGKH

SEQ ID NO: 2326 - protein, 46 aa, Gossypium arboreum
TNLCLRACMTCCDRCKCVPPGTYGNREMCGKCYTDMRTHRNKHKCP

SEQ ID NO: 2327 - protein, 645 aa, Agrobacterium tumefaciens str. C58
MDCFSQYTRDSFRTTPAEAKIAFSHTDENPLRDSAEQSRAGQTRFLRSLGVDKSHIAAFKQRALENGSTVDEELLMSGLVTADVYFSAFAEYLRLPFLPEIASERVANLDNLDLQLTEPRLLRLIPQDGKMGLLIVPELARLDLLTNILDELPHLFDELAVTTPQAMRDAIWKAGEARRLAETRQRLFNAAPQHSAKITLHGQQGFYGGVLATLLVLSLLTYSEIALAWLHATLSMLYLNTLLFRLFALIHIPRETDVETALSLRHENELPVYTILVALYREEAVIEQLVSALERLDWPRSRLDIKLVCEADDGATIEAIRRINPGPHMEIVQVPPSEPRTKPKALTYALSGARGTFVVVYDAEDRPHPQQLREAYAAFRNQPEDMACVQAPLIISNASSSWLSACFALEYAGLFRCMLPALATHGLPLPLGGTSNHFRTAALRRAGAWDPYNVTEDADLGLRLHRLGYRCGVIRRQTLEDAPTSLPVWLNQRTRWFKGWLQSWLVMTRTPFATARTMGWFAYMTFQLLIGGMLLSSLTHPLLFVSLVFMAIAIRENGVDLLFRWQGALFFIDALNIVGSYTIFVLMGRSRMIAYERRQVGRRWLAMPLYWLMLSVAAWRAVVELKTRPFVWNKTPHVPVAKDKT

SEQ ID NO: 2328 - protein, 262 aa, Oryza sativa
  unsure (1)..(262): unsure at all Xaa locations
MSTAVARGGMMPAGHGFGKGKAAAVEEEEDEVNGFFVEEEEEEEEEEEAAVSDASSIGAASSDSSSIXGENSSSEKEGEEEGEEVESKAKEVAVEVEGGPPRLHGLGTLESLEDALPIKRGLSNFYAGKSKSFTSLAEAAAKAAAKEIAKPENPFNKRRRVLAAWSRRRASCSSLATTYLPPLLAPDHAVVEEEDEEDDSDAEQCSGSGGGNRRREPTFPPPRLSLHAQKSSLTPRSSNPASSFRSPRSFSLSDLQNAGSYN

SEQ ID NO: 2329 - protein, 158 aa, Triticum aestivum
LSHDSSGFEFFIIMLSNSLKKLRMPDKFAKVLAGREPREVKLREAGSGRRSLWDVKVVLDADGHTYLGRGWERFARAHDLRLGYFLVFSYDGDAVLTVKVFDVSMCRRHYKHHDDDDASSGSSSDSGGSSSAEVEVDDAPTSQFTNVPLEFHEAHGYA

SEQ ID NO: 2330 - protein, 495 aa, Pisum sativum
MALQVLTLPSWVTLFTTFAILLLFSRRLRRRQYNLPPGPKPWPIIGNFNLIGTLPHQSLHGLTQKYGPIMHLWFGSKRVVVGSTVEMAKAFLKTHDATLAGRPKFSAGKYTTYNYSDITWSQYGPYWRQARRMCLLELFSAKRLESYEYIRKQELHVFLHELFDSRNKTILLKDHLSSLSLNVISRMVLGRKYLEKVENSIISPDEFKNMLDELFLLNGILNIGDFIPWIHFLDFQGYVKRMKVLSKKFDGFMEHVLEEHIERRKGVKDYVAKDMVDVLLQLAEDPDLEVKLERHGVKAFTQDLIAGGTESSAVTVEWAISELIRKPEIFKKATEELDRVIGRERWVEEKDIANLPYVYAIAKETMRLHPVAPMLVPREAREDCNINGYDIPKGSLILVNTWTIARDSNVWDNPNEFMPERFLGKDIDVKGHDYELLPFGAGRRMCPGYPLGIKVIQSSLANLLHGFNWRLSDDVKKEDLNMEEIFGLSTPKKIH

SEQ ID NO: 2331 - protein, 175 aa, Oryza sativa
MAPSVMASSATSVAPFQGLKSTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 2332 - protein, 347 aa, Oryza sativa (japonica cultivar-group)
MRSMFLPVLPLRACGTGTTAPVPPPTASLRRELALSPNLPARGGVAGQPNAATREAPAAAVSSARRVVVVSPSLARRRRTRPPPPPPPPLLFSPRVFSASPPFGLIPRMRSLRLRSGRRRGESGGDQAGALILSWVDANYRGYLDEQFCQVEDLQDEASPNFVEEVVTLFFKDSGRLMSNIEQALCMRSFQKVKREHAVLRQKLESYFQLCSCTWAEEQKGILADDRLAKKPSRQYSMEKGSATNRAIPDFRSAAAMSDAMRRARRRSPCHARNTRNGTRRAGARPDPEPSRQPIRVLGGRSLSVDETWVTSPAAAVFLRHGETRAPAFALGTAGRRRGEDDMSVIR

SEQ ID NO: 2333 - protein, 852 aa, Aspergillus fumigatus
MEKTCKRAGLLIVWPRGFIDGYCDSLLQKELVRHVETTLARSLYNCDELAAYSGTALAFRDRLIIEWNKTQQRQSFADQKRVYYLSLEFLMGRALDNAMLNVGMKDAAREGLKDLGFRIEDVINQEHDAALGNGGLGRLAACFLDSMATLNYPAWGYGLRYRYGIFKQEIVDGYQVEIPDYWLDFNPWEFPRHDITVDIQFYGWVRTYQDENGKTIHSWQDGEAVQAVAYDVPIPGYGTRTTNNLRLWSSKAASGEFDFQKFNAGDYESAVADQQRAETISAVLYPNDNLERGKELRLKQQYFWCAASLYDIVRRFKKTKRAWSKFPEQVAIQLNDTHPTLAIVELQRILIDQEGLEWDEAWTIVTKTFGYTNHTVLPEALEKWSVPLMQNLLPRHLQIIYDINLFFLQSVEKRFPSDREMLSRVSIIEESHPKMVRMAHIAIIGSHKVNGVAELHSDLIKTTIFKDFVKIYGPDKFTNVTNGITPRRWLHQANPRLSDLIASKLGGYDFLKDLTLLDQLEAYVDDKAFRAEWSEIKTANKLRLAKHIKDTTGYSVNPNALFDVQVKRIHEYKRQQLNIFGVIHRYLIIKAMSREEKEKLVPRVSIFGGKAAPGYWMAKTIIHLINRVAAVVNNDADVGDLLKVIFIEDYNVSKAEIICPASDISEHISTAGTEASGTSNMKFVLNGGLIIGTCDGANVSLTRSTLFDMLLTGALQIEITREIGEQNIFLFGTLAEDVEELRHRHFYGDFQLDPQLSKVFEAIRSDMFGDASNFSALMSAIAEHGDYYLVSDDFNSYITTQEIVDEAFKNQDEWIAKSITSVARMGFFSTDRVISEYADSIWNIEPLEIRDD

SEQ ID NO: 2334 - protein, 510 aa, Schizosaccharomyces pombe
MISKLLKIVLLTAGVIGNTLADSRIHEQYLVKAFPNEPVDYEGRMHAGHLNQTDQLDGDLFFWMFESVKPEYEHRSILWLNGGPGCSSEDGSLMEVGPFRLDDNNTFQLNPGRWDELGNLLFVDQPLGTGYSYSLAKDFQSNNEKMANDFSIFFEKFLEEFPERANDEWFIAGESFAGQYIPHIAAKLKEKNLVNLGGLAIGNGWINPLSHYETYLNYLVEKGMVDFESELGQYLHHSWAECLLAFDKIGSGSGDLSKCESFLGDILYMVSKEPGKACMNMYDISLESTYPTCGMDWPYDLSYLTEFLSTREAMTSLNVNLEKVHDWEECNDDVALQYAREGIESSSKLIQDLVSTVPILLFYGENDFLCNYLSGEKLTRSLEWNGAVGFQNQSAQPFYLPGYSDQPSGSYVSSRNLTFARIVEASHMVPYDHPNEMKTLITAFFNNDFASLPSVPKPSPDLGNGNYKWLYLGLIPVALTIIILFSIYLCRRFGLFGLSKQRYQPISPTP

SEQ ID NO: 2335 - protein, 131 aa, Zea mays
  unsure (1)..(131): unsure at all Xaa locations
FFQACGTVHRVPFFSAKFGHPKGFAYVEFLEQKPVQEVLNLNEWELHGRQIKVAPKRTNVPGMKQGPPPGFNPSHGSPYSSYGAPFFPPXGFGGAPKFPPPLGSSPFFLRTGGGIMFNANPPMVCGRFQEN

SEQ ID NO: 2336 - protein, 429 aa, Methylobacillus flagellatus
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLSRQCARAVGDPDRAGRYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEAKPRKRAQTTSQSASA

SEQ ID NO: 2337 - protein, 375 aa, Oryza sativa
  unsure (1)..(375): unsure at all Xaa locations
TSGSPGCRLTANSLTVSADKTAKVWDILXDASGKLNRTLACPSRVDLDVRLVGCLWQNDYLVTVSLGGTFNVFSASNPDKEPVTFAGHLKTVSSLAFFPQSNPKTILSTSYDGVIMRWIKGVGYGGRLMRKNNTQIKCFTVAEEELVTSGYDNKVFRIPLNGDQCGDAESVDVGGQPNALNLAIQKPEFALVTTDSGIVLLHKSTVISTTKVNYTITSSAVSPDGTEAIVGAQDGKLRIYSINGDTVTEEALIEKHRGAITCIHYSPDVSMFASADANREAVVWDRATREIKLKNMLFPSARINCLAWSPDNRLVATGSLDPCAIVYEIDKPASSRIPVKGAHLGGVHGLTFVDNDSLVTAGEDACIRVWKLVPQ

SEQ ID NO: 2338 - protein, 291 aa, Acinetobacter lwoffii
MIKKAILPVAGLGTRFLPASKSIPKEMVTVVDRPAIEYVVREAVEAGIEQIILVTHSSKASIENYFDRNFELETILEQKKKFDLLKEITDILPKHVSVISVRQPQPLGLGHAVLCAKDVIGNEAFAVLLPDVLVKDAEADNDLSRMIRRFEQSNAAQIMVEAVPDHLVDQYGIVDVENSPNEGESIVMQGIVEKPSVGTAPSNLSVVGRYILPAQIMALLENTPRGAGNEIQLTDAIAALQQSETVEAYRMKGQTFDCGSKIGYLKAVLHYGIEHPKLGEEFKGLIRELAL

SEQ ID NO: 2339 - protein, 430 aa, Azospirillum brasilense
  unsure (1)..(430): unsure at all Xaa locations
MSDISNVFDLIKEHDVKYVDFRFTDPRGKLHHTVQHVSTIDEDVFEDGIMFDGSSIAGWKAINESDMILQLDPTTAVMDPFSAQPTLNILCDVYEPSTGQPHARCPRGIAKAAEKHMASAGIGDTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGXDGIQNKIHPGEAMDKNLYDLPAEELAKVPTVCGSLREALDSLKADSAFLQ

SEQ ID NO: 2340 - protein, 361 aa, Kluyveromyces lactis
MPAQDVLTRKTGVIVGDDVKALFDYAKEHKFAIPAINVTSSSTVVAALEAARDNKSPIILQTSNGGAAYFAGKGVSNEGQNASIRGSIAAAHYIRSIAPAYGIPVVLHTDHCAKKLLPWFDGMLKADEEYFAKHGEPLFSSHMLDLSEETDEENIGLCVKYFTRMAKIHQWLEMEIGITGGEEDGVNNEGTSNDKLYTTPETVFSVHEALSKISPNFSIASAFGNVHGVYKIAAALKPELLGTFQDYAAKQLNKKAEDKPLYLVFHGGSGSSTKDFHTAIDFGVVKVNLDTDCQFAYLSGIRDYVLNKKDYLMTPVGNPTGEDSPNKKYYDPRVWVREGEKTMSKRITQALEIFRTKGALE

SEQ ID NO: 2341 - protein, 392 aa, Oceanobacillus iheyensis HTE831
MQSLYKSNIVRNMPPYLFAHIQKKKQKLMEQGSDVIDLGIGAPDLPPPSYIIEELSKHIKNRHLHRYSPYQGIPELRQAVATFYQEKYNVTLDPEEEILILIGSKEGLVHLIQSVINPGDKVILPDPGYPVYKMGVHMTQGRAVYLPLDKNKEYKPNWKMLSEQDKEEAKLLFLNYPNNPTGATAQKETFVKAVQIANKYNICIAHDAAYDHVTFSDYKSPSLLQVDGAKKVGVELGSLSKNFNMTGWRIGYIVGNSSVIQALATLKSNIDTSQFIPVQIAAIKALEQSEDEIRTIHHTMEKRMLKTWKLLKNAGFEVKKTKGTIFLWVKVPKGYTSSSFTEQVLDQAHVIVTPGSAFGEQGEGFFRIALTVPEERLIEAVQRIDSWLNGGK

SEQ ID NO: 2342 - protein, 213 aa, Glycine max
  unsure (1)..(213): unsure at all Xaa locations
EDPAGSKVDSLDYVWRIILMFGAVPAALTYYWRMKMPETARYTALVAKNAKQAASDMSKVLQVEVEAEEDKLQHMVESENQKYGLFSKEFAKRHGLHLVGTTVTWFLLDIAFYSQNLFQKDIFTAIGWIPPAQDMNAIHEVYRIARAQTLIALCSTVPGYWFTVAFIDIIGRFAIQLMGFFFMTVFMFALAIPYNHWEDHNXLGFVVMNSFTF

SEQ ID NO: 2343 - protein, 412 aa, Zea mays
MAAMPGGAHGAGAADPMQVDQPLPPAAAGTAHAPADAKHAGSMIEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTLLPTAGP

SEQ ID NO: 2344 - protein, 2132 aa, Emericella nidulans
MAFPGGELPEGRHSSESSGNNSGLSQETIRDDGRRYGRIVPSGRSISPHSKDDGSDRLELPAPRPPSLGAPNDLYTSMFSWGSPDISPTDVRKNQGFGSHRKALAVLGNDDPGPPPINNPSPRVNTNYGDYFQHDPQGTLSYSPRLGTGDAHGTFFHDHSEHEASPATATFRPGTGRTLASDAPDLDYNGDHRRPSVASATTVSSQGSKSSTSGLFRKKLQGFFGDDPNASDSKQDHDGHHSSGSKPSSIDYFRSRQRADSEGSRRPSDGVQDDAHQPGRPRTPLPSSDITPWEYQRYNDIPQLGEAPVREAPTALDRHRIGSQGASSTSRDPTRRHFSGHRHSRSKEEKANAAGDLAGYPDRPSTGRDDFSVGLRPSRDGSLGFRPAANSSINLAGRSTSPTPSLQSFYTKDSGQGSPGAPSSKRSFLGKLRRPNLKHFPGSKGPTDAIRGTSKLARRDASPGRRGRQGSLEGAPSKGAENGEHERKKDGKGLGIATGKLRGRRGAGHETPIGKETNPSEAPGVWALDTDLSHMEGIVQPAADDGDKTNEGKTVRHDEKRLGDQLGAGNWDAPESWHVKRQRNEVLAKVPKMTNDAARTIAEPDGVPYFIRVFRIDGTFATLSNGLHATVADVLLSLGKKSFLTDHLNNYEIVMRKNDISRQLDPNEQPILMQKKLLEQIGYTEKDRIEELGREDHSYILRFTFLPTKLSGYSSLEGEPGFSKNQKFSHVDLQGRSLVTIPIALYKKAPEIISLNLSRNLELDVPKDFIQGCINLREIKYIGSEALRLPPSFSLASRLTYLDVSNNFLDQLDHANLDRLQGLVSIKLANNRLTKLPDYFGNFKSLRSLNIASNNFQVFPEFLCNLKSLVDLDISFNNISELPNIGNLTSLERLWMTNNGFRGPFGESIKDLVNLKEIDARFNEIVNIDSLTLLPRLEQLLIGHNSVSKFRGSFPKLRNLVLDHCPVTQFDIDAPMPTLTSLNIASAKLVQFRDTLFDSLPNLTKLILDKNHFMSMSPHIGKLRKLEHFSMAKNPLSSLPPSIGCLTELKYLNLRECNLRRLPQEIWYCLKLETLNVSSNVLDSFPKHGGPPPQLPGEATAGTTPAMTPGGSVTPSYDDLGTVEEQETRRPSQASGSAPSGSSPGGGSTRKPSVASSLSQGGRKVSTASKFAEGSPSSRKDSNFSQHVATTFGGSLRNLYLADNRLEDDVFRELSFIPELRIVNLSYNVLNEIPPGLLKRWPLLTELYLSGNELTSLPSDDLEEGSSLKILNINANRFQVLPAELCKVSKLSILDVGSNYLKYNVSNWPYDWNWNWNRNLKYLNFSGNKRLEIKPNVSSLGSQPPNGADLTDFNSLTHLRVLGLMDVTLTTSNIPEENEDRRVRTSASLAGSLAYGMADFLGRSEHLSIIDMIVPRMRQDNVETVVGMFDGQPSSTGGSRVAKFLHENFLHTFSAELKRLRRDEQETPLDAFRRTFLTLNRNMAFACYKSIDQDVRLFQEDSSDQKKVRLNKEDLQSGGVATVLYLNNTDLYAANIGDAQAILVKSDGSMRYLTRNHDPAEAGERARIRAAGGFVSRNGRLNDYLPVSRSFGYFNLMPAVIAAPHTMHVSLTEQDEMIILASKELWDYVTPDLVVDVTRAERRDLMVAAQKIRDLALSFGANNKLMVMILGVGDLRKRERRPPRFPSMNSFSQVDDSILPSPKRTKKPRDMPGDSRLARFDYVDAPTGELAIIFTDIKQSTGLWETCPDAMRSAIQIHNDILRRQLGIIGGYEVKTEGDAFMVAFSTTTAALLWCFNCQYQLLEAEWPTEILEQPQCQVQFDMENNIIFRGLSVRMGIHWGEPVCEKDPITNRMDYFGPMVNRASRISAVADGGQIFVSSDFMNDMQRNLELFADSERAASTGSEESYALDLGDNIRRELQQLNSQGFVIKDQGERKLKGLENPEPLYLIYPHALSGRLSTQDQMSGEESTPTTISQHSQLQIQTEAIWRLWEITLRLERLCGALEHPGEPRLDKPNSALFDIIKKHGGELADSSVVSLIEQQVTRIEVAISTLALRHMLRPFKPGDRLDDHAAPIGDVLQELRTQLAEYRALKEQIATNGAGITGASPSSTATDLHYTPDFHSSASSSSFT

SEQ ID NO: 2345 - protein, 555 aa, Prochlorococcus marinus subsp. pastoris str. CCMP1378
MTNNKFKNRIKKIKRGFLIWRILILLLVNLWLDNLIFKIFQTKRDKKNKVQIRRAKWFTNQLIELGSAFIKIGQLLSARPDLIPNTWIQELSKLQDQVPQFSYTKVEEIIQKELGHKFSEINQITSTPIGSASLAQVHKATLKDGKEVVFKVQRPNLKNLFTIDLSIMQQIAFIIQKNKNWSRGRNWVAIAKECRKVLMKELDFKCEAQYAARFRQQFIDDENVEIPEVIWNLSTERVLCLSYLEGTKISDVEKLKSKNIDLSKIAEIGAVSYLKQLVNYGFFHADPHPGNLAVSNSSKLIFYDFGMMGNISNNLQASLGSMVQSAALRDASSLVTQLQQAGLISKNIDVGPVRRLVRLMLKEALTPPFSPNIIEKLSGDLYELVYETPFQLPVDLIFVMRALSTFEGVGRMLDPGFNLVSITKPYLIDLMTSNNQTPNDLINQFGRQVGELGSKAVGIPKRIDESLERLEQGDLQLQIRMGESDRQFKKMFTAQKSLGHSILIGSLTIASALLVTNNQNNFAVLPLIFAAPISIDWIKCQLSMRKGSRIEKLKQ

SEQ ID NO: 2346 - protein, 792 aa, Methanosarcina mazei Goe1
MEEIQLKVEKAYPIDLGRGIIRLDPTALLKLQLSPGDIVEIRGKKKTTAKVWRADRQDWEQGIVRIDNFIRQNAGVSIGEKVTIKKVEAPEAKKLILALPESMTQGGPELQFGEHANEIIKRHILKRPVFKGDIIPIINSMSQPMTESLTTSQVIPLVAVETDPANTIVLITETTNIELRKKPVQGYEKATRGVTTYEDIGGLGDEIMRVREMIEMPMKHPELFAHLNIEPPKGVILYGPPGTGKTLIAKAVANESGASFHYIAGPEIVGKFYGESEERLRKIFEEATQEAPSVIFIDEIDSIAPKRENVTGEVERRVVAQLLTLLDGMEERGQVVVIGATNRVDAIDPALRRPGRFDREIHIGVPDTKDRYEILQIHTRGMPIEKDEESVTGEPAPEVEIGALDEFEVETGTEIEVDEAAMEREKKEKTNLYLMSLAERTQGFVGADLLALVQEAAMRCLRENLPDLDLEIDTIPPERLEKIVVTKKNFEDALMEAEPSALREIFVEMPSVSWGDVGGLDEAKHSIIEAVEWPIKNPEKFVKMGIKAPKGILLYGPPGTGKTLIAQAVAKESNANFISVKGPEMFSKWLGESEKAIRETFKKARQVSPCVVFFDEIDSIAGMQGMESTDSRTSERVLNQLLTEMDGLETLKDVVIIAATNRPNLLDPAILRPGRFDRLVYVGAPDRKGRLRIFKIHTQNTPLAEDVNLENLADTTEGYVGADIEAVCREAVMFALRENFDIEAIEMRHFREALKKVKPTINENIAQFYEKIEEQFKGGQRPVETAGLVGYR

SEQ ID NO: 2347 - protein, 287 aa, Streptomyces peucetius
MTASTPHHGTPRGGLSGRTVLVTGATSGIGRAAALAVARQGARVVLVGRDPERLRTVTNEVARTAGPAPDAFRADFAELRQVRDLGERLRDRYPRIDVMASNAGGMFWSRTTTQDGFEATIQVNHLAGFLLARLLRERLAGGRLILTSSDAYTQGRIDPDDLNGDRHRYSAGQAYGTSKQANIMTAAEAARRWPDVLAVSYHPGEVRTRIGRGTVASSYFRFNPFLRSAAKGADTLVWLASAPAEELTTGGYYSDRRLSPVSGPTADAGLAAKLWEAGAAAVGDTAH

SEQ ID NO: 2348 - protein, 246 aa, Larix gmelinii
YTYTLRNKGPEDVIVRVIYCGICHSDLVQMRNEMGMSHYPMVPGHEVVGIVTEVGSEVKKFKVGEHVGVGCIVGSCRSCGNCNQSMEQYCSKRIWTYNDVNHDGTPTQGGFASTMVVDQMFVVRIPENLPLEQAAPLLCAGATVFSPMKHFGMTEPGKKCGILGLGGVGHMGVKIAKAFGLHVTVISSSDRKKEEALEVLHADAYLVSKDAEKMMEAAESLDYILDTIPVSHPLEPYLALLKTNGK

SEQ ID NO: 2349 - protein, 88 aa, Triticum aestivum
  unsure (1)..(88): unsure at all Xaa locations
MVVFDVCVYCNIDNLWDAVAKLGEISXNEKAGFISLVSRYLSGEADQIEWSKIQTLTDEVVVLYDTLAPFSEDLDALKALLDKLVVLK

SEQ ID NO: 2350 - protein, 297 aa, Yersinia pestis CO92
MTKLKAVIPVAGLGMRMLPATKAIPKEMLPIVDKPLIQYVVNECVAAGINEIILITHSSKNAVENHFDTSYELEAMLEARVKRQLLDEVQSICPPGVTIMHIRQGHPEGLGHAVLCAKPLVGDSPFVVLLPDVLIDDEQSDLTRDNLAQLVQRFEETGVSQVLVHSVDPETLSNYSVVSCEKSTLLPGESSRINAMIEKPQSSADLQSNLSAVGRYVLSAHIWPLLEQTKPGAWGRIQLTDAIDALAAVEAVDAVALTGKSYNCGEKLGYMQAYVAYGLRHPQQGAEFKAWLKDFVA

SEQ ID NO: 2351 - protein, 311 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDALWKLECALRLQESVI

SEQ ID NO: 2352 - protein, 353 aa, Euglena gracilis
MAPVKIGINGFGRIGRMVFQALCDQGLLGTTFDVVGVVDMATDADYFAYQMKYDSVHGKFKHTVSTKKSDANLAEADIIVVNGHEIKCIMATRNPEDLPWGKLGVEYVVESTGLFTEADKARGHLKAGAKKVIISAPGKGDLKTIVMGVNHTEYQASMDVVSNASCTTNCLAPLVHVLLKEGVGVEKGLMTTIHAYTATQKTVDGPSKKDWRGGRAAAINIIPSTTGAAKAVGEVLPAVKGKLTGMAFRVPTPDVSVVDLTFLAEKDTSIKEIDSLLKKASQTYLKGILGFTDEELVSTDFVHDNRSSIYDSLATLQNNLPGEKRLFKVVSWYDNEWGYSNRVVDLLKHMSGN

SEQ ID NO: 2353 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMKGAKLL

SEQ ID NO: 2354 - protein, 354 aa, Nitrosomonas europaea ATCC 19718
MALVSLRQLLDHAAENGYGLPAFNVNNLEQIHAIMQAADECDSPVIMQGSAGARKYAGEAFLRHLIAAAVEAYPHIPVVMHQDHGASPAVCINAIRSGFSSVMMDGSLEEDGKTPSSYEYNVDVTSKVVAMAHAVGVSVEGELGCLGSLESGQGEAEDGHGAEGQLSHDQLLTDPEQAADFVKQTGVDALAIAIGTSHGAYKFTRKPTGDILAIQRVKEIHERIPNTHLVMHGSSSVPQEWLEIIREYGGDMKETYGVPVEEIQQGIKYGVRKVNIDTDIRLAMTGAIRRHLAKNKSEFDPRKFLKDATAAAKDICKARFEAFGSAGQAGKIKPISLETMANRYLRGELKAIIK

SEQ ID NO: 2355 - protein, 481 aa, Haemophilus somnus 2336
MNIQHLLKTQAYINGEFISAKNHRTFPVINPANQQVICEITCCGKEETELAIKSAKQAQVHWKKYTAKERSKILKKWFELIMQHQESLAYLLSLEQGKPLSESRAEIAYGASFVEWFSEEAKRAYGEIIPQVREENRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 2356 - protein, 399 aa, Arabidopsis thaliana
MASATFSVAKPSLQGFSEFSGLRNSSALPFAKRSSSDEFVSFVSFQTSAMRSNGGYRKGVTEAKIKVAINGFGRIGRNFLRCWHGRKDSPLDVVVINDTGGVKQASHLLKYDSTLGIFDADVKPSGDSALSVDGKIIKIVSDRNPSNLPWGELGIDLVIEGTGVFVDRDGAGKHLQAGAKKVLITAPGKGDIPTYVVGVNAELYSHEDTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDAAEKELKGILDVCDEPLVSVDFRCSDVSSTIDSSLTMVMGDDMVKVIAWYDNEWGYSQRVVDLADIVANNWK

SEQ ID NO: 2357 - protein, 335 aa, Caulobacter crescentus CB15
MAVRVAINGFGRIGRLVLRSIAEHGRRDIEVVAINDLGPVETNAHLLRYDSVHGRFPGVVTSGEDWIDVGMGKIKVTAIRNPAELPHKDLGVDIAFECTGIFTSKEKAAAHLEAGAKRVLVSAPCDGADKTIVFKVNDDTLSADDLVVSNGSCTTNCLAPIAKVIHDLVGIERGYMTTIHSYTGDQPTLDTMHKDLYRGRAAALSMIPTSTGAAKALGLVLPALKGKLDGSSIRVPTPNVSVVDLKFVPGRETTVAELNDALKAAAAGPLKGVLGVTDEALVSTDFNHIAESSTAALAQTQVIEGKLGRVLSWYDNEWGFATRMSDTALVMAKFL

SEQ ID NO: 2358 - protein, 790 aa, Neurospora crassa
MDGGNRCYSPSITTTNMKSSWASYCLLSCTSALVSAIDLPFQTYPDCVNGPLASLKVCDATLSPPQRAAALVAAMTTEEKLQNLVSKSKGAPRIGLPAYNWWSEALHGVAYAPGTQFRSGDGPFNSSTSFPMPLLMAATFDDELIEKVGEVIGTEGRAFGNAGFSGFDYWTPNVNPFKDPRWGRGSETPGEDILRIKRYAASMIRGLQGPLPERRVVATCKHYAANDFEDWNGSTRHDFDAKVTLQDLAEYYLSPFQQCARDSKVGSIMCSYNAVNGVPACANTYLMQTILREHWNWTAPGNYITSDCEAVLDIFANHHYAKTNAEGTALAFEAGTDSSCEYESSSDIPGAWTQGLLEQSTVDRALTRLYEGLVRVGYFDGNHSEYASLGWKDVNSPKSQEVALQTAVEGIVLLKNDQTLPLGLKTDPKSKLAMIGFWANDPKTLSGGYSGKPAFEHSPVYAAEAMGFNVTTAGGPVLQNSTSNDTWTQAALEAAQDANYILYFGGLDTSAAGETKDRTTINWPEAQLQLIKTLTKLGKPLVVVQMGDQLDNTPLLATKTVNSILWANWPGQDGGTAVMQILTGLKSPAGRLPVTQYPANYTAAVPMTDMNLRPSDRLPGRTYRWYPTAVQPFGFGLHYTTFQAKIAAPLPRLAIQDLLSRCGGDNANAYPDTCALPPLKVEVTNSGNRSSDYVVLAFLAGDAGPRPYPIKTLVSYTRLRDVSPGHKTTAHLEWTLGDIARYDEQGNTVLYPGTYTVTVDEPAQASASFVVEGEAVVLDRWPAPSGQVVV

SEQ ID NO: 2359 - protein, 369 aa, Arabidopsis thaliana
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 2360 - protein, 358 aa, Edwardsiella ictaluri
MSKIFDFVKPGVIFGDDVQEVFQVAKENKFALPAVNCVGTDSINAVMEAAAKVRAPIIVQFSNGGAAFIAGKGLKLEGQQGAILGAIAGAHHVHQMAEYYGVPVILHTDHCAKKLLPWLDGLLDAGEKHFAATGKPLFSSHMIDLSEESLEENIEICSQYLARMSKIGMTLELELGCTGGEEDGVDNSHLDNSALYTQPEDVDYAFTKLSAISPRFTIAASFGNVHGVYKPGNVQLTPVILKNSQEYVSKKHNLPHNSLNFVFHGGSGSTAAEIKEAVSYGVVKMNIDTDTQWATWEGVLKYYKKNEGYLQGQLGNPEGDDKPNKKYYDPRVWLRAAQTGMIERLEQAFKELNCIDVL

SEQ ID NO: 2361 - protein, 401 aa, Zea mays
  unsure (1)..(401): unsure at all Xaa locations
MALRLNDVALCLSPPLAARRCRSRSRSRSSGRFVAVASMTCAVSTKVENKKPFAPPREVHVQVTHSMPPHKIEIFKSLDDWARDNILTHLKPVEKCWQPQEFLPEPRXEEFHDEVKELRERAKEIPDDYFVCLVGDMITEEALPTYQTMLNTLDGVRDETGASPTAWAVWTRAWTAEENRHGDLLNKYMYLTGRVDMRQIEKTIQYLIGSGMDPRTENNPYLGFIYTSFQERATXFISHGNTARHAKDFGDLKLXAQICGIIASDEKRHETAYTKIVEKLFEIDPDGTVVALADMMRKKISNAXAHLMFDGQDDKLFEHFSMVAQRLGVYTARDYADILEFLVDRWKVANLTGLSGEGNKAQDYLCTLASRIRRLEERAQSRAKKAGTLPFSWVYGRDVQL

SEQ ID NO: 2362 - protein, 256 aa, Zea mays; identical to SEQ ID NO: 1290

SEQ ID NO: 2363 - protein, 350 aa, Zea mays
  unsure (1)..(350): unsure at all Xaa locations
MRQISSLLQGLARSLSVGRDRKGNGAGDGKTAVPVPAVLRTSGTLWGDGSDTFAAVCSRRGEKGINQDCSIVWEGXGCQEGTIFCGIFDGHGPWGHYVAKAVRDSLPPSLLCXWQEALALASLIDDGEKKLGDCQFDLWKRSYVAACAAVDDELRRSRRLDAVQSGCTALSIVKQGDLMIVANVGDSRAVLGTTSDDGAIAAVQLTVDLKPNLPQEKERIRRCNGQVYCLADEPGVHRVWQPSRESPGLAMSRAFGDYCVKDCGVISTPEVTQKRISSSDQFIILATDGVWDVLSNDEAVHIVAGTPDRXAKAAKRLVECAVRAWRRKRRDIAVDDCSAICLFFHPPPPS

SEQ ID NO: 2364 - protein, 216 aa, Bacillus anthracis str. A2012
MTNNNQIGENKEQTIFDHKGNVIKTEDREIQIISKFEEPLIVVLGNVLSDEECDELIELSKSKLARSKVGSSRDVNDIRTSSGAFLDDNELTAKIEKRISSIMNVPASHGEGLHILNYEVDQQYKAHYDYFAEHSRSAANNRISTLVMYLNDVEEGGETFFPKLNLSVHPRKGMAVYFEYFYQDQSLNELTLHGGAPVTKGEKWIATQWVRRGTYK

SEQ ID NO: 2365 - protein, 304 aa, Streptomyces avermitilis MA-4680
MSSTLSVPAQAPETGTARVKRGMAEQLKGGVIMDVVTPEQAKIAEDAGAVAVMALERVPADIRKDGGVARMSDPDMIEGIISAVSIPVMAKSRIGHFVEAQVLQSLGVDYIDESEVLTPADEVNHSDKWAFTTPFVCGATNLGEALRRIAEGAAMIRSKGEAGTGNVVEAVRHLRQIKNEIARLRGYDNNELYAAAKELRAPYEIVKEVAELGKLPVVLFSAGGVATPADAALMRQLGAEGVFVGSGIFKSGDPAKRAAAIVKATTFYDDPKIIADASRNLGEAMVGINCDTLPEAERYANRGW

SEQ ID NO: 2366 - protein, 141 aa, Neurospora crassa
MDDSELEKIRKARLEQLKAQGGGGGGGPKAGGPSGAGGQGGQEASRQQEAEARKAMLNQILMPEAADRLGRIRLVKEERATDIENRLMMLAQTGQLRSKVTEEQLKELLNAVADNKEAEKIVVTRRKGWGLDDDDDDLFDL

SEQ ID NO: 2367 - protein, 402 aa, Cyanophora paradoxa
TTAPVVISRTAPSVASKKSEVCQAKAGFLKGGRRLGFFLNNVQAPKNNEGAEVTRMALVPMRILLDHAAEHGYGLPAFNVNNMEQIKSIMEAAKATNSPVILQASRGARSYAGENFLRHLILAAAETYPEIPIAMHQDHGNGPATCLSAIRNGFTSVMMDGSLEEDSKTPASYEYNVNVTKTVCDLAHAVGVSVEGELGCLGNLETGQGDKEDGVGAEGVLTIEQMLTDPAQAKDFVERTKVDALAIAIGTSHGAYKFSRKPDGAILRIDRIREINQAVPNTHLVMHGSSSVPEDLLALINANGGNIPETYGVPVEEIQAGIKAGVRKVNIDTDCRLAISAAVREALVKDTKEFDPRHSQASMKYMQKVCEDRYVQFNAAGNADKIKAVDLDTMAKKFYATA

SEQ ID NO: 2368 - protein, 468 aa, Saccorhiza polyschides
IPYAKMGYWDADYNVKHTDILALFRITPQPGVDPVEAAAAVAGESSTATWTVVWTDLLTACDIYRAKAYRVDPVPGTNDQSFAYIAYECDLFEEGSLANLTASIIGNVFGFKAVAALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATIEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYLGEGPEILRNAASTCGPLKAALDLWKDITFEYTSTDTPDFVEVATESN

SEQ ID NO: 2369 - protein, 502 aa, Pseudomonas sp. Y2
MTRSLTMNSSLSAIDGLRLPHQMLIGGQWVSAQSGKTLNVYNPATGDILTEVPDGDVEDVNAAVESAAGTLRSDTWRRMPPSARERILLRLADLLEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 2370 - protein, 486 aa, Pseudomonas putida
MKEIKHFINGAFVGSASGRTFEDINPVNGQVIGRVHEAGRAEVDAAVKAARAALKGPWGKMTVAERADILHRVADGITARFDEFLEAECLDTGKPKSLASHIDIPRGAANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHSDVDAYTFTGETGTGETIMRAAAKGVRQVSLELGGKNAGIVFADCDMDKAIEGTLRSAFANCGQVCLGTERLYIERPIFDAFVARLKAGAESLVIGPPDDASSNFGPLVSLKHREKVLSYYQQAVDDGATVVTGGGVPEMPAHLAGGAWVQPTIWTGLSDNSAVVTEEIFGPCCHIRPFDTEEEAIELANSLPYGLASAIWTESSSRAHRVAGQIEAGIVWVNSWFLRDLRTAFGGSKQSGIGREGGVHSLEFYTELKNICVKL

SEQ ID NO: 2371 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKKYPDAYVRIIGFVNIRQVQCVSFIAFKPPGCEESG

SEQ ID NO: 2372 - protein, 95 aa, Chloroflexus aurantiacus
MARARSGYGPTLVEAITYRWKGHSKSDRQAYRSRDEVKDWQSRDPIMRLARLIQMSDAEFKAIVDQARTMIEEAVEFAQASPEPDPDTIFEGLYA

SEQ ID NO: 2373 - protein, 302 aa, Oryza sativa
MGAMDVQLESTAVQHGQAKINVEEHALVSLLSDEKYATEKTEDVDPDDYEKLEEGIMQYGCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCDNKMVRILCNDCGATSEVQFHLIAHKCQKCKSYNTRQI

SEQ ID NO: 2374 - protein, 298 aa, Pectobacterium carotovorum
MSFFHANQREALNQSLAELQGRINVSFEFFPPRTSDMEETLWSSIDRLSSLKPKFVSVTYGANSGERDRTHSIIKTIKERTGLEAAPHLTCIDASREQLREIAQDYWESGIRHIVALRGDLPQEGGKPDMYAADLVSLLKEVGDFDISVAAYPEVHPEAKSAQADLINLKHKIDAGANRAITQFFFDVESYLRFRDRCVATGIDVEIVPGILPVSNFKQLQKFATMTNVRVPNWMTTMFDGLDNDPETRKMVGASIAMDMVKILSREGVKDFHFYTLNRAELSYAICHTLGVRPDVAR

SEQ ID NO: 2375 - protein, 557 aa, Schizosaccharomyces pombe
MGRTLTSVLVVFISMAGWLGGADTGSISGILGMRDFQSRFADRYNPITNSYSYSAWRQALLTGTVNAGCLFGAMLSSPFTEAIGKKYSIAFFSGCYIIGQILLVTAVPSWVQIMVGKLFTGLTIGALSVLSPGYQSEVAPPQIRGAVVSTYQLFQTCGTLIAACINMGTHKLRKTASWRTSFGINILWGIFLMVGVLFLPESPRYLIYKGRDEEALRIMCQTAELDPESEIIQTNFNTIKSDIEMEMAGGKARWPEVFGKEVRYRTVLGFLTMLLRELIGNNYYFYYATQVFKGTGMTDIFLPAVILGAINFGTTFGALYTIDNLGRRNPLIFGAAFQSICFFIYAAVGDRKLIYKNGTSDHRAGAVMIVFSCLFLFSYCCSWGPMGWVIVGETFPIRYRSKCAAVATSGNWLGNFMVSFFTPFISNSIGFKLGYIYACINMTSAFQIFLMAKETKGLTLEEVNELYESDIKPWDSYKYVRQIESRRIHFSKEEEKREREKSKGYRGQEERFIENADGADNDDSSASSESFASAGAHSRSVFPRRSNVSEESHPTWV

SEQ ID NO: 2376 - protein, 174 aa, Triticum aestivum
  unsure (1)..(174): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLDSTSWFIFXREHNASPGVLXDGGYWTMWNCXYFGXTGPTQVINEVEESKKDXPDAYFRIIXSTTSSRAWLNSSPTGSKIRKAKYH

SEQ ID NO: 2377 - protein, 215 aa, Zea mays
MAEPRLEDSQPVDLSKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLAEFRKVQQWYVVLFYHVSIIVRS

SEQ ID NO: 2378 - protein, 411 aa, Schizosaccharomyces pombe
MALYSISKPVGSKINKHSYQDENTLVGKQALSKGTEKTKLSTNFEINLPRRTVLSDVSNVGKNNADEKDTKKAKRSFDESNLSTNEEADKPVESKFVKKLKVYSKNADPSVETLQKDRVSNVDDHLSSNPLMAEEYAPEIFEYIRKLDLKCLPNPKYMDQQKELTWKMREILNEWLVEIHSNFCLMPETLYLAVNIIDRFLSRRSCSLSKFQLTGITALLIASKYEEVMCPSIQNFVYMTDGAFTVEDVCVAERYMLNVLNFDLSYPSPLNFLRKISQAEGYDAQTRTLGKYLTEIYLFDHDLLRYPMSKIAAAAMYLSRRLLRRGPWTPKLVESSGGYEEHELKEIAYIMLHYHNKPLEHKAFFQKYSSKRFLKASIFVHQLVRQRYSVNRTDDDDLQSEPSSSLTNDGH

SEQ ID NO: 2379 - protein, 419 aa, Vibrio parahaemolyticus RIMD 2210633
MDILANYGTVLIIVAAIFGFMMAIGIGANDVANAMGTSVGSKALTVKQAIIIAMIFEFAGAYLAGGEVTDTIRKGVIETSLFASQPDILVFGMMSALLAAGTWLLLASYMGWPVSTTHSIIGAIIGFACVSVGTEAVDWSSVQGIVGSWIITPVISGFFAYVIFVSAQRLIFDTENPLFNAKRFVPVYMFITTMVIALVTIKKGLKHVGLHLTNGEAWMWAVAVSALVMAGGYFYIQKKFANREEDRSFAGVEGIFSVLMVITACAMAFAHGSNDVANAIGPLSAVVSTVEHMGEVTAKSTIAWWILPLGGIGIVVGLATMGHKVMATVGTGITELTPSRGFAAQLATACTVVLASGTGLPISTTQTLVGAVLGVGFARGIAALNLGVVRNIVASWIVTLPAGALLAVVFFYGIQAMFS

SEQ ID NO: 2380 - protein, 457 aa, Shigella flexneri 2a str. 2457T
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVLFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 2381 - protein, 159 aa, Streptococcus mutans
YNETGNWLPNETLEIIKTHLLAIKGPLETPVGGGIRSLNVALRQELDLFACVRPVRYFKGVPSPLKHPEKTAITIFRENTEDIYAGIEWNAGTAEVQKVINFLQDDMQVKKIRFPKSSSIGIKPISIEGSQRLIRAAIEYALANNLTKVTLVHKGNIQK

SEQ ID NO: 2382 - protein, 231 aa, Escherichia coli O157:H7 EDL933
MALRRPLPNIQVNQVAKYMTDQSHQCVIIGIAGASASGKSLIASTLYRELREQVGDEHIGVIPEDCYYKDQSHLSMEERVKTNYDHPSAMDHSLLLEHLQALKRGSAIDLPVYSYVEHTRMKETVTVEPKKVIILEGILLLTDARLRDELNFSIFVDTPLDICLMRRIKRDVNERGRSMDSVMAQYQKTVRPMFLQFIEPSKQYADIIVPRGGKNRIAIDILKAKISQFFE

SEQ ID NO: 2383 - protein, 149 aa, Triticum aestivum
  unsure (1)..(149): unsure at all Xaa locations
SGQQVLSTSIFFDDEWWPADKLXFNTAILQEKAYLLYVVISSGGDNNDKKLLNKRPPPRRFGKKLYAPQKRRAPLICDDGGIIYFLNKSEEQHHDEYGCQHNNATKKXIDEIRSIVXNIIGAAPPPPAIIISVIIVIGIIGALLEYVLQ

SEQ ID NO: 2384 - protein, 210 aa, Triticum aestivum
  unsure (1)..(210): unsure at all Xaa locations
MEEEDQELYGQKTPVDAEDVNRAAGGDAAARLQDLEKMSRLLKRMEXEDAAPRDKMPKELQREMRGRAPSAHISEEKKRMVFLLFLCXDVYSACTPEEEQQPAFSSLADPSTTFTTDKFGQPKGFAYVEFVEAEAIQEAVKLSESELHGRQIKVAPKRTNVPGLKQPRGGRGFNPYGGHPYMRPYPPPFYNPYGGYGRAPRFRRPRRPFY

SEQ ID NO: 2385 - protein, 247 aa, Malus x domestica
MGRGKVQMKRIENKISRQVTFSKRRSGLLKKAHEISVLCDAEVAVIVFSTVGKLFEYSTDFSMVRILDRYDQYSYAERQRTGADSESQENWPVEYPKLAARIEVLQRKLRNLVGEDLDPLSLRELQDLEQQLDTALKRIRTRKNQLVHESISEMDKKRKALRELNKSLAKKVKENKTMLEEEHDQVQVVGQQQTNQGRHNSSTLMLMPPPPQPPSTPTLPTFRTTRYDLSLSLSLSDVSVKQYAEGE

SEQ ID NO: 2386 - protein, 177 aa, Triticum aestivum
AGPSSSIKKLGGAFVAATAVVPDEVDKIKEILVKWSDIDRVNLILTLGNNVHAGGTGFTPRDVTPEATKSVIEKEAPGLAFVMIQESLKVTPFAMLSRAACGIRGSTLIINMPGNPNAVAECMEALLPALKHAMKQLKGDKREKNPRHIPHAEAAPVDQWERSFRAASSGGGCSCDP

SEQ ID NO: 2387 - protein, 110 aa, Lolium perenne
MGRSPCCEKMGLKRGPWTAEEDKILVAHITSFGHGNWRALPKQAGLLRCGKSCRLRWINYLRPDIKRGNFSDEEEQSIIQLHQLLGNRWSAIAARLPGRTDNEIKNYWNT

SEQ ID NO: 2388 - protein, 248 aa, Zea mays
  unsure (1)..(248): unsure at all Xaa locations
YTRGLPGSSGHVIGVPVISXAYGIEEEASRDPSSLARAATXDADHLAVSFTHPSPYASFGYKHSSSKVTHWVSKLSRRAQGFREHVTLGPKLSETVKGKLSLGARILQAGGVERVFRQAFSAADDDKQGERLLKALQCYIYTTGGPIAGMLFVSTRKVAFRSDRPVTVVTSSSSPAGVVRGTARVTYKVVVPLRRIRRVRXSPAGDRPEQKYVQVVTDDGFEFWFMGFVRYQVSLHELEKAIKQAQAQ

SEQ ID NO: 2389 - protein, 797 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKQANKVRLAEFVKVRTGIDINPQAIFDIQIKRLHEYKRQHLNLLRILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 2390 - protein, 76 aa, Clostridium cellulolyticum
MSGGRNTKLKELSTMRSSPAVPVGGKYRAIDFILSNMVNSGITNIGVIAQYSFRSLMDHLGSGKEWDLDRKTDGPT

SEQ ID NO: 2391 - protein, 177 aa, Glycine max
  unsure (1)..(177): unsure at all Xaa locations
MVNPDXLVVGGWDISNMNLVDAMDSAEVXDIDXYNQLTPYMESMLPLPGLYDPTXLLADQKEQANNEVEGAEHYHVXQHHEKLPGAQQTPHTRDEAXLLLXAANRERCNGVPAGLTDTIANLLRAEHGLDADIAPYSLHAIDQCMQSGSSIKGPPDTTPVPGLRALDIWQNTPIGAD

SEQ ID NO: 2392 - protein, 337 aa, Zea mays
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 2393 - protein, 345 aa, Ricinus communis
MPPREVHVQVTHSMPPQKIEIFKSLDNWAEENILVHLKPVEKCWQPQDFLPDPASDGFDEQVRELRERAKEIPDDYFVVLVGDMITEEALPTYQTMLNTLDGVRDETGASPTSWAIWTRAWTAEENRHGDLLNKYLYLSGRVDMRQIEKTIQYLIGSGMDPRTENSPYLGFIYTSFQERATFISHGNTARQAKEHGDIKLAQICGTIAADEKRHETAYTKIVEKLFEIDPDGTVLAFADMMRKKISMPAHLMYDGRDDNLFDHFSAVAQRLGVYTAKDYADILEFLVGRWKVDKLTGLSAEGQKAQDYVCRLPPRIRRLEERAQGRAKEAPTMPFSWIFDRQVKL

SEQ ID NO: 2394 - protein, 312 aa, Pseudomonas syringae pv. syringae B728a
MFLVCGEALFDIFTRADDSGSLNRLGFDAIAGGSPFNVAIGLRRLGVEASFLAGLSTDYLGRRLRAVLEKETVNTDHLIDFDAPTTLAMVAVGSDGSPTYSFRGDGCADRQLRLEHLPELDGQVRGIHVGSFSLVVQPIADTLLALVARESSTRLISLDPNVRLNPAPDIQRWRSQVAAFAEHAHMIKVSDEDLHLLYPDSDPQKIAEGWLGKRTQLVIVTRGTQGASVFTRQHGTWSAPAKTVVTADTVGAGDTFQAALLTFLSERQLDTPEGLATLSRELLDEMLSFAVGAAALTCTKVGPDLPYRHQLG

SEQ ID NO: 2395 - protein, 441 aa, Amphiroa fragilissima
  unsure (1)..(441): unsure at all Xaa locations
PQPGVDPVEASXXIAGESSTATWTVVWTDLLTACDLYRAKAYKVDSVPNSTEQYFAYIAYDIDLFEEGSIANLTASIMGNVFGFKAVXXLRLEDMRIPVAYLKTFQGPATGIVVERERMDKFGRPFLGATVKPKLGLSGKNYGRVVYEGLKGGLDFLKDDENINSQPFMRWKERFLYSMEAVNRAVAASGEVKGHYLNVTAATMENMYERAEFAKALGSIIIMIDLVIGYTAIQSMAIWARKNDMILHLHRAGNSTYSRQKEHGMNFRVICKWMRMAGVDHIHAGTVVGKLEGDPLMIKGFYNTLLKSHLEVNLPQGIFFEQDWASLRKVTPVASGGIHCGQMHQLLDYLGIDVVLQFGGGTIGHPDGIQAGATANRVALESMVLARNEXXDYVAEGPQILKXXAKTCGPLQTALDLWKNITFNYTSTDTADFVETPTANV

SEQ ID NO: 2396 - protein, 659 aa, Neurospora crassa
MAATTTTTNAGRSMASWKRLSTLIAAFTLSWTSSFVAAAGSADYFVHDLPGAPDGPLVKMHAGHIEVTPDNNGNLFFWHFQNKHIANKQRTVIWLNGGPGCSSEDGALMEIGPYRLKDENTLVYNDGAWNEFANVLFVDNPVGTGFSYVDTNAYIHELTEMAANFVTFLERWFALFPEYEHDDLYIAGESYAGQHIPYIAQAILERNKNAGPVNRKWNLSGLLIGNGWVSPKEQYDAYLQFAYEKDIVKKGTDLANKLEIQQRICQKEIAVKPDKIDYPECEAILQDMLQLTAGGVGASGKNQCYNMYDVRLKDDYPSCGMAWPPDLKSVTPYLRKKEVIKALNINDNKSTGWTECNGQVGMNFNPKTKPSITLLPDILSAGVPILLFSGAEDLICNHLGTEALISNMEWNGGKGFELTPGTWAPRRDWTFEGEPAGFWQQARNLTYVLFYNSSHMVPFDYPRRTRDMLDRFMGVDISSIGGQPTDSRLDGEKLPETTVGGAAGNSTSNQAAEKAKLEMAKWEAYRKSGELVLVIVIVAAGVWGWFVWKERRKTAGQGYMGVATGERHSISNNPGPRGNLSGGGDRTRGQGLAGFRNKRSGRRDVEAQDFDESELDDLHLSKPEDPHADSRYSIGGASDDEEEQKPGKGSSSRQPGGRS

SEQ ID NO: 2397 - protein, 178 aa, Burkholderia fungorum
MPYQHIKVPTGGDKITVNPDFSLNVSDQPIIPYIEGDGTGIDITPVMIKVVDAAVEKAYAGKRKIHWMEIYAGEKSTKVYGPDVWLPEETLQVLKEYVVSIKGPLTTPVGGGIRSLNVALRQELDLYVCLRPVQYFKGVPSPVREPEKTNMVIFRENSEESTRVSSGRPIGAGEKSSV

SEQ ID NO: 2398 - protein, 413 aa, Arabidopsis thaliana
MGLEEQGRAREDTPLLGKGRPLSGKFKTFANVFIAIVGAGVLGLPYAFKRTGWLMGLLTLFSVAALINHCMMLLVHIRRKLGVSNIGSFGDLGFAACGNLGRFVVDILIILSQAGFCVGYLIFIGNTLANLSKPTKSTTLMSLRHLMGVSPKSLYIWGCFPFQLGLNSIKTLTHLAPLSIFADVVDLGAMAVVIVEDIKITVVQRPQVVAFGGMSVFFYGMGVAVYAFEGVGMVLPLESETKDKDKFGKVLALSMLFIAVMYGSFGVLGYMAFGDDTMDIITANLGAGVVSSLVQLGLCINLFFTFPLMMNPVFEIVERRFWSGMYCVWLRWLLVLAVTLVALLVPNFADFLSLVGSSVCCALGFVLPSLFHLMVFKDEMEWKQRALDVGILLLGVILGVSGTWSSLTEIFQE

SEQ ID NO: 2399 - protein, 919 aa, Streptomyces lividans
MPATRRTARVRRVAAVTVTALAAALLPPLAARADTPPAPPSDAKLAKTAARHDLTREQFYFSCRTLRQRGRRERPRRLTGTRLTTGYDPTDKGFYQGGDLKGLTEKLDYIKGLGTTSIWMAPIFKNQPVQGTGKDASAGYHGYWITDFTQVDPHFGTNKDLKNLISKAHAKGMKVFFDVITNHTADVVDYEEKSYDYLSKGAFPYLTKDGQPFDDADYADGERRFPRVDSGSFPRTPTVPTAKKNLKVPSWLNDPAMYHNRGDSTWAGESATYGDFNGLDDLWTERPEVVGGMEKIYQRWVEDFAIDGFRIDTVKHVDMEFWTQWATALDAYAAKKGRDDFFMFGEVYSADTSVTAPYVTQGRLDSTLDFPFQDAARAYASQGGSARKLAAVFGDDYKYTTDKANAYEQVTFLGNHDMGRIGTFLKQDAPEAGDAELLKKDRLANELMFLSRGNPVIYYGDEQGFTGAGGDKDARQPMFASRTADYLDDDQLGTDRTHAEAAYDTSAPLYRQISALAELRKANPALADGVQTERYAADGAGIYAFSRTDAKTGTEYVVAFNNAGTEKSAAFATGSAGMTFRGLYGTDATVKSGADSKVTVTVPARSAVVLKAAGRLAAPAAEPTISLHAPDPGATGTVELSADVAGGQLNRVVFAAQTGDGKWRTLGTADHAPYKVTHTVDADTPAGTALRYKAVVVDSAGRTASGRLHHRHPARRGGAHRRLPGPRGRPLQARRRELRRLGPVRLGRPRRREAHHLARHPPLHRPGRLRAFAYVKLKPGASTVGFLVIDKDGNKDVAADRTIDVTETGEVWIEQGEEQLVTERPEYPAQDTTKAVLHYKRADGNYDGWGLHVWGDAANPTDWAKPLQPVRTDPYGAVFEVPLTDGASSLSYMVHKGDEKDLPTDQAWTSRPTATRCGC

SEQ ID NO: 2400 - protein, 658 aa, Daucus carota
MAQIQVQPQQQQQQIPVSGSNGVSAGAAANAGGSNQFTTTSLYVGDLDQSVTDSQLYDLFNQVGQVVSVRVCRDLSTGRSLGYGYVNYSNQQDATRAIDVLNFTPLNNKTIRVSVSRRDPTDRKSGAGNIFIKNLDKSIDIKALHETFSSFGTIISCKIATDASGQSKGYGFVQYDSEEAAQTAIDKLNGMLMNDKQVYVGVFLRKQDRDSEMSKTKFNNIYVKNLSDSTSEDDLRKTFGEYGTITSVVVMRDADGKSKCFGFVNFENPEDAAKAVDALNGKKFDDKEWYVGKAQKKSEREVELKSRFEQTVKEQVDKYQGVNLYVKNLDDTIDDEKLKELFSEYGTITSCKVMRDPSGISRGSGFVAFSTPEEASRALGEMNGKMIVSKPLYVALAQRKEERRARLQAQFSQMRPVAMPPSMGPRMPMYSPGAPGMGQQLFYGQAPPAMIAPQAGFGYQQQLVPGMRPGGGPMPNFFMPMVQQGQQGQRPGGRRGAGPAQQTQQPVPMMPQQLMPRGRMYRFPPGRNVGDVTMPGVGGGMLPVPYNMGGMLPREAAMGQPMPITALASALANAPADQQRTMLGENLYPLVDQLEHDHAAKVTGMLLEMDQTEVLHLLESPDALKAKVAEAMDVLRNVSQPNVADQLGGLSLNENLVS

SEQ ID NO: 2401 - protein, 117 aa, Oryza sativa
  unsure (1)..(117): unsure at all Xaa locations
MAPSVMAXSATTVAPLQGLKSTAGMPVARRSGNCSFGNVSNGGRIRCMQAWPIEGIKKVETLCYLTPITVEDLLKQIEYLLRSKRVPCLEYSKDGFVYRENHRSPEYYDGRYWTMWK

SEQ ID NO: 2402 - protein, 178 aa, Streptomyces clavuligerus
MTGGAQELLLSRIRDVPDYPQPGVVFKDITPLLADPEAFSVLTEALAEVCVRHGATKVVGLEARGFILGAPVAVRAGLGFIPIRKAGKLPGATLSQAYALEYGTAEIEVHAEDLTPDDRVMVIDDVLATGGTAAAAMELIRRGGADVAGLAVLMELGFLGGRARLEPTLAALEALLAL

SEQ ID NO: 2403 - protein, 215 aa, Papaver nudicaule
  unsure (1)..(215): unsure at all Xaa locations
RHEMSMLCDAEVALIIFSNRGKLYEFCSSNSMFKTXERYQKCNYGQPEPNVSARESLEHASHQEYLKLKARVEALQRSQRNLLGEDLGPLSGKELEFLEKQLDSSLKQIRSTRTQYMLDQLTDLQRREQMLSDANKTLRRRLEEGAQASQQQWDMQHGVGYSRQQQSXHHQAADHNQGFFHPLECEPTLQIGYQQDQITVAQGAPMGSYMPGWLA

SEQ ID NO: 2404 - protein, 467 aa, Glycine max
DCSKVTTKVMKQLGRLFPNKVTIQLPQDEALLSDWKQHLERDIETMKAQSNIVSVCTVLNRIGLDCPDLETLCINDQTLTTESVEKIIGWAISYHFMHSSEASIKDSKLVISAKSINYGLNILQGIQNENKNLKKSLKDVVTENEFEKKLLADVIPPTDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVIFVDEVDSMLGPPENPSARAAMRKMKNEFMVNWDGLRTKDKERVLVLAATNRPFDLDEAVIRRLPRRLMVNLPDAPNREKILRVILAKEDLAPDVDFEAIANMTDGYSGSDLKNLCVTAAHCPIREILEKEKKERSLALSENKPLPGLCGSGDIRPLKMDDFRYAHEQVCASVSSESTNMNELLQWNDLYGEGGSRKMRSLSYFM

SEQ ID NO: 2405 - protein, 470 aa, Zea mays
  unsure (1)..(470): unsure at all Xaa locations
MAGTEVEDPPAAALEVPAKRGLLRYNSPLAQVSLLGLICFCCPGMFNALSGLGGGGQVDPTIADNANTALYACFAVFGVLGGAAHNLLGPRATLLAGALTYPLYAGSFLYYNHRPGSQVFPVTAGALLGAGAGFLWAAQGAVMTSYPPPNRRGTYISLFWCLFNLGGVLGGLLPFALNYNRGDKKGSVSDGTYIAFMAFMLVGAALTVLVLPPARIVRDDGTRATRVTFSSPATEGAEILKLFANWKMLLALPAAWASNFFYTYXVQQRQQRPLHAPHQGPQQRLLLGRADDRLRRHRLLPRLRLRQPPKEGAVRGRRRRRRRNGHLXGGLANQLSYNAVPVPDPIDFKDGHRYAGPFLLYFSYGLLDAMFQSLIYWIIGALANDSQILSRYVGFYKGVQSAGAAVAWQVDRRHTPLMSQLIVNWGLMTISYPLLALLVFLAVKDESYSVSSVEDGREKDSKLSAPTSFH

SEQ ID NO: 2406 - protein, 330 aa, Glycine max
MGSNGGSSNNNNNKVLEKPGQDQLVQQQQQQQEAPKCPRCDSSNTKFCYYNNYSLSQPRHFCKACKRYWTRGGTLRNVPVGGGCRRNKRVKRPLITTNPSSAAIDTAASNNSSNSSSAPLQPPIDTASTSNHINPLFYGLPSSSSDVNLPLFSRFGSRISSSGFDLQLNNALGLGFSSGVLSNEASDNNGYRNWFGSNNTLLSSYTSTTSTTTPAMSSLLSSSLLQQKFMTDGVDSTNTFQHGLGLTPLEQLQMASDHSSEAGMVALKDVKVELGQNNRLEWNNGAACQSQIQHVGLYDPSLYWNNSAATALGVWNDQAANIGSSVTSLI

SEQ ID NO: 2407 - protein, 289 aa, Neisseria meningitidis Z2491
MKPIRKAVFPVAGMGTRFLPATKASPKEMLPIVDKPLIQYAVEEAVEAGCTEMVFVTGRNKRSIEDHFDKAYELETELEMRHKDKLLEHVRNILPPNITCLYIRQAEALGLGHAVLCARAAIGDEPFAVILADDLIDAQKGALKQMVEVYERSGNSILGVETVEPSQTGSYGIVETEQLKQFQRITGIVEKPKPEDAPSNLAVVGRYILTPRIFDLLTGLPRGAGNEIQLTDGIAKLLDHEFVLAHPFEGTRYDCGSKLGYLEATVAYGLKHPETGEPFRRLLEKYRTE

SEQ ID NO: 2408 - protein, 316 aa, Buchnera aphidicola str. Sg (Schizaphis graminum)
MNQLNALKQFTTIVADTSDIESICKYKPQDATTNPSLILKAVSSSVNKRFIDQAIEYARKKGGSYNYKIVNASDKILVDLGVEILKHIPGYISSEVDARLSFNKEKCILKAKKIIDMYEEKGISRNRVLIKLAATWECIKAAEELKKNNIACNLTLLFSFAQARACAESNVFLISPFVGRIYDWYLSQNLILKNPADQDPGVLSVCKIYDFYKKYNYKTIIMGASFRNVQQILSLSGCDRLTISPVLLKELESSNKELNRKLCPPTSFLNPPVPLTEAEFRWEHNQDEMAVQKLSEGIRNFGKDQLSLEKIFSKLI

SEQ ID NO: 2409 - protein, 184 aa, Triticum aestivum
KYPYIAGMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDKNRSI

SEQ ID NO: 2410 - protein, 480 aa, Sarcodia dentata
  unsure (1)..(480): unsure at all Xaa locations
ARIKNDRYESGVIPYAKMGYWDPDYVVKDTDILALFRVSPQPGVDAVEASAAVAGESSTATWTVVWTDLLTACDLYRAKAYKVDPVPKTSDQFFGYIAYDIDSFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTIIIMIDLVIGYTAIQTMAVWARKNDMILHLHRAGNSTYSRQKIHGMNFRVICKWMRMAGVDHIHAGTVVGKLEGDPLMIRGFYNTLLKTHLAVNLPQGIFFEQDWASLRKVTPVASGGIHCGQMHQLLDYLGIDVVLQFGGGTIGHPXGIQAGATAXRVALESMVIARNEGRDYVAEGPQILQDAAKTCGPLQTALDLWKNITFNYTSTDTADFVETPTANV

SEQ ID NO: 2411 - protein, 279 aa, Pseudomonas syringae pv. syringae B728a
MIKKCLFPAAGYGTRFLPATKAMPKEMLPVVNKPLIQYGVEEALAAGLTEISIVTGRGKRALEDHFDISYELEHQIKGTDKEKYLVGIRKLIDECSFSYTRQTEMKGLGHAILSGRPLIGNEAFAVVLADDLCVNPEGDGVLAQMVKLHKHYGCSIIAIQEVDPQETNKYGVIAGEEIKPGLFRVTNMVEKPKPEDAPSNLAIIGRYILTPDIFEKIEQTEPGKGGEIQITDALMKQAAEGNVLAYKFKGERFDCGGAEGYIQATNFCFEHFYKTGKAH

SEQ ID NO: 2412 - protein, 579 aa, Brassica napus
MNNNWLGFSLSPYEQNHHRKDVYSSTTTTVVDVAGEYCYDPTAASDESSAIQTSFPSPFGVVVDAFTRDNNSHSRDWDINGCACNNIHNDEQDGPKLENFLGRTTTIYNTNENVGDGSGSGCYGGGDGGGGSLGLSMIKTWLRNQPVDNVDNQENGNAAKGLSLSMNSSTSCDNNNDSNNNVVAQGKTIDDSVEATPKKTIESFGQRTSIYRGVTRHRWTGRYEAHLWDNSCKREGQTRKGRQVYLGGYDKEEKAARAYDLAALKYWGTTTTTNFPMSEYEKEVEEMKHMTRQEYVASLRRKSSGFSRGASIYRGVTRHHQHGRWQARIGRVAGNKDLYLGTFGTQEEAAEAYDIAAIKFRGLTAVTNFDMNRYNVKAILESPSLPIGSAAKRLKEANRPVPSMMMISNNVSESENSASGWQNAAVQHHQGVDLSLLHQHQERYNGYYYNGGNLSSESARACFKQEDDQHHFLSNTQSLMTNIDHQSSVSDDSVTVCGNVVGYGGYQGFAAPVNCDAYAASEFDYNARNHYYFAQQQQTQQSPGGDFPAAMTNNVGSNMYYHGEGGGEVAPTFTVWNDN

SEQ ID NO: 2413 - protein, 469 aa, Oryza sativa
MAKPRKNSTTTNTSSSGVAAAAAAAAVKPKRTRKSVPRESPSQRSSVYRGVTRHRWTGRFEAHLWDKNSWNESQNKKGKQVYLGAYDDEEAAARAYDLAALKYWGPDTILNFPLSAYEGELKEMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGADGAGAPQNPHPMLGALSAQDLPAIDLDAMASSFQHDGHGAAAAAAQLIPARHSLGHTPTTSALSLLLQSPKFKEMIERTSAAETTTTSSTTTSSSSPSPPQATKDDGASPQCSFPEDIQTYFGCAAEDGAAGAGYADVDGLFFGDLAAYASPAFHFELDLVVSESSAFDSKLSSEDLLHCTHRWRRRLLTGEVIGEVKFLSRGRPHGLQHGAREVVVRDIELLHLLHPGHLRWERASEGVEADVEECDLP

SEQ ID NO: 2414 - protein, 373 aa, Candida maltosa
MSVKTKTITILPGDHVGTEIVNEAIKVLEAIEAATPYQKIHFDFKHHLIGGSAIDATGVPLPDDALESAKNSDAVLLGAVGGPKWGTGALRPEQGLLKIRKELNLYANIRPCNFASDSLLELSPLRPEVVKGTNLIIVRELVGGIYFGDREEQEESEDKQTAWDTEKYTVDEVTRITRIAAFMALQHNPPLPIWSLDKANVLASSRLWRRTVDKVISEEFPTLSVQHQLIDSAAMILIQNPTKLNGIIITSNMFGDIISDEASVIPGSLGLLPSASLASLPDTNTVFGLYEPCHGSAPDLPANKVNPIATILSAASMLRLSLDCVKEAEALEEAVKQVLDKGIRTADLRGTSSTTEVGDAIVEAVTKILKEKA

SEQ ID NO: 2415 - protein, 354 aa, Pseudomonas syringae pv. tomato str. DC3000
MALISMRQMLDHAAEFGYGVPAFNVNNLEQMRAIMEAADKTDSPVIVQASAGARKYAGAPFLRHLILAAIEEFPHIPVVMHQDHGTSPDICQRSIQLGFSSVMMDGSLREDGKTPADYDYNVDVTRRVVAFAHACGVSVEGELGVLGSLETGMAGEEDGVGAEGVLDHSQMLTDPEEAADFVKRTQVDALAIAIGTSHGAYKFTKPPTGDILAIERIKEIHKRIPNTHLVMHGSSSVPQEWLKIINEFGGDIKETYGVPVEEIVEGIKHGVRKVNIDTDLRLASTGAIREFMAKHPSEFDPRKYLAKTVSAMRDVCIARYEAFGTAGNASKIKPVSLDAMFERYARGELDAKIN

SEQ ID NO: 2416 - protein, 502 aa, Streptomyces avermitilis MA-4680
MRPGRQSAMTELVEHGQLFIGGVLADPLGKDVIEVISPHTEEVIGRVPHASTADVDRAVAVARKAFDEGPWPRATLDERIEVVTRIKDAIAVRHEEIARVISSENGSPYSWSVLAQALGAMMVWDAAITVARNFTYEETRDGVLGKIVVRREPVGVVAAVVPWNVPQFVAAAKLAPALLTGCTVVLKPSPESPLDAYLLGEIAREAGLPEGVLSILPADREVSEYLVGHPGIDKVSFTGSVAAGRRVMEVASRNLTRVTLELGGKSAAVVLPDADITTSVPGIVSAAWMNNGQACVAQTRILVPRSRYDEFADAFAAAASALVVGDPLDPATQVGPLVARRQQRRNLDYIRIGQEEGAKILTGGGRPPGLDRGWYVEPTLFGDVDNSMRIAREEIFGPVICLLPYGDETEAVKIANDSDYGLSGSVWTADVEHGIDVARRVRTGTYSVNTFSLDMLGPFGGYKNSGLGREFGPEGYGEFLEHKMIHLPAGYEAPTGVEGAGA

SEQ ID NO: 2417 - protein, 702 aa, Nicotiana tabacum
MTILNQEKYIRFEDCKSEDNRLFSGRKPSTRSWMSSIRRGFSDRLSSLKRKSRCIPSLSDWPKQVSEGSSRNKILDPQEPFLQFWNKIFVLACIVSVAIDPLFFYISVVDIKRKCLDLDHSLKIPISVLRSATDLFYIYHIFGQFRTGFIAPSSRVFGRGELIEDSSLIAKRYIPYCIIDVLAVLPLPQLVLYINAPNANRAISLVMKKQLVIVVFTQYVPRIFRIFPLYREVTRTTGFFTETAWAGAAFNLFLFMIASNVVGALWYLITVERQDNCWSQVCKGFEECVLDHLCCGQQGKNAQFLNFSCRLLKPEEIQENDFDFGIFRDALQSRVVQRRNFWSKLSYCFWWGLRNLSSLGQGLNTSDFLGEILFAVFICILGLILFSLLIGNMQEYLQSITVRVEGMRLRRRDAEQWMSHRMLPDNLRERIRRYEQYKWQQTRGVDEDYLICNLPKDLRRDVKRHLCWSLLKRVPMFEKMDEQLLDALCDRLKPALFTENSFIIREGDPVNEMLFLMRGTLLTITTNGGRTGFFNSASLSAGDFCGEELLTWALDPNASSCLPASTRTVQAVIDVEAFALTADDLKFVAAQFRRLHSKQIRHTFRFYSQHWRTWAACFIQAAWRRHYRNKLEKSLREEEDRLQAALENETANIPSLGATIYASRFAANALRILRRNHPKGSKSSSKVSPLLLQKPAEPDFSS

SEQ ID NO: 2418 - protein, 261 aa, Zea mays
MSFSSMSKQQVLDAGDGEGEEVMELIPGLPEEVAEKCLLHLPFLYHRLFRTVSSTWNRFLTDALAKPLLFPHAAGAGTAATGSVPFLFALAFDPMSRRLQCQALDRFSRKWLLLPPVPGGAAAGSFAVVGLPRRGQIYVIGGVEEGGDKAVTSVAVYSAARNGWEEAAAMRTPRGYMAAGEVGGRVVVAGEDGEAEVFDPDAGRWSPAAPRRGAAVAWYDAAAAGGKLFVTEGWAWSFERAPCGAVFYFVTVFCCEMVRGM

SEQ ID NO: 2419 - protein, 525 aa, Cicer arietinum
MRLVEIAVTLVLIALFIHFRPTPTAKSKALRHLPNPPSPKPRLPFVGHLHLLDHPLLHQSLIRLGERYGPLYSLYFGSMPTIVASTPDLFKLFLQTHEAVSFNTRFQTSAIRRLTYDNSVAMVPFAPYWKFIRKLIMNDLLNATTVNKLRPLRSQEIRKVLNVMAKSAQTQEPLNVTEELLKWTNSTISRMMLGEAEEIRDIARDVLKIFGEYSLTDFIWPLKKLKVGKYEKKIEEIFNRFDPVIEKVIKKRQDVRRRRKERNGELEEGEQSVVFLDTLLDFAEDETMEIKITKEQIKGLVVDFFSAGTDSTAVATDWCLSELINNPRVMKKAREEVDSVVGKDRLVDESDIQNLPYIRAVVKETFRMHPPLPVVKRKCTEECEINGYVIPEGALVLFNVWAVGRDPKYWDRPLEFRPERFLENAGEGDAGSIDLRGQHFQLLPFGSGRRMCPGVNLATAGMATLLSSVLQCFELQVAGPNGQILKGADAKVSMDERPGLTVPRAHNLVCVPLARPGAAAKLLSS

SEQ ID NO: 2420 - protein, 390 aa, Helicobacter pylori 26695
MLYSSKIQSLSESATIAISTLAKELKSQGKDILSFSAGEPDFDTPQAIKDAAIKALNDGFTKYTPVAGIPELLKAIAFKLKKENNLDYEPNEILVSNGAKQSLFNAIQALIEEGDEVIIPVPFWVTYPELVKYSGGVSQFIQTDEKSHFKITPKQLKDALSPKTKMLILTTPSNPTGMLYSKAELEVLGEVLKDTKVWVLSDEIYEKLVYKGEFVSCAAVSEEMKKRTITISGLSKSVAMTGWRMGYAASKDKKLVKLMNNLQSQCTSNINSITQMASIVALEGLVDKEIETMRQAFERRCDLAHAKINAIGGLNALKPDGAFYLFIHIGSLCGGDSMRFCHELLEKEGVALVPGKAFGLEGYVRLSFACSEEQIEKGIERIARFVKSKG

SEQ ID NO: 2421 - protein, 508 aa, ASPERGILLUS NIDULANS FGSC A4
MGNNPSKGPVGDGPSPVVSGNTGLTASTSDKRAARGPSAHGPSNAAKAPVADVASSRETATGQSSSQHQTSVQQRLQTRNVKGSPTRTVDRPGFSKTDSPRSKAISAPDPSDPVQVPSSRTAAARRDPYESVALSAPPPKMYYSASHHLQRPPRMPLPIGDATAIPGSPISGPDDTSPLATEERLGDKTTAAKPDLATIEDDDTVDELQPYATSGVGRAVPTTIEWTAGGNKVYVTGTFVNWEKKFRLHRSENNPDVLSTKLNLRPGTHHLKFIVDGEMRASDNLPTAVDFTNHLVNYIELSADDVNRSRRESDKSAPSGVHPPQVLPEEVADGKVETAVDDEKPEKEEEPEEIPIGDFRGVVPQFLLDLDKDEESPCYQQAVNIIGDAPTPPSLPLFLGKSILNGTTPMKDDSSLLNNPNHTVLNHLATSSIKNGVLATSVTTRYKRKAALGILVKANERLSVSNFKKGKPCVVSKEAGNWFATACLLRLMSPDISLLDYRAVSYVR

SEQ ID NO: 2422 - protein, 198 aa, Yersinia ruckeri
GSSIGGWKGINESDMVLMPDASTAVMDPFFADSTLIIRCDILEPGTMQGYDRDPRSISKRAEDFLKSSGIADTVLFGPEPEFFLFDDIRFGSSIRGSHVAIDDIEGAWNSSTKYEGGNKGHRPAVKGGYFPVPPVDSAQDLRSAMCLTMEDMGLVVEAHHHEVATAGQNEVATRFNTMTKKADEIQIYKYVVHNVAHA

SEQ ID NO: 2423 - protein, 484 aa, Medicago sativa
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKPVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVKEEVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 2424 - protein, 422 aa, Pseudomonas aeruginosa PAO1
MSDLKTAALEYHAQPRPGKLSVELTKPTATARDLSLAYSPGVAEPVREIARDAELAYQYTGKGNLVAVISDGTAILGLGNLGPLASKPVMEGKGVLFKRFAGIDVFDIEVDAESPQAFIDTVKRISITFGGINLEDIKAPECFEIERALIEQCDIPVFHDDQHGTAIVTAAGMLNALELAGKKLEEAKIVCLGAGAAAISCMKLLVSMGAKVENIYMIDRKGVIHAGRDDLNQYKSVFATETDKRTLADALEGADVFVGLSGANLLEPEDLKRMAPNPIVFACSNPDPEIKPELAHATRNDVIMATGRSDYPNQVNNVLGFPFIFRGALDVRATRINEEMKIAAALALRDLAKQPVPEDVCAAYGVDKLEFGREYIIPKPMDKRLITVVSDAVAKAAIETGVATLPYPKNYPLKSVDDVFNG

SEQ ID NO: 2425 - protein, 136 aa, Glycine max
  unsure (1)..(136): unsure at all Xaa locations
ASSLISSPAATTVNRAGAGLVAPFTGLKSMAGFPTRKTNNDITSIASNGGRVRCMQVWPPIGKKKFETLSYLPYLDDAQLAKEVEYRVKKRLMPYLEFEVKHDCVYREHNRSPRCYNRLYXTMIKLAMFSCTEACQ

SEQ ID NO: 2426 - protein, 172 aa, Glycine max
  unsure (1)..(172): unsure at all Xaa locations
MAEQALEGSQPVDLTKHPSGIVPTLQNIVSTVNLDCKLELKSIALQARNAEYNPKRFAAVIMRIREPKTTALIFASGKMVCTGAKSEQQSTTRPLXDFKIQNIVGSCDVKFPIRLEGLAYSHGAFLKCKCEVHNHLFFLVNFLEKWSSQIPALVISPTYGPLDVGYSIGCCT

SEQ ID NO: 2427 - protein, 512 aa, Brucella melitensis 16M
MKIRAQIGMVLNLDKCIGCHTCSITCKNVWTNREGVEYAWFNNVETKPGVGFPKEWENQKKWNGGWVRKKNGKIEPKMGAKWRILAKIFANPDLPEIDDYYEPFDFDYGHLQTAGESRTMPTARPRSLISGERMEKIEWGPNWEEILGGEFAKRSKDYNFEGVEKEIYGQFENTFMMYLPRLCEHCLNPTCVAACPSGAIYKREDDGIVLIDQEKCRGWRMCVSGCPYKKIYYNWSSGKSEKCIFCYPRIESGQPTVCSETCVGRIRYLGVMLYDADRISEAASTANEQDLYQEQLNIFLDPNDPAVIEQARKDGVPDAWLEAAKHSPVYKMAMDWKIAFPLHPEYRTLPMVWYVPPFSPLQSAAQAGKLGMDGPLPDVRSMRIPVRYLANLLTAGKEEPVISALERMLAMRAYMRAKTIDGVIDEAIADRVGMSGAMIEEMYNIMAIANYEDRFVIPTSHREITEDAYDVRGSCGFTFGNGCSGGTSTEDLFGAKRQKVVQTPTDIFREQV

SEQ ID NO: 2428 - protein, 439 aa, Streptomyces avermitilis MA-4680
MSTTPPSPQLTAATAPGAGEPASEDGAFGFLRALGPRGRRAFAGAFGGYALDSYDYFTLPLSMVALAAYFGLDSGQTGLFTTVTLVVSAIGGAVAGVVADRIGRVKALMITVITYAVFTVACGFAPNYETLLVFRALQGLGFGGEWAVGAILVAEYASARHRGRTLGAIQSSWAVGWALAAVVYTLVFSFVGDDLAWRVMFWTGALPALLVVWVRRRVHDAPEAAVERQKSAHKGSFTAIFRPGTADAPGLLRITVFAGLLSTGVQGGYYTLATWVPTYLKTERGLSVVGTGGYLTFLISGAFIGYLTGGYLTDKLGRKRNILLFAVLSAICVLVYANIPSGADTLLLVLGFPLGFCMSAIFSGFGSFLSELYPTAVRGTGQGFTYNTGRAVGAVFPTLVGFLADSWGVGGALVFGAIGYALAALALLGLPETRGKELR

SEQ ID NO: 2429 - protein, 466 aa, Pterocladiella capillacea
  unsure (1)..(466): unsure at all Xaa locations
YAKMGYWDPDYTVKETDVLALFRVTPQPGVDPVEASAAVAGESSTATWTVVWTDLLTACDLYRAKAYKVDDVPNTNDQYFAYIAYDIDLFEEGSIANLTASIIGXXXXXXAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAASGEIKGHYMNVTAATMEDMYERAEFAKQLGTVIIMIDLVIGYTAIQTMAIWARRNDMILHLHRAGNSTYSRQKSHGMNFRVICKWMRMAGVDHIHXXXXXXXXEGDPLMIKGFYNTLLLTHLDTNLPQGIFFEQDWASLRKVTPVASGGIHCGQMHQLLDYLGVDVVLQFGGGTIGHPDGIQAGATANRVALEAMVIARNEGRDYVAEGPQILRDAAKTCGPLQTALDLWKDISFNYTSTDTADFVETPTANV

SEQ ID NO: 2430 - protein, 528 aa, Triticum aestivum
MALEAAYHYLQRAVGHGTSTEALLLTVLLLLIIRVAWVRAFTTTTASTKCKQQLPPTPPGKLPIIGHLHLIGSHPHVSFRDLAAKHGRDGLMLVHVGAVPTVVVSTPQAAEAVLRTHDHVFASRPRNPVADIIRYNSTDIAFAPYGDYWRRARKVVNTHLLSVKMVYSKRHDREEEVRLVVAKICELAMAAPGKALDMTELLGGYASDFVCRAVLGESHRKHGRNELFRELTEISASLLGGFNLEDYFPRLANLDVFLRVVCSKAMGVSKRWDNLFNELIAEYEHGKEDNAEDFVHLLLSLKKEYGLSTDNVKAILVNMFEAAIETSFLVLEYSMAELINNRHVMAKVQKEVRESTPKGEKLDLIMEEDLSRMPYLKATIKEAMRIHPPAPFLLPHFSTNDCEVNGYTIPAGTRVIVNAWALARDPSHWERAEEFYPERFLQEGRDAEVDMYGKDIRFVPFGAGRRICAGATFAIATVEVMLANLIYHFDWELPSEMEAIGAKVDMTDQFGMTLRRTERLHLVPKIYK

SEQ ID NO: 2431 - protein, 101 aa, Oryza sativa (japonica cultivar-group); identical to SEQ ID NO: 1654

SEQ ID NO: 2432 - protein, 661 aa, Triticum aestivum
IRHEAKANEAHLNAEKICHVLYPGDESSEGKILRLKQQYTLCSASLQDIISRFESRAGDSLNWEDFPSKVAVQMNDTHPTLCIPELMRILMDIKGLSWNEAWSITERTVAYTNHTVLPEALEKWSLDIMQKLLPRHVEIIETIDEKLMNNIVSKYGTADISLLKQKLKDMRILDNVDLPASVAKLFIKPKEKTGKLLVQSLESIAEGDEKTESQEEENILSETAEKKGGSDSEEAPDAEKEDPVYELDPFAKYDPQLPRVVRMANLCVVGGHSVNGVAEIHSEIVKQDVFNSFYEMWPTKFQNKTNGVTPRRWIRFCNPELSAIISKWIGSDDWILNTDKLAGLKKFADDEDLQSEWRTAKRNNKMKVVSLIRDKTGYVVSPDAMFDVQVKRIHEYKRQLLNILGIVYRYKKMKEMSAKDRIKSFVPRVCIFGGKAFATYVQAKRIVKFITDVAATVNYDPDVGDLLKVVFVPDYNVSVAEKLIPASELSQHISTAGMEASGTSNMKFAMNGCILIGTLDGANVEIREEVGEENFFLFGAHAPEIAGLRQERAEGKFVPDPRFEEVKEYVRSGVFGTSNYDELMGSLEGNEGYGRADYFLVGKDFPSYIECQQKVDEAYRDQKLWTRMSILNTAGSPKFSSDRTIHEYAKDIWDISPVIMP

SEQ ID NO: 2433 - protein, 166 aa, Triticum aestivum
  unsure (1)..(166): unsure at all Xaa locations
MAQESLRLVCPPVSAHEGRLPRQYTLEGQGAKKDISPPLEWYGVPDGTRSLAVVVQDVDADERVPWTHWVVVNISPEEKGLPEGFSGAGGNANAGGGDGGVQEGVNDWKQPGWRGPVPDSHGHRIQFRLYALDDVLSLGNKVTVDKVMXAIEGHVXLREAEITAGF

SEQ ID NO: 2434 - protein, 737 aa, Oryza sativa
FVESIVIGMPHRGRLNVLGNVVRKPLRQIFSEFSGGTKPAEEGEGLYTGTGDVKYHLGTSYDRPTRGGKHIHLSLVANPSHLEAVDPVVAGKTRAKQYYSNDLDRTKNLGVLLHGDGSFSGQGVVYETLHLSALPNYTTGGTIHIVVNNQVAFTTDPRAGRSSQYCTDVAKALDAPIFHVNGDDLEAVVHVCELAAEWRQTFHSDVVVDIVCYRRFGHNEIDEPSFTQPKMYKIIRNHQSALEIYQNRLLESGKISKEDIDKMQKKVSTILNDEFQNSKEYIPNKRDWLSAYWTGFKSPEQISRIRNTGVKPEILKRVGEAMTTLPENFKPHRAVKKIFELRRQMIETGEGIDWAVGEALAFATLIIEGNHVRLSGQDVERGTFSHRHAVIHDQETGEQYCPLDNLVMNQDEELFTVSNSSLSEFAVLGFELGYSMENPNSLVLWEAQFGDFSNGAQVIFDQFLSSGEAKWLRQTGLVVCLPHGYDGQGPEHSSARLERFLQMSDDNPYVIPEMDPTLRKQIQQCNWQVVNVTTPANYFHVLRRQIHRDFRKPLIVMSPKNLLRHKDCKSNLSEFDDLAGHPGFDKQGTRFKRLIKDQNNHKDLEEGIKRLVLCSGKVYYELDEERRKKERDDVAICRVEQLCPFPYDLIQRELKRYPNAEIVWCQEEPMNMGAYSYINPRLLTAMRALGRGTIDDIKYVGRAPSAATATGFYSVHVQEQTELVQKALQRDPINSPF

SEQ ID NO: 2435 - protein, 542 aa, Ipomoea nil
MAFGLSSLLQNSDLFTSDHASVVSMNLFVALLCACIVLGHLLEENRWVNESITALIIGLCTGVVILLLSGGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSRVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQMPSGHSSMTTSEPSSPKHFTVPLLDNQPDSESDMITGPEVARPTALRMLLRTPTHTVHRYWRKFDDSFMRPVFGGRGFVPFVAGSPVEQSPR

SEQ ID NO: 2436 - protein, 322 aa, Beta vulgaris
MDENYIRTCFAQSGELVNVKIIRNKQTMQSECYGFIEFSTHAAAERILQTYNNTLMPNVEQNYRLNWAFYGSGEKRGEDASDYTIFVGDLAPDVTDYTLQETFRVRYPSVKGAKVVIDRLTSRSKGYGFVRFGDESEQARAMSEMNGMMCLGRAMRIGAAANKKSVGGTASYQNNQGTPNDSDPSNTTIFVGNLDSNVTDEHLRQTFSPYGELVHVKIPAGKQCGFVQFTNRSSAEEALRVLNGMQLGGRNVRLSWGRSPNNRQSQPDQNQWNNAAYYGYPQGYDSYGYVSAPQDPNMYYGGYPGYGGYAMPQQAQMPLQQQ

SEQ ID NO: 2437 - protein, 428 aa, Zea mays
MASAGNSGSGDDDAGGKLLADRYQKGEVLGEGTYGVVFKAIDTKTGNTVAVKRIRIGKDKKEGVNFTALREIKLLKELKDPNIIELIDCFPYKENLHLVFEFMETDLEALIKDKNIILSPADTKSYVQMMLKGLAFCHKKWVLHRDMKPNNLLIGADGQLKLADFGLARVFGSPGRNFTHQVFARWYRAPELLFGSKQYGSGVDIWAAGCIFAELLTRRAFLQGSSDIDQLGKIFAALGTPKSSQWPDMVYLPDYVEYQYVAAPPLRTLFPMASDDALDLLSKMLTYDPKARISAQQALEHRYFSSLPAPTRPSQLPRPRRKGDQGNNKIPDLNLQDGPMVLSPPRKLRRVTAHEGMEGMHRTDKVDEHPSGMRHTDDMPSQSSRIPMSVDVGAVFGTRPAPRPTLNSADKSRLKRKLDMDPEFGYAE

SEQ ID NO: 2438 - protein, 212 aa, Synechococcus sp. PCC 7942
MSELQRLKGLLPPELQSWVFVEASAAVDPPLVTCEEIGRDEVEIQIDLLRWEQLAIDQRNLLFWHEVGRIQNDAIPRDGWEMAALAIGLGGAVGELWVRDGLLLLLALGLSGFAGYRLYLKNNSEKKLQEAIAADERAIALSTRFGYSLPNAYKSLGSAIKTLIEQTPKKKQRSFYENRLQALRRSAAKAKAKAQQQVAANPETFEDVYQQG

SEQ ID NO: 2439 - protein, 147 aa, Synechocystis sp. PCC 6803
MANWLEHSVQVEVDAPIELVWQLWSDLEQMPRWMKWIDSVKVLEDNPDLSRWKLASGSLEFTWLSRITKLISQQIIQWESVDGLPNRGAVRFYDRHGKSIVRLTIAYSVPGWLALLMDNLFLGRVVESTIQADLERFREYINNLQAS

SEQ ID NO: 2440 - protein, 568 aa, Schizosaccharomyces pombe
MSISFSELVAKTLLDLEVKVVFGIVGIPVIEICEAIQASGIRFVGFRNEQSAAYAATAYGYLTQRPGVCVVVGGPGVVHAMAGVFNSKTNRWPLLLLAGSSETFQQNCGAFQELDQVSYLSPHTKLAVRPPSPKMVVDSIRRAYRVSMTGTPGTCYVDLPANYIESTVDDFPKDPLPPIPSSPKCAPDPTQLQKAAYYLKNAKAPLLVVGKGAAYACAEKQLLEFVEHTGIPFLPSPMGKGLLPESHPLNVSSARSAALRNADVVLLAGARLNWIFQYGLPPKWSPNAKFIQIDTNAETLGNNAADLDLAIWADVGLTIDCLFKLVQTWKYSVGISTPYLRTLNETRSKNEKKALESRKSSIPLQMNYALYVVNEELQSLSLKSKRNITWVSEGANTMDRGRQLLEVTHPRGRLDAGTMSTMGVGMGYAIASAFAHSSDKIVVVEGDSAFGFSAMELETAIRNQLDLLVIVINNNGVYHGLDTDAYETLRDNHQLPTTALGTSIRYDQICEACGGKGFFVKNEEDLRSSLRKAWQTSSVSLINVMVDPEAARKLTFAWMSSTKVKPKL

SEQ ID NO: 2441 - protein, 244 aa, Zea mays
PTRPNTLQAEVENLSLQEQALDERISDMREKLRGLTEDENNKRWLYVTEDDIKGLPSFQNETLIAIKAPHGTTLEVPDPDEAGDYLQRRYRIVLRSTMGPIDVYLVSQFDEKFEELGGVATPVKHSSVPRHQPAEDFNTYAGQSSTPMDVAHDVQHGQKIPQDPSALHDFGGMTRISPSDVHTDSDYWLLTEGDVSMTDMWKTGQEVQWDQMDFLSEDVVTPRAHNQQPVTVDGPHMEVPSMDP

SEQ ID NO: 2442 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYCHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 2443 - protein, 470 aa, Gelidium latifolium
  unsure (1)..(470): unsure at all Xaa locations
GVIPYAKMGYWDPDYAVKETDVLALXRVTPQPGVDPVEASRAVAGESSTATWTVVWTDLLTACDLYRAKAYKVEEVPNSSDQYFAYVSYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDIYERAEFAKQLGTVIVMIDLVIGYTAIQSMAIWARKNDMILHLHRAGNSTYSRQKIHGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVVARNEGRSFVEEGPQILRDAAKTCGPLQTALDLWKDISFNYTSTDTADFVETPTANV

SEQ ID NO: 2444 - protein, 810 aa, Saccharomyces cerevisiae
MNTPQISLYEPGTILTVGSHHAKIIKYLTSGGFAQVYTAEISPPDPYSNANIACLKRVIVPHKQGLNTLRAEVDAMKLLRNNKHVVSYIDSHAARSVNGIAYEVFVLMEFCERGGLIDFMNTRLQNRLQESEILEIMSQTVQGITAMHALQPPLIHRDIKIENVLISHDGLYKVCDFGSVSGVIRPPRNTQEFNYVQHDILTNTTAQYRSPEMIDLYRGLPIDEKSDIWALGVFLYKICYYTTPFEKSGEAGILHARYQYPSFPQYSDRLKNLIRLMLMEAPSQRPNICQVLEEVSRLQNKPCPIRNFYLLRAMNQNANTQLAGEPSSTTYVPTQKFIPVQSLQSINQPPNMMPVTHVSTTPNLGTFPISINDNNKTEVTAHAGLQVGSHSNLTSPLMKTKSVPLSDEFASLYYKELHPFQKSQTFKSVESFQSPQRKSMPPLSLTPVNNDIFDRVSAINRPNNYVDSETQTIDNMAVPNLKLSPTITSKSLSSTKEIAAPDNINGSKIVRSLSSKLKKVITGESRGNSPIKSRQNTGDSIRSAFGKLRHGFTGNSVNNSRSASFDNNNVNGNGNNTNRRLVSSSTSSFPKFNSDTKRKEESDKNQRLEKRRSMPPSILSDFDQHERNNSRTGSRDYYRSHSPVKKTQASAKTTSKPTLIPDNGNVNINQEKKESIQRRVHNLLKSSDDPVTYKSASGYGKYTDIGTETSNRHSSVRITPITEEKFKKTLKDGVLDIKTKSNGKDKSRPPRPPPKPLHLRTEIQKIRNFSRLQSKKLPIERISSERTETIVDVNVDDLEADFRKRFPSKV

SEQ ID NO: 2445 - protein, 365 aa, Ipomoea batatas
MVGGGDFLAVQTHGGQYVQYDIFGNLFEVTSKYAPPITPIGRGAYGIVCSALNAETNEMVAIKKIADAFDNYMDAKRTLREIKLLRHLEHENVIAIKDVIPPPLRREFNDVYIATELMDTDLHQIIRSNQGLSEEHCQYFLYQILRGLKYIHSANVIHRDLKPSNLLLNSNCDLKICDFGLARTNLDNEFMTEYVVTRWYRAPELLLNSSDYTAAIDVWSVGCIFMELMNRKPLFQGKDHVHQMRLITELLGTPTDSDLGSIQNENARRYIRQLPLRPRQQLANGFPHVHPLAIDLMDKMLTFNPSKRITVEEALAHPYLAQLHDKSDEPICPVPFTDFEKQAYGEEQIKDMIYQEALAMNPGYA

SEQ ID NO: 2446 - protein, 168 aa, Enterococcus faecalis
MTKPTEEELKQTLTDLQYAVTQENATERPFSGEYDDFYQDGIYVDIVSGEPLFSSLDKYDAGCGWPSFTKPIEKRGVKEKADFSHGMHRVEVRSQEADSHLGHVFTDGPLQEGGLRYCINAAALRFVPVADLEKEAMANTFLYSNNPHFLDKYDKIVRKKATFDEYLV

SEQ ID NO: 2447 - protein, 119 aa, Oryza sativa
  unsure (1)..(119): unsure at all Xaa locations
AAEIAPYVMASSATSVAPFQGLKSTVAMRVARRSGNFSFGNVSNGGRIRCMQVWLIEGIKKSVTLSYLAALTVEDLLXXIEYLNTSKREPCLEFSKDXFVNRENHISXXXYDSKIWTIW

SEQ ID NO: 2448 - protein, 113 aa, Triticum aestivum
  unsure (1)..(113): unsure at all Xaa locations
SRSNFIVFNTNACVTMTAFLGENPQLLTVIXPQSLKNXPPESREISSKVQNXIEKPHXDHSXPLIEASRLCNMHIISKDQQAICFASHDNRLLMKTCHXAKNMRKIVTLFYLN

SEQ ID NO: 2449 - protein, 255 aa, Neurospora crassa
MSDSPQSNSKDVEQGAPSPGEEPQMNDPQDPHSSGLNQYEFEVKEQDRWLPIANEHFQNKRCAYSLYTSMSHHSSSKSPEAPRASSSSSKADRCDAYDANIRNFAPVARIMKNALPENAKIAKEAKECMQECVSEFISFITSEASEKCQQEKRKTVNGEDILFAMTSLGFENYAEALKIYLSKYREQQQNQTNRSENQQNRPSSQGYGAPQGQNQPGQGGFSSNDLGGQQESGDASGYNLYGAQTGHNGGGAEGY

SEQ ID NO: 2450 - protein, 398 aa, Leuconostoc mesenteroides subsp. mesenteroides ATCC 8293
MNSGDLAWVLVSAALVWVMTPGLALFYGGLGERRNLLHTMFIPVMIIGIASLVWFVVGYTLSFGGSGNVIGNFKHLFLTNVSFTHSTKDLTIPDGAFALFQGMFPIITAAIITGSVIGRVRIKALLVFIALWLIFIYSPLAHMVWGGGFLAQLGAIDFAGGTVVHISSGVTGLVLALMIGHRHIDKHIPVRPSYVLIGGALLWVGWFGFNSGSALAANGTAVLALVNTWLASAAAVLTWGLVEYKYHGRATLSGITSGGVAGLVAITPAAGFVAPWAAVVMGLLAGFIGFAGITFVKNSFGYDDTLDAFGIHGIGGAVGAILTGVFADKSVGGVAGLINGNISLVGKQLVAILFTIAFAAIGTYVLAKITELIAAPLRLTADEEAEGYDAIMHDLTVE

SEQ ID NO: 2451 - protein, 375 aa, Zea mays
MALMQESSSQDLLQAHDELLHHSLCFAKSLALAVALDLRIPDAIHHHGAGGATLLQILAETALHPSKLRALRRLMRVLTVTGIFSVVEQPPAGGGDDSTVHTSDDEAVVVYRLTAAPRFLVSDDVSTATLAPFVSLALQPIAACPHALGISAWFRQEQHEPSPYGLAFRQTPTIWEHADDVNALLNKGMAADSRFLMPIVLRECGETFRGIDSLVDVGGGHGGAAATIAAAFPHLKCSVLDLPHVVAGAPSDGNVQFVAGNMFESIPPATAVFLKKTLHDWGDDECVKILKNCKQAISPRDAGGKVIILDVVVGYKQSNIKHQETQVMFDLYMMAVNGVERDEQEWKKIFTEAGFKDYKILPVIGDVSVIIEVYP

SEQ ID NO: 2452 - protein, 269 aa, Oryza glumipatula
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGEDWMDDVRALASFLDTDDAWNLCA

SEQ ID NO: 2453 - protein, 426 aa, Opuntiella californica
  unsure (1)..(426): unsure at all Xaa locations
GESSTATWTVVWTDLLTACDLYRAKAYKVDAVPNTSDQYFAFIAYDIDLFEEGSIANLTASIIGNVFGFKAVKALRLEDMRLPVAYLKTFQGPATGIISERXRMDKFGRPFLGATVKPKLGLSGKNYGXVVYEGLKGGLDFLKDDENINSQPFMRWKERFLYSMEGVNRSVAASGEVKGHYLNVTAATMEDMYERAEFAKQLGSIIIMIDLVVGYTAIQTMAIWDRKNDLIFHLHRAGNSTYSRQKIHGMNFRVICKWMRMAGVDHIHAGTVVGKLEGDPLMIRGFYNTLLLPYLDINLPQGIFFEQDWASLRKVTPVASGGIHCGQMHQLLDYLGIDVVLQFGGGTIGHPDGIQAGATANRVALETMVVARNEXRDYVAEGPQILQGARKTCGPLQTALDLWKDITFNYTSTDTADFVETPTANV

SEQ ID NO: 2454 - protein, 184 aa, Oryza sativa
  unsure (1)..(184): unsure at all Xaa locations
LTTWLCAPTVMGSSATSVAPFQGLKSTAGLPVSRRSXTSGFGNXVTNAGRIKCMQVWPIEAIKKFETLSYLPPLTVEDLLXQIEYLLRSKWVPCLEFSKVGFVYRENHRSPGYYDGRYWTMWKLPMFGCTDATQVLKELEEAXKAYPDAFVRIIGFXTNVRQVXQLISFIAYKPPQVARSLVAN

SEQ ID NO: 2455 - protein, 436 aa, Arabidopsis thaliana
MGFQNEASSSSYTLKIPPPAREDSPLLGKGPPLSSQFKTFANVFIAVVGAGVLGLPYAFKRTGWLMGVLLLVSVSVLTHHCMMLLVYTRRKLDSFNAGISKIGSFGDLGFAVCGSLGRIVVDLFIILSQAGFCVGYLIFIGTTLANLSDPESPTSLRHQFTRLGSEFLGVSSKSLYIWGCFPFQLGLNSIKTLTHLAPLSIFADIVDLGAMAVVIVEDSMIILKQRPDVVAFGGMSLFLYGMGVAVYSFEGVGMVLPLESEMKDKDKFGKVLALGMGFISLIYIAFGILGYLAFGEDTMDIITANLGAGLVSTVVQLGLCINLFFTFPLMMNPVFEIVERRFSRGMYSAWLRWVLVLAVTLVALFVPNFADFLSLVGSSTCCVLGFVLPALFHLLVFKEEMGWLQWSSDTAIVVLGVVLAVSGTWSSLSEIFSVKV

SEQ ID NO: 2456 - protein, 427 aa, Batrachospermum cayennense
  unsure (1)..(427): unsure at all Xaa locations
IEAAAAVAGESSTATWTVVWTDLLTACDLYRAKAYKVDAVPNADDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFAIEGVNRAQAGTGEIKGHYLNVTAATMEDMYERAEYAKELGSVICMIDLVIGYTAIQTMAVWARKADMILHLHRAGNSTYSRQKIHGMNFRVICKWMRMAGVXHIHAGTVVGKLEGDPLMIRGFYNTLLLGHLDINLPQGIFFEQDWASLRKVTPVASGGIHCGQMHQLLDYLGNDVVLQFGGGTIGHPDGIQAGATANRVALECMVMARNEGRDYVNEGPQILKEAAKTCGPLQTALDLWKDITFNYTSTDTADFV

SEQ ID NO: 2457 - protein, 346 aa, Bartonella henselae
MAERLKKNSASVVHNALSNTTKKAKIANFTKEEEIDAYREMLLIRRFEEKAGQLYGMGLIGGFCHLYIGQEAVVIGTLKAAKEGDQVITSYRDHGHMLAVGMSPRGVMAELTGRQGGFSKGKGGSMHMFSKEKNFYGGHGIVGAQVPIGSGLAFSNQYLGKDNVTLVYFGDGAANQGQVYESFNMASLWKLPVVYIIENNQYAMGTSVARASAETDFSRRGLSFEIPGIVVDGMDVRAVKGAADEAITWTRSGKGPIILDMQTYRYRGHSMSDPAKYRSKEEVQKIKEEQDPIDQVRNRILQQGFASEDDLKSIDKEVRAIVADAVDFAQSDQEPDASELYTDILV

SEQ ID NO: 2458 - protein, 392 aa, Escherichia coli
KITLQNGKLNVPENPIIPYIEGDGIGVNVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 2459 - protein, 172 aa, Zea mays
  unsure (1)..(172): unsure at all Xaa locations
MTCDENVVYDSFSVRXHIIGENDEFIGKKAAYALSQNVKVIACIGELXXXXXXXXXFDVCFRQMKAFADSISNWADVGIAYEPVWAIGTGKVATPEQAQEVHAAVRNWLTTNISPDVASSTRIIYGGSVNAANCAELAKKEDIXXXXXXXXSLKAPDFATIINSVTAKKVAA

SEQ ID NO: 2460 - protein, 385 aa, Ipomoea batatas
KIFVLTQFNSASLNRHISRTYFGNGVSFGDGFVEVLAATQTQGETGMKWFQGTADAVRQFTWVFEGAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLFRLLRWRYPTSNDFGSEILPAAVMEHNVQAYIFRDYWEDIGTIKSFYDANLALTEEFPKFEFYDPKIPFYTSPRFLPPTKIDNCKIKDAIISHGCFLRECTVEHSIIGERSRLDCGVELKDTLMMGADTYETESEIASLLADGKVPIGVGENTKIRNAIIDKNVRIGKDVVITNKDGVQESDRPDEGFYIRSGITIIMEKATIRYGTVI

SEQ ID NO: 2461 - protein, 61 aa, Triticum aestivum
NYGSFQGRCVICGGVGISDAYYCKECTQQEKDRDGCPKIVNLGSAKTDLFYERKKYGFKKR

SEQ ID NO: 2462 - protein, 511 aa, Zea mays
MASNGCNGNGNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 2463 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGAPSPVKHPELTDMVIFRENSEDIYAGIEWKADSADAEKVIKFLREEMGVKKIRFQEHCGIGIKPCSEEGTXXXVREAIEYAIATDGDSVTLVPKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTESADLIVKGMEGAINAKTVTYDFERLMEGAKLL

SEQ ID NO: 2464 - protein, 117 aa, Zea mays
  unsure (1)..(117): unsure at all Xaa locations
QRPEGIFGXFQQVYEPSQKPQLVLQLQAGLCPKDLSPTELSGXCKAKSSKFRFQVAHPPFRPDMTEAATHLACENLSLLVAKPYKEAHSMTIVXMKDRMSDLLQSLGIVPGLSEGMK

SEQ ID NO: 2465 - protein, 392 aa, Synechocystis sp. WH 8501
MHFAQRIQALEKNVFADMDRAKSQAISKGKKIIDLSLGSSDLPADPEAIATISASLEDPSTYGYLLHHGTLNFRETVGQWYSNRFGVEVDPQREVLTLIGSQEGTAHLPLALLDPGDFALLLDPGYPSHAGGVYLAGGQIYPMPLLAENDFLPVFEDIPSQVLGQAKLMVLSYPHNPTTATASLSFFQEAVNFCRNHGLVLVHDFPYVDIVFEGMTQPPSILQADTQKSLSIEFFTLSKSYNMGGFRIGYAIGNAEIIQALRQVKAVVDFNQYQGILNGAIAALTGEQTTVKKTLARFQSRRDAFIKALNNIGWQVTPPQATMYVWAKLPQTWENKSVEFSTELVAATGVAVSPGAGFGKQGEGYVRFALVHDPHVLELAVEKIAQFLATRT

SEQ ID NO: 2466 - protein, 389 aa, Zea mays
HETITYNILIEKSRGATTPQAQPYKSTNKVEFYGPLGLGKPMEEMLMAGNANPNPPPAAAPSAPGAQTQSQRGGGAPPPAAGAAAPSAGATVGAAGTERRARPHKEKALNCPRCNSTNTKFCYYNNYSLQQPRYFCKTCRRYWTEGGSLRNVPVGGGSRKNKRSSSSAASTSAAMSGTVSVKNPKLVHEGAHHDLNLAFPHHNNGRALQPPEFPSSFPNLESSSVCYPGAAMLGNGAAGRGMGALSAMELLRSTGCYVPLQHVQLGMPAEYAAPAGFTLGEFRIPPPPQSQSVLGFSLDTHGTGGYSAGGLQESAVGRMLFPFEDLKPAVSAAGGGASNDGADHRQNDHRKDQAAGDGSSVTGGHETPGGFWSNSLIGNGSSNGGGGHW

SEQ ID NO: 2467 - protein, 239 aa, Triticum aestivum
RAGLFINNEFVKAVDGKTFEVINPSTEEVICNVAEATEKDVDIAVAAARKAFNGPWRKETPENRGKLLVKLADLFEKNADLLASVEALDNGKAFSMARNVDIPAAAGCLRYYGGWADKIEGKVVDTAPDSFNYIRKEPIGVCGQIIPWNFPILMWSWKIGPAIATGNTVVIKTAEQTPLSAYVACKLIQEAGFPPGVINVITGFGKVAGAAISAHMDVDKVAFTGSTVVGRQIMKAAAG

SEQ ID NO: 2468 - protein, 172 aa, Prunus persica
HDEIDFEFLGNLSGDPYILHTNVFTQGKGNREQQFYLWFDPTKDFHTYSILWNPQSIIFSVDGTPIRQFKNLESKGIPFPKNQAMSIYSSLWNADDWATRGGLVKADWSKAPFTASYRNFNAQACTWSSGSSRCSSSSSSGSSSWLSQSLDATGQERIKWVQKNYMIYNYCT

SEQ ID NO: 2469 - protein, 479 aa, Gelidium sesquipedale
RIKNQRYESGVIPYAKMGYWDPDYAVKETDVLALFRVSPQPGVDPVEASAAVAGESSTATWTVVWTDLLTACDLYRAKAYKVEQVPNSSDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARRNDMILHLHRAGNSTYSRQKNHGMNFRVICKWMRMAGVDHIHAGTVVGKLEGDPLMIKGFYNTLLESHLDKNLPQGIFFEQDWASLRKVTPVASGGIHCGQMHQLLDYLGVDVVLQFGGGTIGHPDGIQAGATANRVALEAIVIARNEGRDYVEEGPQILRDAAKTCGPLQTALDLWKDISFNYTSTDTADFVETPTANV

SEQ ID NO: 2470 - protein, 329 aa, Neurospora crassa
MADFVAPPPGPPPPKVPEGWVARWNEQYKECDRPTIKRIITNTILTRFYVNTYTKKSQWEKPTEPAVPPRDESAPAGPPPSYSAGDSKPVVSDTKSNNPYDNPANRAGGNGGGPSAYEDEDARLARQLQAEEDARAAAAANQRGHTPSGQQSPFPSQLPPRPETNDRGGSKGSFLGKIFGAAGKGKHSGSSSHGYGGGGGYPAQGYSPAPYGGSPAPYGQPQQPMYGQQPPVGYGGYPQQGGYGGYAPPQGYYGGGGYPQQQQAYGAPGRSGGGGGMGMMGGAALGLGAGVLGGALIADAVNDHDQEIYQEGYNDGQDGDMDFGGGDDF

SEQ ID NO: 2471 - protein, 407 aa, Arabidopsis thaliana
MALSSLLRSAATSAAAPRVELYPSSSYNHSQVTSSLGFSHSLTSSRFSGAAVSTGKYNAKRVQPIKATATEAPPAVHSFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 2472 - protein, 348 aa, Saccharomyces cerevisiae
MSIPETQKGVIFYESHGKLEHKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 2473 - protein, 463 aa, Chondracanthus corymbiferus
MGYWDPDYVVKDTDVLALFRVSPQPGVDPVEASAAVAGESSTATWTVVWTDLLTACDLYRAKAYKVDPVPNVSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRAIAAAGETKGHYLNVTAATMEEIYERAEFAKQLGSMIIMIDLVIGYTAIQTMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVSEGPQILQDAAKTCGPLQTALDLWKDITFNYTSTDTADFVETPTANV

SEQ ID NO: 2474 - protein, 95 aa, Raphanus sativus
MALVRSLLGAKKILGQATASTSKRATMAAPPKGFLAVYVGESQKKRYVVPISYLSQPSFQALLSKSEEEFGFDHPMGGLTIPCPEDTFINVTSRL

SEQ ID NO: 2475 - protein, 324 aa, Shewanella oneidensis MR-1
MQQLFVQLLEERYFNRLPEALVLKFATESADFVRFWLVHCMRSMVSERELAIALFFSAEWELEELASLKSFWGSYVAMEEAQEVKATFCHFVPWLKTISPHHEDAICVFSALWFFEHRPTSVGKQLQSATLSHSQLPVSLLDDIKLFSLPHLRPITVYGHQGKGSVESGIRNNMHYPTPIPNDNLAMACVERVIAKFAGIKLAFAEPIVVLRYEPGQFYQWHYDAIHAYTAEIQAELERFGQRSRTAILYLNDDFEGGETEFKAPYIQVKPETAAILVFDNTDQTGKPIPSSLHRGCEVTAGKKWVCTQWFRDKPFWLRAGLLA

SEQ ID NO: 2476 - protein, 475 aa, Rhizobium sp. NGR234
MKHARKFYIDGEWVEPSVSKTLEVIDPSTEQPMGTIALGSAADAEKAVAAARRAFASYSQTSKQERVELLRRILTILKRRNDELGDIISREMGAPLAMARAEQAGIGAAHFEQAIKSFETFAFDYMQGTTRIVHEPVGVVAMITPWNWPINQIACKVAAALATGCTMVLKPSEIAPFNAVLFAEIMDEAGVPKGVFNLVQGDGPTVGAALASHPDVDMVSFTGSTRAGIAVAQAAAPTVKRVHQELGGKSPNIILRSADFPAAVAAGVRRCFGNSGQTCTAPTRMLVPAERMDEAGAIAARQADALVVGPPSDSRTDLGPVASAAQFDKIQALIERGIAEGAELVAGGLGRPSHLNAGYYVRPTVFARVTNQMSIAREEIFGPVLSIIGYDSEDEAIAVANDTPYGLAAYIQGDPKETRALAGKLRSGTVRLNSSGWDSAAPFGGYKQSGNGREYGKFGLHEFTEIKGIVGFLNE

SEQ ID NO: 2477 - protein, 184 aa, Glycine max
WQPTSIVSYNHLGNNDGMNLSAPQTFRSKEISKSNVVDDMVNSNAILYEPGEHPDHVVVIKYVPYVGDSKRAMDEYTSEIFMGGKSTIVLHNTCEDSLLAAPIILDLVLLAELSTRIQFKAENEGKFHSFHPVATILSYLTKAPLVPPGTPVVNALSKQRAMLENIMRACVGLAPENNMILEYK

SEQ ID NO: 2478 - protein, 81 aa, Haemophilus somnus 2336
MKIAVLGAAGGIGQALALLLKLQLPAGSELSLYDIAPVTPGVAADVSHIPTAVKIQGFAGEDPIPALENADVVLIFCRCCS

SEQ ID NO: 2479 - protein, 249 aa, Zea mays
MFGYQKGLDVEAGTSGAAATGGARQLYPGMQESPELRWALIRKIYVILSLQLLLTAVVAAVVVKVRAIPHFFTTTSAGLGLYIFLIILPFIVLCPLYFYHEKHPVNLILLGLFTVAISFAVGMTCAFTSGKVILESAILTTVVVLSLTAYTFWAVNRGKDFSFLGPFLFAAIIVLLVFALIQILFPLGKLSQMIYGGLASLIFSGYIVYDTNNIIRRYTYDQYVWAAVSLYLDVINLFLSLMTLFRAAD

SEQ ID NO: 2480 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPTELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 2481 - protein, 511 aa, Oryza sativa
MVASKLGIEMGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGYLLSTMTNYSSKFGHAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 2482 - protein, 433 aa, Grateloupia kurogii
KDTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEEMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIAPNEGRDYVAEGPQILQDAAKTCGPLQTALDLWKDI

SEQ ID NO: 2483 - protein, 321 aa, Geobacter metallireducens
MGTGRNGGRAIVATGLGQCCWDTLAVVDSYPSPDSKAEAAVWAEQAGGPTATALVALARLGIPCRFAGVVGDDDAGSRIRQALDSEGVDGAFLVTRRRGASQRAFIMIERGSGRRTIVWRRPTGDPLDPREVPDAFLAGSSLLLLDGLMADASLHAAGRARSLGIPVMVDAGRMRPGMLDITRQCDYVVAAEQFFLDLGWDRTPEHFRGLAADLGAPVVTVTLGAAGSLTWSGHEPFHVPAFTVDAVDTTGAGDVFHGGYGYGILQGWSVRETVVFASAMAAMKCRQVGAQQGIPRLPDVLEFLTRRTITVLSNPQTEVSP

SEQ ID NO: 2484 - protein, 256 aa, Actinobacillus pleuropneumoniae serovar 1 str. 4074
MARRPLVMGNWKLNGSKAFTKELIAGLKAELADVKGCDVAIAPPVMYLAEAEAALAGQSVIALGAQNVDVNVQGAFTGDISTEMLKDFGAKYIIIGHSERRTYHKECDTFIAKKFAALKAAGLVPVLCIGETEAENEAGQTEAVCAKQIDAVIDALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAEKAKA

SEQ ID NO: 2485 - protein, 371 aa, Triticum aestivum
  unsure (1)..(371): unsure at all Xaa locations
PTRPREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGXLVVPGIYYSDDKMLQCRVFAYADTQRYRLGPNYLMLPVNAPKCGFKNNHYDGAMNFMHRDEEVDYYPSRHAPLRQAEPASFPVPTRPVVGKREKTRIKKENDFVQPGERYRSWAPDRQDRFVRRFADALAHPKVSHELRVIWIDFLSKCDKSCGMKVANRLNVKPSM

SEQ ID NO: 2486 - protein, 499 aa, Brassica oleracea
MGKVAVGATVVCAAAVCAASVYIVRRRMQSSGKWARVIEILRVLEEDCATPIGKLRQVADAMTVEMHAGLASEGGSKLKMLISYVDNLPSGEEHGFFYALDLGGTNFRVMRVLLGGKQGRVVKQEAKEVSIPPHLMTSGSDELFNFIAEALANFVATEGEDFHLPEGRQRELGFTFSFPVKQTSLSSGTLIKWTKGFSIEDTVGQDVVGALVKAMERVGLDMNVTALVNDTVGTLAGGRYYNPDVVAAVILGTGTNAAYVERAHAIPKWHGLLPKSGEMVINMEWGNFRSSHLPLTEYDHLLDFDSLNPGEQILEKIISGMYLGEILRRVLLKMADEAAFFGDSVPPKLRIPFIIRTPNMSAMHSDTSPDLKVVGSKLKDILEVPTTSLKMRKVVVSLCDIIACRGARLSAAGIYGILKKLGRDAPKDGETQKSVIAMDGGLFEHYTQFSECMESSLKELLGDEASDSVEVIHSNDGSGVGAALLAASHSQYLDDSQTS

SEQ ID NO: 2487 - protein, 789 aa, Escherichia coli
MLMANYGFCTIFAATSGNKGRKIHMKWLCSVGIAVSLALQPALADDLFGNHPLTPEARDAFVTELLKKMTVDEKIGQLRLISVGPDNPKEAIREMIKDGQVGAIFNTVTRQDIRAMQDQVMELSRLKIPLFFAYDVLHGQRTVFPISLGLASSFNLDAVKTVGRVSAYEAADDGLNMTWAPMVDVSRDPRWGRASEGFGEDTYLTSTMGKTMVEAMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGTAADPEDAVRVALKSGINMSMSDEYYSKYLPGLIKSGKVTMAELDDAARHVLNVKYDMGLFNDPYSHLGPKESDPVDTNAESRLHRKEAREVARESLVLLKNRLETLPLKKSATIAVVGPLADSKRDVMGSWSAAGVADQSVTVLTGIKNAVGENGKVLYAKGANVTSDKGIIDFLNQYEEAVKVDPRSPQEMIDEAVQTAKQSDVVVAVVGEAQGMAHEASSRTDITIPQSQRDLIAALKATGKPLVLVLMNGRPLALVKEDQQADAILETWFAGTEGGNAIADVLFGDYNPSGKLPMSFPRSVGQIPVYYSHLNTGRPYNADKPNKYTSRYFDEANGALYPFGYGLSYTTFTVSDVKLSAPTMKRDGKVTASVQVTNTGKREGATVVQMYLQDVTASMSRPVKQLKGFEKITLKPGETQTVSFPIDIEALKFWNQQMKYDAEPGKFNVFIGTDSARVKKGEFELL

SEQ ID NO: 2488 - protein, 354 aa, Trichodesmium erythraeum IMS101
MVNTQAREDLHIRLEETQLLDRDCTTLSRHVLQQLHFSPDAQDISSLMNRIGLAGKLIARRLTRAGLLEDTLGFTGTVNVQGESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISNQG

SEQ ID NO: 2489 - protein, 404 aa, Tropheryma whipplei TW08/27
MSERISKRCSKLGESVTLSIDSKAKRMKKAGKPIISYAAGEPDFPTPEHIVSRCQLAAATRSNHVYTETAGLAELREAIAEKTLADSFLKVSESQILITNGCKQAVYMACQTILDPNDEVILPTPYWTTYPESIRAAGAKVVIPATDSFYVTVDQLQSVLTNKTKAIILSSPSNPSGAVYSLDSLRDIARFAKKHGIWIISDEIYQNIYYSGRVAPGFGEALPEIKDQLILVNGLSKTYAMTGWRIGWMIGPQDIINASVKLQSHICSHVSNIMQQAALEALTGPQDCVAYMRDEFKKRRDLMLRELGRIKGLSIPKPDGAFYIYPDVSAFIGRRIAGRMIHSSFELAELVLSETLVATVPGEAFGTKGHLRLSYALDETSLLEGTGRLVEFFDTANSDMTKVF

SEQ ID NO: 2490 - protein, 261 aa, Maackia amurensis
MASSKERETFVYVAKLAEQAERYEEMVDSMKNVATLDVELTVEERNLLSVGYKNVIGARRASWRILSSIEQKEEAKGNEVNAKRIKEYRQKVESELTNICNDVMRVIDEHLIPSASAGESTVFYYKMKGDYYRYLAEFKTGNEKKEAGDQSMKAYESATAAAEAELPPTHPIRLGLALNFSVFYYEILNSPERACHLAKQAFDEAISELDTLNEESYKDSTLIMQLLRDNLTLWTSDIPEDGEDAQKANGTAKLGGGEDAE

SEQ ID NO: 2491 - protein, 593 aa, Paracoccus pantotrophus
MKMTTEEAFVKTLQLHGIEHAFGIIGSAMMPVSDLFPKAGITFWDCAHETNAGMMADGFTRSTGKMSMAIAQNGPGVTGFVTPVKTAYWNHTPLLLVTPQAANRTIGQGGFQEMEQMRIFADCVCYQEEVRDASRIPEVLNRVIMQAWRNSAPAQINIPRDFWTQVIDVELPQVVGFERPAGGEQAVTEAARLLSEAQFPVILSGAGVVLSGAIPDLVRLAERLDAPVCSNYQHNDSFPGSHPLAMGPLGYNGSKAAMEIIAKADVVLALGTRLNPFSTLPGYGIDYWPKEAKIIQVDINADRIGLTKKVTVGIQGDAAKVARGILAQLAPMAGDAGRAERKALVAQTKSRWAQELSSLDHEEDDPGTVWNADARKRDAGLMSPRQAWRAIMQAVPQEAIVSSDIGNNCAIGNAYPSFEAGRKYLAPGLFGPCGYGFPAILGAKIGNPDVPVIGFAGDGAFGISMNEMTACGRDDWPAITMVIFRNYQWGAEKRNTTLWYDNNFVGTELDRDTSYAKIAEACGLRGVQVKSQDELTAALHDAVERQMKNRETTFIEVLLNQELGEPFRRDAMKKPVVVAGIDPADMRPQQGAA

SEQ ID NO: 2492 - protein, 508 aa, Haemophilus influenzae Rd
MSSQCPFSHLAATNLTMGNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFRTQQGIKNLTDAEAAEIIANDRESHQRDLYEAIERGDFPKWTLFVQIMPEADAEKVPYHPFDLTKVWSKKDYPLIEVGEFELNRNPENFFADVEQSAFAPSNLVPGIGASPDRMLQARLFNYADAQRYRLGVNYRQIPVNRPRCPVHSNQRDGQGRVDGNYGSLPHYEPNSFSQWQQQPDFAEPPLRINGDAAHWDYRNDDNDYFSQPRALFNLMNAEQKQSLFNNTAAAMGDAPDFIKYRHIRNCHWCDAAYGEGVAKALGLTVEDALKARDTDPALGQGGLL

SEQ ID NO: 2493 - protein, 73 aa, Triticum aestivum
  unsure (1)..(73): unsure at all Xaa locations
CVRIRKGHVWNGNAPLPGRLRGAILLGDDHLIEKLXSFDRLPIPERDVNARGASAKGFFEVTNDVISRTCADF

SEQ ID NO: 2494 - protein, 482 aa, Ascoseirophila violodora
NRTRIKSERYESGVIPYAKMGYWDADYNVKATDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLSEGLFFDMDWAALRKCVPVASGGIHCGQMHQLLYYLGDDVVLQFGGGTIGHPDGIQSGATANRVALESMGLARNEGRDYVGEGPEILRRAATTCGPLKAALDLWKDITFDYTSTDTPDFVEVATESR

SEQ ID NO: 2495 - protein, 171 aa, Zea mays
  unsure (1)..(171): unsure at all Xaa locations
MAATAMMASSDTAGAAFQGLKCTVSLPIVRRSFRSLXGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 2496 - protein, 800 aa, Oryza sativa
  unsure (1)..(800): unsure at all Xaa locations
WLGFEFGLLPQRDANVLVWSYYRHVLLLAYQSCGVVYGDLSTSPLYVYKSTFIIGSLRRFQDEEIVFGVFSLVFWTLTLIPLLKYVFIVLAADDNGEGGTFALYSLHGWRHAKFSLMPNQEAADEELTSYYRPGYXAPQETPILTALRRFLENHRKSRTFLLVTVLFGASLVIGDGVLTPPMSVLSSFSGLQVHSTALTSGEVEILSCTVLVCLFMVQHWGTHRVAFLFAPVVIVWLLLLGALGVYNIVVWNPRVLRALSPYYLVRFFQHTGKDGWISLGGILLSMTGTEAMYADLGHFTAASIRVAFVGLIYPCLVLQYMGQAAFLSKSPHCDIHFVFFESIPTGIFWPVLVIATLAAIVGSQAVISATFSIVRQCTALGCFPRVKIVHTSRRIHGQIYSPEINWILMLLCIAVTMGLRDTTLIGNAYGMACAGVMLVTTLLMALVIVFVWQYSCLVAALFLVAFGVVEAVYLSAALMKVPQGGWLPLVLSLVFVAVMYVWHYGTRRKHQFDVQNKVSLRWIHALGPSLGIVRVPGIGIIYSELATGVPAIFSHFVTNLPAFHQVLVFICVKAVPVPHVRDEERHLVGRIGPREFRMYRCVVRHGYKDVLAEDTDFENDLVLRIAEFVQMEADFDQRCSISDDGVVASVEVEGRMAVVPRPSDLARTGLLMREPGEEESVVARAAAAAKPESLIHSMHTMHEAESPGFASRRRVRFEVANQHTDPRVKEELSALVEAKHAGVAYIMGHSYIKARKSSSVFKKFAVNVAYAFLRKNCRGPGLVLNIPHISLIEVGMIYYV

SEQ ID NO: 2497 - protein, 256 aa, Vibrio vulnificus CMCP6
MRRPVVMGNWKLNGSKTMVAELLTGLNAELEGVEGVDVAVAPPALYIDLAERLIAEGGNKIILGAQNTDINNSGAFTGDMSPAMLKDFGATHIIIGHSERREYHNESDEFVAKKFAFLKENGLKPVFCIGETEAQNEAGETEAVCARQINAVIDAYGVEALNGAIIAYEPIWAIGTGKAATAEDAQRIHASIRAMIAAKDAAVAEQVIIQYGGSVKPENAEAYFAQPDIDGALVGGASLDAKSFAAIAKAAAKMKA

SEQ ID NO: 2498 - protein, 228 aa, Crocus sativus
MGRGKIEIKRIENTTNRQVTFCKRRNGLLKKAYELSVLCDAEVALIVFSTRGRLYEYANNSVKGTIDRYKKACTDTSNSGTVSEANSQYYQQEASKLLQQIAQLQNSNRNLMGESLSTMSPRELRQLEGKLEKGINKIRAKKNELLYAEIEYMQKREMELQNDNMYLRNKISENERAQQHMNMLPSATATEYEAMPPFDSRSFLQANLVDPNHHYSHQQQTALQLGFV

SEQ ID NO: 2499 - protein, 330 aa, Glycine max
MASTNALPPTGNGLIVSFGEMLIDFVPTVSGVSLAEAPGFLKAPGGAPANVAIAVARLGGKAAFVGKLGDDEFGHMLAGILKENDVRSDGINFEKGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFRGSVEAFHVNTVDTTGAGDSFVGALLSKIVDDQSILEDEARLREVLKFTNACGAITTTKKGAIPALPTEADALKLIKEA

SEQ ID NO: 2500 - protein, 306 aa, Bacillus halodurans
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIQDM

SEQ ID NO: 2501 - protein, 62 aa, Brassica napus
MRGILVDWLLEVHVKFELNLETLYLTVNIIDRFLSVKAVPKRELQLVGISALLIASKYEEIY

SEQ ID NO: 2502 - protein, 842 aa, Nostoc sp. PCC 7120
MRAVLMAGGSGTRLRPLTCDLPKPMVPILNRPIAEHIINLLKRHHITEVIATLHYLPDVLRDYFQDGGDFGVQMTYAVEEDQPLGTAGCVKNIAELLDETFLVISGDSITDFDLGEAIAFHKQKQSKATLILTRVPNPIEFGVVITDEAGKIKRFLEKPSTSEIFSDTVNTGTYILEPEVLEYLPSNTECDFSKDLFPLLLAKDEPMYGYVAEGYWCDVGHLDAYREAQYDGLDRKVKLDFAYRENSPGLWIGQNTYIDPSAHIEAPAVIGNNCRIGARVQIEAGTVIGDNVTIGADANLKRPIVWNGAIIGEEAQLSACVISRGTRVDRRAHVLEASVVGSLSTVGEEAQISPGVRVWPSKKIESGAILNINLIWGNTAQRNLFGQRGVQGLANIDISPEFAVKLGAAYGSTLKPGAKVTVSRDQRNVSRMVTRSLIAGLMSVGVDIQNLDATAIPIARTVIPTMGVAGGIHVRVHPDRADYILIEFMDHKGINISKAQEKKIEGAYFKEDMRRALTHEIGDVAYPSQVIDLYCTAFEKLLNVSTLNNSRAKVVIDYVYAVSGAVLPQMLDKFGADAVVLNASLNKNAVTTTDRETLLTQLGHVVEALKANFGVQVSANGEQLILVDESGYPIRGELLTALMVDMILTSNPRGTVVVPVHASSAVEQVARRHDGRIIRTKANATALMEACQKNPNVVLGGSGETGFIFPQLHPGFDSMFCIAKIIEMLTIQERSLATVRSELPRVIYRTHTIRCPWSAKGALMRYLVETHPAQNLELIDGVKIRQPFDDSWLLVLPDASEPLVHLYANSHERDWVDETVRDYRSRVQSFVERQQEYHPAEV

SEQ ID NO: 2503 - protein, 341 aa, Oryza sativa
MAKNACKLCYRRFASPRALAGHMRSHSVAAANAAAAAAAAAAAKLQISSASSASTSFTAADEEEEEEEEEEDVGFKKPLSIYALRENPKRSLRVSEYAFSDRESEAESTPTPAAKGLRAGGGGGGGDGEPMSSLSYAGTPEEEVALALMMLSRDTWPSVERGGGGGEYSDDGSDDGYALPPPSPAPAPAPVPEKRTRFQCPACKKVFRSYQALGGHRASHVRGGRGGCCAPPVAPPPQPHPQPPLPEHDAGEEDMDGKAPPHECPYCYRVFASGQALGGHKKSHVCSAAAAAAHAQTPGGGAPPPQPKILGMIDLNFAPPVDEVELSAVSDPHFPSNPPGP

SEQ ID NO: 2504 - protein, 539 aa, Bacillus subtilis subsp. subtilis str. 168
MNQLHRRMGTFSLMMVGLGSMIGSGWLFGAWRAAQIAGPAAIISWVIGMVVILFIALSYSELGSMFPEAGGMVKYTQYSHGSFIGFIAGWANWIAIVSVIPVEAVASVQYMSSWPWEWAKWTSGLVKNGTLTGEGLAFASVLLLIYFLLNYWTVNLFSKANSLITIFKIIIPGLTIGALLFVGFHGENFTGGQSIAPNGWASVLTAVATSGIVFAFNGFQSPINMAGEAKNPGKSIPIAVVGSLFVATVIYVLLQIAFIGAVNPSDIAHGWSHLNFNSPFADLAIALNINWLVIVLYADAFVSPSGTGITYTATTSRMVYGMEKNKYMPSIFGKLHPIYGVPRQAMFFNLIVSFIFLFLFRGWGVLAEIISVATLISYITGPITVMTLRRTGKDLYRPLRLKGLNVIAPLGFIFASLVLYWARWPLTGQVLFIILIGLPIYFYYQAKAKWKGFGRNFKAGVWMVFYLLAMMVISYLGSDKFGGLNVIHYGWDMVLIAMVSLVFYVWALKSGYQTEYLKDAKEINSQLLNGQSEAAAGKE

SEQ ID NO: 2505 - protein, 120 aa, Zea mays
  unsure (1)..(120): unsure at all Xaa locations
GRVNPIVGDDLLVTNPKRIADAIDKKACNALLLKLVNQIGTVTESIQAALDSKAAGWGVMVSHRSGETEDNFIADLAVGLXQIKTGAPCRSERLAKYNQLLRIEEELGNVRYAGEAFRSP

SEQ ID NO: 2506 - protein, 487 aa, Escherichia coli CFT073
MTRRGKCRGALPSDTLSRGFRMGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIRKILRAEGSEIRLRMWLYPWLTWLVIGFITFVLVVMLFRPAQQLEVISTGLLAIGIICTVPIMARWKKLIMWQKTPIHNTR

SEQ ID NO: 2507 - protein, 463 aa, Synechocystis sp. PCC 6803
MVSLTPNPSYSVSLLLELPNHAGTLASVTQAIADAGGSFGQISLIESNLKLTRREIAVDASSSEHAEKIIGAVKALDNVKLLKVSDRTFDLHRQGKISVVSRIPLTSQSDLAMAYTPGVGRICRAIAEDPEKVYSLTIKSNTVAVVTDGSAVLGLGNLGPEAALPVMEGKAMLFKEFAQLDAFPICLDTQDTEEIIRTVKAIAPVFGGVNLEDIAAPRCFEIEARLKKELNIPVFHDDQHGTAIVTLAALLNALKFVGKAMAAVRIVINGAGAAGLAIAELLKESGATDIWICDSKGIVGKHRTDLNSKKQSFAVDAEGTLADAMAGADVFLGVSAPGVVTKEMVQSMAKDPIVFAMANPIPEIQPELIQEDAAVIATGRSDYPNQINNVLAFPGVFRGAIDCRASIITTTMCIEAAKAIASLVHSNTLDSEHIIPSVFDNRVATTVASAVQLAARNEGVAGQ

SEQ ID NO: 2508 - protein, 77 aa, Zea mays
  unsure (1)..(77): unsure at all Xaa locations
GEPQDSGISLXIVFELXPPILIFRVCMGLRCITEAFGGKVIRAPSGMTHEKISPVHYDEELGNSLFNGLPNSSSAGM

SEQ ID NO: 2509 - protein, 366 aa, Bacillus coagulans
MKMKLAVLPGDGIGPEVMDAAIRVLKTVLDNDGHEAVFENALIGGAAIDEAGTPLPEETLDICRRSDAILLGAVGGPKWDHNPASLRPEKGLLGLRKEMGLFANLRPVKAYATLLNASPLKRERVENVDLVIVRELTGGLYFGRPSERRGPGENEVVDTLAYTREEIERIIEKAFQLAQIRRKKLASVDKANVLESSRMWREIAEETAKKYPDVELSHMLVDSTSMQLIANPGQFDVIVTENMFGDILSDEASVITGSLGMLPSASLRSDRFGMYEPVHGSAPDIAGQGKANPLGTVLSAALMLRYSFGLEKEAAAIEKAVDDVLQDGYCTGDLQVANGKVVSTIELTDRLIEKLNNSAAGPRIFQ

SEQ ID NO: 2510 - protein, 189 aa, Glycine max
  unsure (1)..(189): unsure at all Xaa locations
MASDGFTDKNTVFRKLKAKSENKMCFDCNAKNPTWASVTYGIFLCIDCSAVHRSLGVHISFVRSTNLDSWSPEQLKTMSFGGNNRAQVFFKQHGWNDGGKIEAKYTSRAADLYRQILSKEVAKSMAEDGGLPSSPVASQSSQGVXGLPEVKTNEVPKETXLEKPEKPESTSSPRASHTVISSTVKKPIG

SEQ ID NO: 2511 - protein, 392 aa, Methanosarcina mazei Goe1
MKACIMCGGAGTRLRPLTFKHPKPSIPILNKPSVRHLIEHLSREGFNEIVMTLGYMGERIEEQLGDGHIFGVHIEYVYEKEKMGTAGGVKNAEEYLKNEPFIVLGGDHVLNLDLREMYRFHETNDAIVTIGLLSIDDPREFGIADMDINNRIHRFLEKPKSGQIFSNLASTGIYICDPEIFDWIPENKKYDFAKDLFPSLLAADEKINGMLVRGKWTDVGSSAAYRQAQRWMLDALPGTTIEGNFTTRNARIRGPLSIGNNVCIGSNSSLVGPIVIGENTVIGDNVLVGPYSVIGANCTIDDNAKILSSYLFDYVSIGKGSNISGSVVADETAVGEKCSLENGTVIGHRVTIGDNSTIHSGVKIWPEVIIDNDSSIEETIVNLNYDTSQEGS

SEQ ID NO: 2512 - protein, 304 aa, Streptococcus uberis
MTKVRKAIIPAAGLGTRFLPATKALAKEMLPIVDKPTIQFIVEEALRSGIEEILVVTGKSKRSIEDHFDSNFELEYNLQEKGKTELLKLVDETTSINLHFIRQSHPKGLGDAVLQAKAFVGNEPFIVMLGDDLMDITNTKAVPLTKQLMDDYETTHASTIAVMKVPHDDVSSYGVIAPNGKALNGLYSVDTFVEKPKPEDAPSDLAIIGRYLLTPEIFDILENQAPGAGNEVQLTDAIDTLNKTQRVFAREFTGKRYDVGDKFGFMKTSIDYALKHHQVKDDLKAYIIKLGKELEKAQDSKESK

SEQ ID NO: 2513 - protein, 81 aa, Oryza sativa
IVEKYSNSNIEIHTFNQSQYPRIVTEDFLPLPSKGKTGKDGWYPPGHGDVFPSLNNSGKLDTLLAQGKEYVFVANSDNLGA

SEQ ID NO: 2514 - protein, 172 aa, Xanthomonas axonopodis pv. citri str. 306
MPSNLDFIPLRLCVLTVSDSRTLADDRSGDYLADVLTHEGHVLHERALCPDDRYRMRAIVSGWIADAQVDGILITGGTGFTGRDSTPEAITPLLDKVMPGFGEMFRAISVEEIGTSSLQSRAFAGLANHSFVFCLPGSTSACRTAWEKIVRAQLDARTKPCNLATLRPRLGE

SEQ ID NO: 2515 - protein, 99 aa, Glycine max
  unsure (1)..(99): unsure at all Xaa locations
ASSMISSPAVTTVNLAGAGMVAPFTGLKSLAGLPTKKTYYDITSLAYTGGXLHCMHVWPPVGRKKFDTLFYLPDLDYAQLAYVLKYLLANGWIPCYEFE

SEQ ID NO: 2516 - protein, 756 aa, Bruguiera gymnorrhiza
MGTDAGEVVETLPHCYSCKVHQSICRELRKVVDRIERLFPNIEASRPRCRLGIEVLCLLNDALDRAKQVLQYCSESSKLYLALNGDVIVSRCQKSRNLLEQSLDQIQTMVPVILAAEISQVIDDLRVAKFVLDHSDEEAGKAVRELLQQHTSMSDAVESEIKVLRFAASRLCITTPKDLLIEKRSIKKLVNKVRDNDPTKKKILIYLLHLLKKYGNSILGEQGENLNSQQEELFADGSSVSSQAAEVGPCTACKQIVAEAEMSNIPPAPPEEYKCPLSKRLMYDPVVIASGQTFERIWIQKWFDEGNDTCPKTLVKLDHQSLMPNTALKDLISKWCEKYGVTILDPNSQAFQSLDTSSTSVASFGISMNDLHLPLDISNVSLGSSDASYCSDSPRTKIAERSNLMSMQRNNGYSAFQSRANTNKTCLDFLSRLAKLGWESKCEMIEDVKSHLEDNVQPFHHISFENFVEPLIKFLRDAKYQHDVRAQRAGSKLLLAFVSKKRSGISWLHEDTFDLLASMLDSELVEEALAILEVLSSDKDSRSKITASGALVYILRILDSEREEFQEGAVRILHNLSSNNEVCSQILSLNCIPKLVPFINQGQLASHCMGLLKNLCDIEDARVSVAETNGCVAAIAKLLERESCEEQDHAVAILLSLCSQRVQYCNLVMDEGVIPSLFVISINGSEKGKASALELLRQLRDVDFDNEQKCSGYDVGVTEDSHQCKEKKISSRKTRFLGISLFSNWKSSSVASKKKR

SEQ ID NO: 2517 - protein, 238 aa, Glycine max
MLWLEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGEEQKVDSARAAGGDDA

SEQ ID NO: 2518 - protein, 488 aa, Bacteroides thetaiotaomicron VPI-5482
MEEKKLTAANGRPIADNQNSQTAGQRGPVMLQDPWLIEKLAHFDREVIPERRMHAKGSGAFGTFTVTHDITKYTRAAIFSEVGKQTECFVRFSTVAGERGAADAERDIRGFAMKFYTEEGNWDLVGNNTPVFFLRDPLKFPDLNHAIKRDPKTNMRSPNSNWDFWTLLPEALHQVTITMSPRGIPYSYRHMHGFGSHTYSFINADNQRIWVKFHLRTLQGIKNLTDQEAEAIIAKDRESHQRDLFESIEKGDYPKWLFQIQLMTEEEADHYRINPFDLTKVWPHKDFPLQDVGILELNRNPENYFAEVEQAAFNPINTVDGIGFSPDKMLQGRLFSYGDAQRYRLGVNSEQIPVNKPRCPFHAYHRDGAMRVDGNYGATKGYEPNSYGEWKDSPHMKEPPLKASGNGEIYNYNEREYDDDYYSQPGDLFRLMPADEQQLLFENTARAMGDSELFIKQRHTRNCYKADPAYGAGVAKALGIDLQEALKE

SEQ ID NO: 2519 - protein, 218 aa, Leuconostoc mesenteroides subsp. mesenteroides ATCC 8293
MSGIIAPSILSADYTNLERDVKLVEAAGAEYLHIDVMDGTFVPAISYGPNWVKQLRPETDLVLDVHLMIQNPERFVEEFADAGADIIGVHVEATPHIHRALQMIKNKGVKAEVVINPGTPVSAIEAVLDMVDQVLVMTVNPGFGGQKFLPSTLQKIEQLQTFREERGFDFDIEIDGGVNNETIKSAYDAGAKVFVAGSYVYDKVDPAAKIGILKDLIK

SEQ ID NO: 2520 - protein, 292 aa, Campylobacter jejuni
MKGIILAGGSGTRLYPSTLTLCKQLLPIYDKPMIYYPMSVLMLAKIKEVLIISTPKDIDRFKELFKDGSFLGMQIQYKIQERPEGLAQGLILAQDFIQNDDIALILGDNIFYGQGFSDILENAKDDLKKGFASIFSYHVKDPERFGVVEMDQNGNVLSLEEKPKNPKSNYVATGLYFYNNDAIDIAKNIKPSARGELEITDVNIEYLRLNKLKSQHLGRGFAWIDTGTHDSLIEASSFVQTIELRQGYKIACLEEIAYNNNWIDNETLEKRALLLSKSNYGQYLYKILSQGK

SEQ ID NO: 2521 - protein, 140 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 2522 - protein, 272 aa, Thellungiella halophila
MATQPPSSSSAREEFVYMAKLAEQAERYEEMVEFMEKVAKAVDKEELTVEERNLLSVAYKNVIGARRASWRIISSIEQKEESRGNNDHVSLIRDYRTKIETELSGICDGILKLLDTMLIPAAASGDSKVFYLKMKGDYHRYLAEFKTSQERKDAAEHTLNAYKAAQDIANAELAPTHPIRLGLALNFSVFYYEILNSPDRACNLAKQAFDDAIAELDTLGEESYKDSTLIMQLLRDNLTLWTSDMQDDDDVIKEAAAAAPAAPKPAEEQQQS

SEQ ID NO: 2523 - protein, 177 aa, Streptococcus anginosus
TSIMFDGSHLPVEENLKLAKDVVEKAHAKGISVEAEVGTIGGEEDGIIGKGELAPIEDAKAMVATGIDFLAAGIGNIHGPYPANWEGLDLDHLKKLTEALPGFPIVLHGGSGIPDDQIQAAIKLGVAKVNVNTECQIAFANATRKFARDYEANEAEYDKKKLFDPRKFLADGVKAIQ

SEQ ID NO: 2524 - protein, 775 aa, Methanosarcina barkeri
MEEIQLKVEKAYPIDLGRGIIRLDPTTLLKLQLSPGDIVEIRGKKKTTAKVWRADRQDWDQGLVRIDNFIRQNAGVSIGEKVTIKKVEAPEAKKLVLALPESMMQGGPELQFGEHANEIIKRHILKRPVFRGDIIPIINSMSQPMTESLTTSQVIPLVAVETEPSNTIVLVTEETLIELRKKPVQGYEKATRGVTTYEDIGGLGAEIMRVREMIELPMKHPELFGHLNIEPPKGVILYGPPGTGKTLIAKAVANESGASFHYIAGPEIVGKFYGESEERLRKIFEEATQDAPSVIFIDEIDSIAPKRENVTGEVERRVVAQLLTLLDGMVERGQVVVIGATNRVDAIDPALRRPGRFDREIHIGVPDTKDRYEILQIHTRGMPIERDEETEEIGKVETEADEAALERERKEKADKYLMYLAERTQGFVGADLLALVQEAAMRCLRENLPDLDLEKEAIPPERLEKIVVTKRNFEDALMEAEPSALREIYVEMPTVSWNDVGGLDEAKQSITEAVEWPIKNPEKFSHMGIKAPRGILLYGPPGTGKTLIAKAVAKESNANFISVKGPEIFSKWLGESEKAIRETFRKARQVAPCVIFFDEIDSIASMPGMESTDSHTSERVLNQLLTEMDGLESLRDVVVIAATNRPNLLDPAILRPGRFDRLVYIGSPDRKGRLKIFRIHTKDTPLAENVNLETLADETEGYVGADIESVCREAVMIALRENFDTEYVEMRHFREALKKVKPTITENIAQFYEKIEAQFKGGQRLTETAGYIGYR

SEQ ID NO: 2525 - protein, 417 aa, Malus micromalus
MAAKESNSAAAAASSDGKIKRMLTHGGRYAQYNVFGNLFEVSSKYVPPIRPIGRGAYGIVCAAVNAEAREEVAIKKIGNAFDNRIDAKRTLREIKLLRHMDHENVIATKDIIRPPQKENFNDVYIVYELMDTDLHQIIRSNQPLNDDHCRYFLYQLLRGLKYVHSAGVLHRDLKPSNLFMNANCDLKIGDFGLARTTSETDFMTEYVVTRWYRAPELLLNCSEYTAAIDIWSVCCILGEIMTRKPLFPGKDYVHQLRLITELLGSPDDSSLGFLRSDNARRYVRELPQYPKRSFSLGFPNMSPSSIDLLEKMLIFDPNRRITVDEALSHPYLAPLHDINEEPVCPMPFNFDFEQPSFTEENIKELIWRESVRFNPESHFSMDHDIICCILLQTNLKTDCNDMFVDTVIVECVKGVDS

SEQ ID NO: 2526 - protein, 417 aa, Neurospora crassa
MFSRAARLSTRVAAPVRARVAAPRVVIPSIAARRSVTTNAASAQLEKPLPESETEPFQVTLSDESFETYELDPPPYTLNVTKKELKQMYYDMVVVRQMEMAADRLYKEKKIRGFCHLSVGQEAVAVGIEHAIERADDVITSYRCHGFAYMRGGTVRSIIGELLGRRGGIAYGKGGSMHMFTKGFYGGNGIVGAQVAVGAGLAFAHKYTGRKNASIILYGDGASNQGQVFESFNMAKLWNLPALFGCENNKYGMGTSAARSSALTDYYKRGQYIPGLKVNGMDVLAVKAAVAYGKQWTNNDNGPLVLEYVTYRYGGHSMSDPGTTYRTREEIQRMRSTNDPIAGLKQHILEWGVASEEELKNLDKEARAYVNEEVAAAEAMPPPEANQQILFEDIYVKGTEPDFIRGRTPDELFYFKH

SEQ ID NO: 2527 - protein, 405 aa, Flintiella sanguinaria
VVWTDLLTACDLYRAKAYRVDPVPGNPDQYFAYIAYDIDLFEEGSIANLTASIIGNVFGFKAVKALRLEDMRVPVAYLKTFQGPATGVVVERERMNNFGRPLLGATVKPKLGLSGKNYGRVVYEGLKGGLDFLKDDENINSQPFMRWRERFLYCMEGVNRASASSGEVKGHYLNVTSATQEDMYERAEFAKELGSIICMIDLVIGYTAIQTMSVWARKNDMILHLHRAGNSTYSRQKNHGMNFRVICKWMRMAGVDHIHAGTVVGKLEGDPLMIKGFYNTLLDGHTDINLPQGLFFEQNWASLRKVMPVASGGIHCGQMHQLVNYLGDDVVLQFGGGTIGHPDGIQAGATANRVALEVMILARNEGRDYVSEGPQILRAAAKTCGPLQTALDLWKDITFNYTSTD

SEQ ID NO: 2528 - protein, 306 aa, Streptococcus mutans UA159
MPSKKVRKAVIPAAGLGTRFLPATKALAKEMLPIVDKPTIQFIVEEALKSGIEDILVVTGKSKRSIEDHFDSNFELEYNLEQKGKTDLLKLVNDTTAINLHFIRQSHPRGLGDAVLQAKAFVGNEPFVVMLGDDLMDITDDKAIPLTRQLMNDYEETHASTIAVMEVPHEDVSAYGVIAPQGEGVSGLYSVDTFVEKPAPKEAPSNLAIIGRYLLTPEIFTILETQEPGAGNEVQLTDAIDTLNKTQRVFAREFKGKRYDVGDKFGFMKTSIDYALKHPQVKEDLKAYIIELGKKLDQKSTQKNSD

SEQ ID NO: 2529 - protein, 508 aa, Burkholderia fungorum
MSLWHQCTAPLPHSVSIKAIQESRMSEHKLTNAAGAPVADNQNSMTAGARGPVVLQDVWLLEKLAHFDREVIPERRVHAKGSGAFGTLKVTHDISRYTKAKVFAQAGKETPLFMRFSTVAGERGAADAERDVRGFSIKFYTEEGNWDVVGNNTPVFFIRDPLKFPDFIHTQKRDPYTNMRSNVAAWDFWSRHPESLHQVTILMSDRGIPQNFRQMHGFGSHTYSFINANNERFWVKFHFKSMQGVENFTDAEAAQVVAQDRESAQRDLLTNIDQGNFPKWRFAIQVMPEAEAATYRFNPFDITKVWSQKDYPLIDVGTIELNRNAANYFADVEQAAFTPANVVPGIGFSPDRLLQGRLFSYGDTQRYRLGVNHHQIPVNASRVASPHSFHRDGAMRTDGNLGGNVNYEPNRFGDFAQDANASEPPLAAGAVDRYDHRLDDDYYTQPGMLFALFDAAQRERLFGNIARHINGVPQEIVARQIEHFRRADPAYAEGVIAAIARLAEGETK

SEQ ID NO: 2530 - protein, 563 aa, Pseudomonas fluorescens
MAMITGGELVVRTLIKAGVEHLFGLHGAHIDTIFQACLDHDVPIIDTRHEAAAGHAAEGYARAGAKLGVALVTAGGGFTNAVTPIANAWLDRTPVLFLTGSGALRDDETNTLQAGIDQVAMAAPITKWAHRVMATEHIPRLVMQAIRAALSAPRGPVLLDLPWDILMNQIDEDSVIIPDLVLSAHGARPDPADLDQALALLRKAERPVIVLGSEASRTARKTALSAFVAATGVPVFADYEGLSMLSGLPDAMRGGLVQNLYSFAKADAAPDLVLMLGARFGLNTGHGSGQLIPHSAQVIQVDPDACELGRLQGIALGIVADVGGTIEALAQATAQDAAWPDRGDWCAKVTDLAQERYASIAAKSSSEHALHPFHASQVIAKHVDAGVTVVADGALTYLWLSEVMSRVKPGGFLCHGYLGSMGVGFGTALGAQVADLEAGRRTILVTGDGSVGYSIGEFDTLVRKQLPLIVIIMNNQSWGATLHFQQLAVGPNRVTGTRLENGSYHGVAAAFGADGYHVDSVESFSAALAQALAHNRPACINVAVALDPIPPEELILIGMDPFA

SEQ ID NO: 2531 - protein, 343 aa, Chrysosplenium americanum
MLFAMQLACASVLPMVLKSAIELDLLEIIRGQDTCMSPTEIASHLPTTNPDAPAMVDRILRLLSCYSVVTCSVRSVDDQRVYGLAPVCKYLTKNQDGVSIAALCLMNQDKVLMESWYHLKDAVLDGGIPFNKAYGMSSFEYHGTDPRFNKVFNRGMSDHSTITMKKVFQTYQGFQGLTSLVDVGGGTGATLTMILSKYPTIRCINFDLPHVIEDAPEYPGIEHVGGDMFVSVPKGDAIFMKWICHDWSDEHCLKLLKNCYDALPNNGKVILAECILPEVPDSSLATKGVVHIDVITVAHNPGGKERTEKEFEALAKAAGFQGFQVFCNAFNTYIIEFSKKICN

SEQ ID NO: 2532 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQR

SEQ ID NO: 2533 - protein, 300 aa, Zea mays
MGALDLHLDFASAQHGQAKLKEYAKSSLLSDGNYNTDKINGSNPDDYEKFEKGIMHYGCPHYRRRCRIRAPCCNEIFDCRHCHNETKNSIKIDKMKRHELPRHEVQQVVCSLCGTEQEVRQVCINCGVCMGKYFCGLCKLFDDDVSKQQYHCNGCGICRIGGRENFFHCSKCGCCYSIALKNSHACVEGAMHHDCPICFEYLFDSTNDVSVLPCGHTIHVKCLKEMEEHCQFACPLCSKSVCDMSKAWERLDMELATLSDSCDHKMVRILCNDCGAISDVQFHLIAHKCQNCKSYNTRQI

SEQ ID NO: 2534 - protein, 106 aa, Triticum aestivum
  unsure (1)..(106): unsure at all Xaa locations
GWGESYLSXQDQVYXNLEGKHTHAVNTGWAMLTLIDAGQAERDPTPXHRAAKVLINLQSEDGEFPQQEIMGVFNKNCMISYSQYRNIFPIWALGEYRCRVLGAAKK

SEQ ID NO: 2535 - protein, 184 aa, Triticum aestivum; identical to SEQ ID NO: 2409

SEQ ID NO: 2536 - protein, 300 aa, Arabidopsis thaliana
  unsure (1)..(300): unsure at all Xaa locations
MFGLRKSPANLPKHNSVDLKSSKPNPFDSDDESDNKHTLNXSKRTTSEPSLADMTNPFGGERVQKGDSSSSKQSLFSNSKYQYKNNFRDSGGIENQSVQELEGYAVYKAEETTKSVQGCLKVAEDIRSDATRTLVMLHDQGEQITRTHHKAVEIDHDLSRGEKLLGSLGGMFSKTWKPKKTRPINGPVVTRDDSPTRRVNHLEKREKLGLNSAPRGQSRTREPLPESADAYQRVEMEKAKQDDGLSDLSDILGELKNMAVDMGSEIEKQNKGLDHLHDDVDELNFRVQQSNQRGRRLLGK

SEQ ID NO: 2537 - protein, 425 aa, Xylella fastidiosa Dixon
MMSNSPQTPLVTRQRLSEVRYEIRGELARRARELEAEGRKLIKLNIGNPGAFGFRAPEHLQRAIADDMGRTDPYTHQQGLPIAREAIAAAYARRHYPDADADRVFVGNGVSELIDLSLRALLNPGDEVLVPSPDYPLWSAATILNDGRPVYYRCAPENGFQPDAVEIETLVSSRTRAIVLINPNNPSGANYSQELLERIAAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVAEKVVPLKLRSAAA

SEQ ID NO: 2538 - protein, 219 aa, Oryza sativa
MGLYDTLKRRWERDDGGGGGPLPLHRKVAAGLFSGGVGAAVGNPADVAMVRMQADGRLPAAQRRNYRSVADAIVRMARDEGVCSLWRGSPLTVKRAMIVAASQLATYDQAKEAILARRGQGADGLATHVAAGLAAGLVAASASTPVDVVKTRVMNMKVVAGAPPPYSGALDCLIKTVRSEGAMALYKGFVPTVTRQGPFTIVLFVTLEQVRKLLKGVDF

SEQ ID NO: 2539 - protein, 443 aa, Magnetococcus sp. MC-1
MPSTNPLTRRRSTKMSSIVEIHGREVIDSRGNPTVEVDVYTEDGGFGRAAVPSGASTGSREAVELRDGDKSRFLGKGVRKAVDAVNTVLAEVVLGMEVADQKGIDAAMIALDGTHNKSRLGANAILGISMAVAKAAADECDLPLYRYLGGTNTSLLPVPMMNIINGGAHADNNVDIQEFMIMPVAATSCTEAIRMGAEVFHSLKKVLKSKGLNTAVGDEGGFAPNLGSNEEALKVIVEAIEAAGYKPGEDIKLALDCASSEFYNKETGNYDLTGEGRVLTKQELVAFYEDLVAKYPIISIEDGFDESDWDGWKLMTEALGNKIQLVGDDLFVTNSKILAEGISKGIANSILVKVNQIGTLTETFEAVEMAQRAGYTAVISHRSGETEDATIADIAVALNAGQIKTGSMSRSDRIAKYNQLIRIEEELGGMARFEGMKVFYNLR

SEQ ID NO: 2540 - protein, 42 aa, Daucus carota
AGCDWIHVDVMDGRFVPNITIGPLVVDALRPVTDLPLDVHLV

SEQ ID NO: 2541 - protein, 841 aa, Arabidopsis thaliana
MANANGKAATSLPEKISAKANPEADDATEIPGNIVYHAKYSPHFSPLKFGPEQALYATAESLRDRLIQLWNETYVHFNKVDPKQTYYLSMEYLQGRALTNAIGNLNLQGPYADALRTLGYELEEIAEQEKDAALGNGGLGRLASCFLDSMATLNLPAWGYGLRYRHGLFKQIITKKGQEEIPEDWLEKFSPWEIVRHDVVFPVRFFGKVQVNPDGSRKWVDGDVVQALAYDVPIPGYGTKNTISLRLWEAKARAEDLDLFQFNEGEYELAAQLHSRAQQICTVLYPGDATENGKLLRLKQQFFLCSASLQDIISRFHERSTTEGSRKWSEFPSKVAVQMNDTHPTLAIPELMRLLMDDNGLGWDEAWDVTSKTVAYTNHTVLPEALEKWSQSLMWKLLPRHMEIIEEIDKRFVQTIRDTRVDLEDKISSLSILDNNPQKPVVRMANLCVVSSHTVNGVAQLHSDILKAELFADYVSIWPNKFQNKTNGITPRRWLRFCSPELSDIITKWLKTDKWITDLDLLTGLRQFADNEELQSEWASAKTANKKRLAQYIERVTGVSIDPTSLFDIQVKRIHEYKRQLMNILGVVYRFKKLKEMKPEERKKTVPRTVMIGGKAFATYTNAKRIVKLVNDVGDVVNSDPEVNEYLKVVFVPNYNVTVAEMLIPGSELSQHISTAGMEASGTSNMKFALNGCLIIGTLDGANVEIREEVGEENFFLFGATADQVPRLRKEREDGLFKPDPRFEEAKQFVKSGVFGSYDYGPLLDSLEGNTGFGRGDYFLVGYDFPSYMDAQAKVDEAYKDRKGWLKMSILSTAGSGKFSSDRTIAQYAKEIWNIEACPVP

SEQ ID NO: 2542 - protein, 380 aa, Triticum aestivum
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGANILRAIAGAGVLSGYDQLQILFFGKKYGSGGA

SEQ ID NO: 2543 - protein, 325 aa, Zea mays
MASNGDKGLIVSFGEMLIDFVPTESGVSLAEAPGFLKAPSGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFIGALLNQIVDDRSVLEDEERLRKVLRFANACGAITTTKKGAIPALPSDAEVRSFLEKK

SEQ ID NO: 2544 - protein, 490 aa, Neurospora crassa
MECASPFSFAAHDDNTEARASGAANAPERPALRNRRKSQLNARRKSFVNSIVDGEEALLLKMDAFLVELESRLEYWENYGELTLDSSIEVALSTLQAVRTRCSHVSEEVMGAGRRRLHVLVETLETSYHEAMAAAGSLNEKAKVGIDLLDGLLEDLETQAAKLREKGLANAAESLMGEGKRVMEEGIERAMRAAENLEDHIQRAINQAREKGLISYEELPIPWRINPHIQKGYRFSENKLACIRSAFTFSNELINIWSHAIGLILVLAVAFYFYPTSINFSQSTTTDIVIAAIFFFAACQCLACSVIWHTMNSVADVNLISMFACVDYTGISLLIAASIITTEYTAFYCEPVSRWVYMIATAFLGVGGVILPWHPRFNGQDMAWVRVAFYIGLSASGFLPIFQIWLTRGGMSVWEHYSPILESLFVYFLGALVYASKVPERWCPGMFDYVGGSHNLWHMAVLGGILFHYNAMQEFFSNAFRRAQDACPMY

SEQ ID NO: 2545 - protein, 541 aa, Oryza sativa (japonica cultivar-group)
  unsure (1)..(541): unsure at all Xaa locations
MGRQDQQLQVLNALDAAKTQWYHFTAIIVAGMGFFTDAYDLFCISLVTKLLGRIYYTDPASPXPGSLPPNIAAAVNGVALCGTLSGQLFFGWLGDKLGRKSVYGMTLLLMVICSIASGLSFSHTPTSVMATLCFFRFWLGFGIGGDYPLSATIMSEYANKKTRGAFIAAVFAMQGFGILAGGVVTLAMSAGFQAAFPAPAYEVNAAASTVPQADYVWRIILMLGALPAILTYYWRMKMPETARYTALVAKDAKQASSDMAKVLQVEIEVEEEKLQDITRGRDYGLFSARFAKRHGAHLLGTAATWFLVDVAYYSQNLFQKDIFTSIHWIPKARTMSELEEVFRISRAQTLIALCGTVPGYWFTVFLIDIIGRFKIQLLGFAGMTAFMLGLAIPYHHWTMPGNQVIFVFLYGFTFFFANFGPNATTFIVPAEIFPARLRSTCHGISAASGKAGAIIGAFGFLYAAQPQDKAHVDAGYKPGIGVRNALFVLAGCNLVGFLMTWMLVPESKGKSLEEMSGEADDEEASANGGATAVNSSGVEMV

SEQ ID NO: 2546 - protein, 549 aa, Escherichia coli K12
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTNIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 2547 - protein, 196 aa, Shigella flexneri 2a str. 301
MMNTLRIGLVSISDRASSGVYQDKGIPALEEWLTSALTTPFELETRLIPDEQAIIEQTLCELVDEMSCHLVLTTGGTGPARRDVTPDATLAVADREMPGFGEQMRQISLHFVPTAILSRQVGVIRKQALILNLPGQPKSIKETLEGVKDAEGNVVVHGIFASVPYCIQLLEGPYVETAPEVVAAFRPKSARRDVSE

SEQ ID NO: 2548 - protein, 144 aa, Oryza sativa
MIHSKKLAQLARKLQRIKTAASNREDDDAGCTSTSPSPVADKGHCAVYTSDGARFEVPLPYLGTTVFVELLRMSQEEFGFAGGDGRITLPCDAAAMEYVMCLLRRNASEEVERAFLSSVVTMPCQNSGCTMPPVALHHQFAVCS

SEQ ID NO: 2549 - protein, 224 aa, Triticum aestivum
MDGGGGVRPSLQPAAAGGGASGSPDEPRDARVVRELLRSMGLGEGEYEPRVVHQFLDLAYRYAGDVLGDAQVYADHAGKPQLDADDVRLAIQAKVNFSFSQPPPREVLLELARSRNKIPLPKSIAPPGSIPLPPEQDTLLSQNYQLLPALKPPTQTEEAEDDEEGANADAANPNPNSLQDQTGNEQQQQPQSQSQGQRVSFQLNAVAAAAAKRLRMTIDQLNMG

SEQ ID NO: 2550 - protein, 471 aa, Gracilaria capensis
  unsure (1)..(471): unsure at all Xaa locations
SGVIPYAKMGYWDPDYVVKDTDVLALFRVSPQPGVDPVEASAAXAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQPGATANRVALEAMVIARNEGRDYVAEGPQILRDAAKTCGPLQTALDLWKDITFNYTSTDTADFVETPTANV

SEQ ID NO: 2551 - protein, 415 aa, Polysiphonia japonica
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLKGGLDFLKDDENINSQPFMRWKERFLYSMEAVNRSIASTGEVKGHYMNITAATMEEMYERAEFGKQIGTIIVMIDLVIGYTAIQTMAVWARKNDMILHLHRAGNSTYSRQKIHGMNFRVICKWMRMAGVDHIHAGTVVGKLEGDPLMIKGFYNTLLETHLDINLPQGIFFQQDWASLRKVAPVASGGIHCGQMHQLLDYLGNDVVLQFGGGTIGHPDGIQAGATANRVALESMVIARNEGRDYVAEGPQILRDAAKTCGPLQTALDLWKDITF

SEQ ID NO: 2552 - protein, 406 aa, Oryza sativa
MARPRTRSVARMEATAAAAAAAEEEEAGNPDGAEGAAVVAVAPEAAAEGPNEPNAGEASREPDAGQASREPDVAGPSRQPGAAGPSREPGAAGGPRQPGAAGGPWQLVPNAAGPAVAPYVEDIDRYLRSLEGREMAKCLDAVQFCTAEESRRPIVNYDQEIQGGHINMRGKLVNWMEELVYGFNLWDNILYLAVSYVDRFLSRNVVNRERLQLLGTSALFVASKYEDRCHPSARFFSSITADTYTTQQVVAMEANILSFLNFQMGSPTVITFLRRFLFSCRGSNRPINIRLELMCIYLAELSLLDDYNIRFLPSIVAAACLFVGKFTLNPNTRPWNLSVQRITGYKVSDIEDCIRSIHDLQAGRKWSNLRAIRSKYEDDAFERVSTIPSPNTIKPSFLRDLKYVNG

SEQ ID NO: 2553 - protein, 419 aa, Neisseria lactamica
FTVPARIVLEDPEEWFENGQAFDGSSIGGWKGIQASDMQLRPDPATAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 2554 - protein, 632 aa, Helicobacter pylori
MKPTNEPKKPFFQSPIILAVLGGILLIFFLRSFNSDGSFSDNFLASSTKNVSYHEIKQLISNNEVENVSIGQTLIKASHKEGNNRVIYIAKRVPDLTLVPLLDEKKINYSGFSESNFFTDMLGWLMPILVILGLWMFMANRMQKNMGGGIFGMGSAKKLINAEKPNVRFNDMAGNEEAKEEVVEIVDFLKYPERYANLGAKIPKGVLLVGPPGTGKTLLAKAVAGEAHVPFFSMGGSSFIEMFVGLGASRVRDLFETAKKQAPSIIFIDEIDAIGKSRAAGGVVSGNDEREQTLNQFLAEMDGFGSENAPVIVLAATNRPEILDPALMRPGRFDRQVLVDKPDFNGRVEILKVHIKGVKLANDVNLQEVAKLTAGLAGADLANIINEAALLAGRNNQKEVKLQHLKEAVERGIAGLEKKSRRISPKEKKMVAYHESGHAVISEMTKGSGRVNKVYIIPRGMAALGYTLNTPEENKYLMQKHELIAEIDVLLGGRAAEDFFLEEISTGASNDLERATDIIKGMVSYYGMSSVSGLMVLEKQRNAFLGGGYGSSREFSEKTAEEMDLFIKNLLEERYKHVKQTLSDYREAIEIMVKELFDKEVITGERVREIISEYEVANNLESRLIPLEEQAS

SEQ ID NO: 2555 - protein, 184 aa, Glycine max
  unsure (1)..(184): unsure at all Xaa locations
MASQRVFQLGLRRAAAPSLRVQPAGRMVQRRLAATEHASQSEAAEILAKQRVNRPVSPHLAIYKPQITWYASSLNRITGITLSGSLYLFGIAYLIAPYTGWHLETQSMVATVAAWPAAVKAGLKAFLXLFPFFFHSFNXLRESGLGTLGFGXKNQGYLGPVGLDRIWYYNFPNILGEGLMGMNK

SEQ ID NO: 2556 - protein, 504 aa, Glycine max
  unsure (1)..(504): unsure at all Xaa locations
MSALSNSSSSHGNSFLKMPAIKFTKLFINGDFVDSISGRTFETIDPRKEEVIARVSEGDKEDIDIAVKAARQAFDSGPWPRLPGSERAKIMMKWADLVDENIEELAALDTIDAGKLYYINKVAEIPSATNALRYYAGAADKIHGDVLKMNGDFHAYTLLEPIGVVGHIIPWNAPSLSFFIKVSPSLAAGCTMVLKPAEQTPLSALFYAHLAKLAGIPDGVLNIVPVFGPTAGAAISSHMDIDAVSFTGSIEVGREVLQAAAWSNLKPVSLELGGKSPLIIFNDADIDKASELALFGIMSNKGEICVAGSRVFVQEEIYDEFEKKLVEKAKSWVVGDPFDPKSXQGPQADRNQLEKILSYIEHGKREGATLLTGGNTVGNKGYYIEPTIFSNVKEDMLIARDEIFGPVLALMKFKTMEEAIKSANNTKYGLAAGIVTKNLDTANTMSRSIRAGIVWINCYFTVGSDVPFGGYKMSGFGRDLGLQALHKYLQVKSVVTPIHNSPWL

SEQ ID NO: 2557 - protein, 579 aa, Staphylococcus aureus subsp. aureus Mu50
MAKIKANEALVKALQAWDIDHLYGIPGDSIDAVVDSLRTVRDQFKFYHVRHEEVASLAAAGYTKLTGKIGVALSIGGPGLIHLLNGMYDAKMDNVPQLILSGQTNSTALGTKAFQETNLQKLCEDVAVYNHQIEKGDNVFEIVNEAIRTAYEQKGVAVVICPNDLLTEKIKDTTNKPVDTSRPTVVSPKYKDIKKAVKLINKSKKPVMLIGVGAKHAKDELREFIEMAKIPVIHSLPAKTILPDDHPYSIGNLGKIGTKTSYQTMQEADLLIMVGTNYPYVDYLPKKNIKAIQIDTNPKNIGHRFNINVGIVGDSKIALHQLTENIKHVAERPFLNKTLERKAVWDKWMEQDKNNNSKPLRPERLMASINKFIKDDAVISADVGTATVWSTRYLNLGVNNKFIISSWLGTMGCGLPGAMASKIAYPNRQAIAIAGDGAFQMVMQDFATAVQYDLPLTVFVLNNKQLAFIKYEQQAAGELEYAVDFSDMDHAKFAEAAGGKGYTIKSASEVDAIVEEALAQDVPTIVDVYVDPNAAPLPGKIVNEEALGYGKWAFRSITEDKYLDLDQIPPISVAAKRFL

SEQ ID NO: 2558 - protein, 337 aa, Oryza sativa
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKASSHLKGGAKKVFISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 2559 - protein, 302 aa, Pseudomonas aeruginosa PAO1
MQQLLNEILDEVRPLIGRGKVADYIPALAGVEPNQLGIAVYSRDGELFHAGDALRPFSIQSISKVFSLVQAIQHSGEDIWQRLGHEPSGQPFNSLVQLEFERGKPRNPFINAGALVICDINQSRFAAPAQSMRDFVRRLCGNPEVVSDSVVARSEYQHRSRNAAAAYLMKSFGNFHNDVEAVLFSYFHHCALRMSCVDLARAFCFLADKGFCKHSGEQVLNERQTKQVNAIMATSGLYDEAGNFAYRVGLPGKSGVGGGIIAVVPGRFTVCVWSPELNAAGNSLAGIAALEKLSERIGWSIF

SEQ ID NO: 2560 - protein, 474 aa, Laurencia pinnatifida
RLESGVIPYAKMGYWDPNYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGLVVERERMDKFGRPFLGATVKPKLGLSGKNYGRVVYEGLKGGLDFLKDDENINSQPFMRWKERFLYSMEAVNRSIAGTGEVKGHYMNITAATMEEMYERAEFAKQIGTVIIMIDLVIGYTAIQTMAIWSRKNDMILHLHRAGNSTYSRQKIHGMNFRVICKWMRMAGVDHIHAGTVVGKLEGDPLMIKGFYDTLLEPYLKQNLSQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 2561 - protein, 343 aa, Triticum aestivum
  unsure (1)..(343): unsure at all Xaa locations
MGKIKIGINGFGRIGRLVARVALQSDDVELVAVNDPFITTEYMTYMFKYDTVHGHWKHSDIKLKDDKTLLFGXEKPVTVFGRQEPXEEIPWGEAGAXDYVVESTGVFTDKDKXAAAHLKGGAKKVVISAPSKDAXPMFVVGVNEDKXYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 2562 - protein, 294 aa, Picea abies
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVPGLEPAGIDLLSKMLCLEPSKRITARSALEHEYFKDLGFVP

SEQ ID NO: 2563 - protein, 344 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLGDGDVKG

SEQ ID NO: 2564 - protein, 85 aa, Glycine max
  unsure (1)..(85): unsure at all Xaa locations
GGGWDIFNLNLSDAMARAKAPDIHLQKQLRTYMEYMVALPSIYDPYFIAANQGDRANNFIKVAXYEQVQQIIQDIYESNESTKAD

SEQ ID NO: 2565 - protein, 282 aa, Escherichia coli
ALLLKTQLPSGSELSLYDIAPVTPGVAVDLSHIPTAVKIKGFSGEDATPALEGADVVLISAGVPRKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDT

SEQ ID NO: 2566 - protein, 194 aa, Sorghum bicolor
QKLSEKLLDLLCENLGLEPGYLKSAFAGSNGPTFGTKVSAYPPCPRPDLVDGLRAHTDAGGIILLFQDDQVSGLQLLKDGEWVDVPPMRHAIVVNIGDQLEVITNGRYKSVMHRVLTRPDGNRMSIASFYNPGADAVIFPAPALVGAAGAEEERAGQATYPRFVFEDYMNLYVRHKFEAKEPRFEAMKSAIATA

SEQ ID NO: 2567 - protein, 436 aa, Zea mays
FCSVPATGGGVHLDDAHEQIDTAIATALRESKPVYLSISCNLPGLPHPTFTRDPVPFFLAPRMSNKMGLEAAVEATVEFLNKAVKPVLVAGPKLRVAKAGKAFVDLVDASGYAYAIMPSAKGFVPETHPHFLGTYWGAVSTAFCAEIVESADAYLFAGPIFNDYSSVGYSFLLKKDKAIIVQPERVIVGNGPAFGCVMMKEYLSALAKRVQKNTTAYENYKRIFVPEGHPLKGEPNEPLRVNVLFKHVQKMLTGDSAVIAETGDSWFNCQKLKLPEGCGYEFQMQYGSIGWSVGALLGYPQGANHKRVIAFIGDGSFQVTAQDVSTILRCEQNSIIFLINNGGYTIEVEIHDGPYNVIKNWNYTGFVDAIHNGLGKCWTSKVKSEEDLTAAIETALGEKDCLCFIEVIAHKDDTSKELLEWGSRVSAANSRPPNPQ

SEQ ID NO: 2568 - protein, 359 aa, Capsicum annuum
MDSTNQNLTQTEDEAFLFAMQLASASVLPMVLKSALELDLLEIMAKAGPGAAISPSELAAQLPTKNPEAPIMLDRMLRLLATYSVLNCTLRTLPDGRVERLYSLAPVCKLLTKNADGVSVAPLLLMNQDKVLMESWYHLTDAVLDGGVPFNKAYGMTAFEYHGTDPRFNKVFNRGMSDHSTMTMKKILEDYKGFEGLNSIVDVGGGTGATVNMIVSKYPSIKGINFDLSHVIEDAPAYPGVEHVGGDMFVSVPKADAIFMKWICHDWSDEHCLKFLKNCYEALPANGKVLVAECILPETPDTSAATKNAVHVDIVMLAHNPGGKERTEKEFEALAKGAGFTGFRRACCAYQTWVMEFHK

SEQ ID NO: 2569 - protein, 56 aa, Triticum aestivum
YEWGPMSFFAKQAGGKGSDGPQRGLDIMPPKVHQRVPLYFGSVEEVEKVEKFLFSE

SEQ ID NO: 2570 - protein, 337 aa, Hordeum vulgare
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKVINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 2571 - protein, 156 aa, Glycine max
MAYAFFRDGAMPLSSLWHKVNKQEVPIYAVWLSVFISFCMALTSLGSIVAFEAMVSIATIGLYIAYAFPIFLRVTLARKHFVSGPFNLGRYGVVVGWVAVLWVLTISVLFSLPVSYPITIKTLNYTPVAVGCLLILVVSYWLISGRRWFKGPITNI

SEQ ID NO: 2572 - protein, 419 aa, Gonyaulax polyedra
FLAPLCLAAVVLGAWQLLPTSFVAPSPRLRGVTSESAQVSTAAPLERSNASQSSAWLATGAACALILSGAAARALSMGRQSSSVAMRATGIAINGFGRIGRQVARIAMKDPEVELKLINASYDADYLAYMMKYDTIHGKYDGTVEVDGDALVIDGLKVALSHTRDPAEIPFTEHGAEYVCESTGVFLTTEKVEPHLKAGAKKIVFSAPAKDDSHTIVMGVNQDTYDPSMTCVSCASCTTNGLAPAVKAVNDAFGIKRGLMTTIHAMTASQPTVDSASKKDWRGGRAASGNIIPSSTGAAKAVAKVVPEVKGKLTGMAFRVPTIDVSVVDLTCELEKATTYEEICAEIKRRSEGDMKGFLGYTDEPLVSTDFETNTISCTFDAKAGIMLDPTFVKLVMWYDNEWGYSCRVVRPDKAHGEG

SEQ ID NO: 2573 - protein, 513 aa, Nitrobacter sp. NRB5220
MDIRSQVSMVFHLDKCIGCHTCTIACKNIWTDRKGTEYMYWNNVETKPGTGYPTRWEDQTKYRGGWVVDGHRQKNLRLRLQGKWGTLTNIFYNPYLPTLDDYFEPWTYDYQNLINAPLADEQPTARAISMVTGKYMDTIEAGPNWDDDLGGSQVYANNDPNFDGASDEEMRQINEINSTVFFYLPRICNHCLNPGCVAACPQGALYKRGEDSVVLVSQERCRAWRMCVSGCPYKKTYFNWSTGEAEKCILCYPRLESGQPPACFHSCVGRIRYIGLVLYDADAIEETAKASQDQLVMAQRNIIKDPFDPKIIAAARANGIPDSKIDAAQKSPVYQFVNKWGIALPLHPEFRTLPMLFYVPPLGPVLAKVENGVYDNIASESRLGPLMSSLERSRISLRYMASLLSGGNEEIIRDVYKKLVAVRVYMRSRRVKDIPDEEVQRALAEGKTTAAEVEAIWRLTSMPTFEERFVVPPMEREEAVDALFPQLDPVSYNYPIRRGAVGVGFHTDPARGP

SEQ ID NO: 2574 - protein, 765 aa, Hypocrea jecorina
MRLCDLSSLASWVLVTVALPSSGAAAKGVSQIPSTHSSQSKGNGPWAHAYRRAEKLVRQMTLEEKANITRGFTGDNVCAGNTGSVPRLGWPGMCVHDAGNGVRATDLVNSYPSGIHVGASWDRNLTYERGLHMGGEFKAKGVNVPLGPNAGPLGRTPLGGRNWEGFSIDPYLSGQLNAETITGMQDAGVIANIKHFIANEQETLRRPYFGVEAVSANIDDRTLHEYYLWPFMDSVHAGVGSVMCSYNRINNTYGCMNDKLMNGILKAELGFQGFVMLDWNAQHDLQSANAGLDMVMPLGGSWGKNLTDAVANGTVSESRITDMATRIIAAWYLVGQDGNNFPVPGIGLKQLTKPHEQVDARDPASKPVLLEGAIAGHVLVKNENNALPFNKKLTMISVFGYDATIPRTKNTDILFQLGYTSSPEMAQAVLGNEAHFDQAAKGGTIMTGGRAGANAPSYIDDPLAAIQRRARKDDTWVNWDLDSFNPEVNAASDACLVFINAIATEGWDRDGLHDDFSDGLVLNVAANCSNTIVVVHAAGTRLVDQWIEHPNVTAAVIAHLPGQDSGRALVKLLYGEANFSGKLPYTIAKNESDYSVYTPCQRRSPEDTDPQCDFTEGVYLDYRAFDANNMTPRFEFGYGLSYTSFNYSALSIKKAKGLRQSRCTDDLWQAAAQVTASITNSGGMSGSEVAQLYLAIPNSPPKQLRGFNKLLLRPHESGTVHFGLTKRDLSVWDVVSQSWVIQEGEYKVFVGASSRDIRLSGKLHI

SEQ ID NO: 2575 - protein, 566 aa, Xylella fastidiosa Dixon
MLAAAMRGMAVTFFSQFMVSCMHSIQIVLAMLLVVAASGYLVRIIPFSMPLPLLQIALGAVISGVFDGGYELQPEVFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGNFSLATASLTFVWVLVVGLSLGIATTYVLSRVQRWVWRHFGGEPAAAILVNLLTPFAAYLLAESMQASGILAAVAAGITMSYVELSGNAQATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPFLMPDGTPLPARQLVIFLAASVILVSLLLASVALPYLLRGLELPEKSSYDKEEDFARKVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 2576 - protein, 474 aa, Abroteia sp. SF2000
RYESGVIPYAKMGYWDPEYVIKETDVLALFRVSPQPGVDPVEASAAVAGESSTATWTVVWTDLLTACDLYRAKAYKVEAVPKTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAASGEIKGHYMNITAATMEDMYERAEFAKQLGTVIVMIDLVIGYTAIQSMGVWARKNDMILHLHRAGNSTYSRQKIHGMNFRVICKWMRMAGVDHIHAGTVVGKLEGDPAMIRGFYNTLLLPYLEVNLPQGIFFQQDWASLRKVTPVASGGIHCGQMHQLLDYLGNDVVLQFGGGTIGHPDGIQAGATANRVALESMVIARNEGRDYVTEGPQILRDAAKTCGPLQTALDLWKDITFNYTSTDTADFVETPTANV

SEQ ID NO: 2577 - protein, 165 aa, Zea mays
PVGAETFKEALRWGVQVFAVLGKVLKERKLLSGGVGDEGGYAPNLTSNQQALDILIEAIEQAGYKPGSQIALAMDIAASEFFKNGQYEYDGGSHSPQEFIDYQAKLVSQYPIVSIEDGLHEDDWESWKGLTTSLGTKTQLVGDDLMVTNPVRLQKSIDLGVANAI

SEQ ID NO: 2578 - protein, 385 aa, Coriandrum sativum
MAMKLNALMTLQCPKRNMFTRIAPPQAGRVRSKVSMASTLHASPLVFDKLKAGRPEVDELFNSLEGWARDNILVHLKSVENSWQPQDYLPDPTSDAFEDQVKEMRERAKDIPDEYFVVLVGDMITEEALPTYMSMLNRCDGIKDDTGAQPTSWATWTRAWTAEENRHGDLLNKYLYLSGRVDMRMIEKTIQYLIGSGMDTKTENCPYMGFIYTSFQERATFISHANTAKLAQHYGDKNLAQVCGNIASDEKRHATAYTKIVEKLAEIDPDTTVIAFSDMMRKKIQMPAHAMYDGSDDMLFKHFTAVAQQIGVYSAWDYCDIIDFLVDKWNVAKMTGLSGEGRKAQEYVCSLAAKIRRVEEKVQGKEKKAVLPVAFSWIFNRQIII

SEQ ID NO: 2579 - protein, 526 aa, Triticum aestivum
HQLSFFLLPPQLLRPLDLIAHHPRKRLDRRRSRPWDPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIKKENNFKQAGERYRSFDPARQDRFLQRWVDALTDARVTHEIQGIWVSYWSQCDASLGQKLASRLKMKPNM

SEQ ID NO: 2580 - protein, 341 aa, SYNECHOCOCCUS SP. WH 8102
MTLRVAINGFGRIGRNVMRGWISRGADTGLEIVGMNSTSDPKTSAHLLTYDSILGKLDPSVKIETTDDTMLVNGKEIKFFADRNPLNCPWKDWGVDLVIESTGVFNTDEKASMHLEAGASKVILTAPGKGDGVGTFVVGVNDDQYRHEDWNILSNASCTTNCLAPIVKVLDQNFGLDWGLMTTIHSYTGDQRILDNSHRDLRRARAAALNMVPTTTGAAKAVALVYPEVKGKLTGFAMRVPTPNVSAVDLTFGPSRATSVDEVKAVIKAASENGMKGIIKYSDLPLVSTDYAGTNESTIFDADLTYAMGDKAVKILAWYDNEWGYSQRVVDLAEVVARNWK

SEQ ID NO: 2581 - protein, 367 aa, Methanosarcina acetivorans C2A
MMFLSRPELIKKEIFEIAEYVPGKSIEEIAAAYGIDPPSIIKLGSNENPLGPSPKAVRALVETAPGANIYPSADARELREVLSKYTGFPVSNIVASGPGMDGLLDGLCRIIIEKGDEVIVPTPTFAYYELPARACGGKPVFVRRNPDFSLDPEKILGAVSPRTKIIFLCSPNNPSGNLLPEADLRKIVENTHALVFVDEAYVEFADRNLTGLVREYDNLAVGRTFSKVFGLAGLRLGYGILPEWLVKEYSRAATPFSVSLLALRAGVAALSDTDHLNKSINLAREGREYLKKNIPFAVYPSQANFVLVDVTPLKAKKVSENLMKKGIIVRPCDSFREAGDSLIRVTVGTPEQNEKVVRAFEISKTEV

SEQ ID NO: 2582 - protein, 173 aa, Geobacillus thermocatenulatus
MAQNRHQALGLSDDTVLEMYETMLLARKLDERMWLLNRAGKIPFVISCQGQEAAQVGAAFALDRTKDYVLPYYRDMGVVLTFGMTPRELMLAAFAKAEDPNSGGRQMPGHFGQKKNRIVTGSSPVTTQVPHAVGFALAAKMEKKDFVAFVTFGEGSSNQGDFHEGANFAGVQA

SEQ ID NO: 2583 - protein, 427 aa, Arabidopsis thaliana
MRYDQEAGSSSHSLPSGSSSHSLPPTEDTPLLGPRTLSSQPKTFANVFIAIVGAGVLGLPYTFKKTGWLLGLLTLLFVSSLTFFCMMLLVHTRRKLESLSGFNSITSFGDLGESVCGPAGRLVVDVMLVLSQSGFCVSYLIFVATTMANLLSRGTEHILGLDAASIYLWGCFPFQLGLNSIPSLTHLAPLSIFADIVDVAATLVVMVQDVFIFLKRRPPLRVFGGVSVFFYGLGVAVYAFEGIGMVLPLELEAKYKDKFGRALGLAMGLISIMYGAFGLLGYMAYGEETKDIITTNLGTGVVSTLVQLGLAINLFFTFPLMMQPVYEVVERRLCSSRYSVWVRWATVLVVTLVALLVPNFADFLSLVGSSVCVVLGFVLPSLFHLQAFKNELSITRIVVDVLVFLIGVMIAITGTWTAVHEILTSKA

SEQ ID NO: 2584 - protein, 320 aa, Streptococcus pneumoniae TIGR4
MPKKILVLHTGGTISMQADASGAVVTSSDNPMNHVSNPLEGIQVHALDFFNLPSPHIKPKHMLVLYQKIKEEADNYDGVVITHGTDTLEETAYFLDTMEVPHMPIVLTGAMRSSNELGSDGVYNYLSALRVASDDRAADKGVLVVMNDEIHAAKYVTKTHTTNVSTFQTPTHGPLGLIMKQEILYFKTAEPRVRFDLDHIQGLVPIISAYAGMTDELIDMLDLEHLDGLIIQAFGAGNIPKETAQKLESLLQKGIPVALVSRCFNGIAEPVYAYQGGGVQLQKAGVFFVKELNAQKARLKLLIALNAGLTGQALKDYMEG

SEQ ID NO: 2585 - protein, 475 aa, Streptomyces coelicolor A3(2)
MTSAQVDTDKAPEEGYERGLNSRQVQMIAIGGAIGVGLFLGAGANIAKAGPSIILMYALAGVIIFFIMRALGELLLYRPVSGSFAEYSREFLGPFFGYFTGWTYWLMWVVTGMAELTAAAIYIHYWFPDIPQWVSALVFLVLLFVANLISVKLFGEIEFWFSMVKVTAIIGMIVIGVGVLTLGFSQAGDTAAVSNLWEFDGFFPKGIGSSLMTLQGVMFAYLAVELVGVTAGESENPEKTLPKAINTLPWRIALFYVGALTVILAVVKWTEFAEGVSPFVEAFAVIGIPAGAGIVNFVVLTAALSSCNSGMYSTGRMLRTLADNGEAPRIFNKLSSTKTPAIGIAVSVVFMAIGVVLNYLVPEKAFGYVTSVATAAGIWTWLMILISHVRYRRKVVAGRLPASSFPAPGGSVCSYIAIAFLLFVTCLIAYDADARVCLYVMAGWAAALGIGWAVLKSRNPQITERPGEPEFEKIG

SEQ ID NO: 2586 - protein, 271 aa, Zea mays
  unsure (1)..(271): unsure at all Xaa locations
SRSRTSIEDPFDQDDWVHNCSFQELKSFLVLLDVRSKTTFVTNIRENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPXTRVAKAIKEKSCNALLXLKVNQIGSVTESIEAVKMSKRAGWGVMTSHRSGETEDTFIADLAVGLSTGQIKTGXAPCRSERLAKYNQLLRIEEELGXAIAVYAGAKFRAPVEPY

SEQ ID NO: 2587 - protein, 557 aa, Escherichia coli CFT073
MRKPVYYMEILLTILILTLVVSLTSVLTRLSPVQIPLPLIQIAAGAVLAQPIFGLHVEFNPELFLLLFIPPLLFAESSKIQPKELIKHSREIISLALVLVLITIFGVGYVIHLLLPNVPLIAAFALAAVLSPTDAVALLGIVGKGRISKNIQEVLEGEALMNDASGLVALKFAVAVTMGTMEFSVHGATIAFFVVALGGIAVGIAVTWLYGKGLLLISRYAHDEPSIQIVLMLLLPFIVYLVAEHFGLSGILAAVAAGLTTSRIGVVHHAPIRLRIKAKSSWSMLEYVFNGMVFLILGLQLPGIISESLIRAENDPLVDTGSLLLDVIWIYLALMVVRLGWLWLMRLYSRKRPGKHPMLFAGYKTRHMLLATFAGVRGAITLAGVLSIPLLLPDGTPFPGRYLLVFLATGVILFSLVCGIIILPLLLGKNVGIFSDNRQKEEEAADLFMAKMAILSVQKTEQRLLRARTENLDNELIMETGARVIGYMRHSEEDMSPNDNSLHMQRAKLERTFNLAALNAKRAAIYQMRARQEVSDETLAKIVSELDVLETLIMDSR

SEQ ID NO: 2588 - protein, 554 aa, GIBBERELLA ZEAE PH-1
MSNSSSRDEPYTMEPSTKKTIWQCIRENPKIIFIAFFASLGGFEYGYQQGVLGQSLVMTRFTQNFPSVVESSSATGWLTSILQLGGILGSLSAGVSSEIISRKYTMFIACCWVVLGSYLYVGATAGNPSLLYAGRFFTGLGVGLFSGVGPLYNAELSAPEMRGFLVSFYQLATILGIMLSFWVGYGCNYIGGTGDGQSDLAWRLPSIIQGIPAAILAVGIWFMPFSPRWLVKVGRDEEAKSTLAWMRKLPIDSDRVQVEYLEIKAEAVFEQKVFARDFPHLAEKGKSKFRQEIAQYVTCFRSMDNFKRVCTAWLIMFFQQWSGIDAIIYYASNVFISLGLTGGTIALLATGVTGVVFLISTIPAMFIIDRVGRKPMLQVGSIVMGASMITVGIIVAKFRHDWPSHVAAGWTAVALIWVYIAGFGATWGPVSWTLISEIFPLSIRAKGASIGASSNWLNNFAIAFFVPPMLEAWEWGTYIFFAVFLFAGILWVWFFLPETKNASLEEMDRVFKSRAGEQDAELLREAQAEVGLLGSVSGRKASMEKQGEKHVEEL

SEQ ID NO: 2589 - protein, 428 aa, Oryza sativa
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATLLRIEEELGAAAVYAGAKFRAPVEPY

SEQ ID NO: 2590 - protein, 1331 aa, Saccharomyces cerevisiae
MMMDILNTQQQKAAEGGRVLAPHTISSKLVKRLSSHSSHKLSRSDLKALGGSETISDGPSQLTFKDRYVFNESLYLKKLKKTALDDYYTRGIKLTNRYEEDDGDDEIIRLSNGDRIDEDLHSGVKFFSTTPYCRKMRSDSDELAWNEIATERFKWQSMLARVLKGDIVKGEKTRIANQVKKPGLNKELSDEIWLELKAWLNGRTMQEMEQSLTYLRDSSDSVFEEIMKFQIPQGKILSLDALEAILQDLMNRYHSVVSYWPNLKKMYKDKPITNTAEFTARIDVMNSWLNFKTNLTLRRQELDDWINRFSPISSSDNCQEDFDGVPQWNCKMKILAEQLMKEKNIESIFQKKIFYPLSPWMFKLKLHFIVYRETLTKMNIKYPYERLRSLLAFPVYLIKEVILTRLSYARKLKNPTMMMIDQMIDDFNAFIRLSVQLKYTLTKYCSNLPFDVDFDPTFENTVIEAIRYLFFLLNLKLIDSSKQNFKAPDLLLKYWDHLKNTGHYINGAETVIPNEFLKLTLRLVHKLQFYLLKQQNFPPTFANASEAEKWLSSIFENLGAMKRKLNRFSNILVKAFQNSAVYQINHNAQLVKKLKDAHYFLVYSGNTFESSGVYMFAAPELLGCDNDTILRILRNKSIGCDLVPKLDIGNNLNVYDITTKETDLNILVSKGEDSKGIPYYRVVANSSSDLDRHAHQSKKKNFSTDPFDQHLDEKNNEVFELEVALSSLGALVVLYPGEPVVWDGPVYKLPGNNLFASNEMDLGKIGNPNTLILLNQGSNYALTYQIDKFNQTVGDSVSFIEKRCSLNSIESSLQKINKAYYKLTYTVLNNYKGILGSFMKQCPGNELLNSIFMFGRDFGRSFLKYNAFSSKRKYVIIFLMVKLGMNWLKFLVEECDPTDQRTFRWCVLAMDFAMQMTSGYNILALNVKQFQELKERVSVCMSLLISHFDVMGARATEAENGMQQARLNIDTEENIDEEATLEINSRLRLEAIKTLEKTMKRNPRQMGKVLDATDQGNKYLLSLASSLSNVSMRWQKRSFIGGGTFGQVYSAINLENGEILAVKEIKIHDTTTMKKIFPLIKEEMTVLEMLNHPNIVQYYGVEVHRDKVNIFMEYCEGGSLASLLDHGRIEDEMVTQVYTFELLEGLAYLHQSGVVHRDIKPENILLDFNGIIKYVDFGTARTVVGSRTRTVRNAAVQDFGVETKSLNEMMGTPMYMAPETISGSAVKGKLGADDVWALGCVVLEMATGRRPWSNLDNEWAIMYHVAAGRIPQLPNRDEMTAAGRAFLERCLVQDPTMRATAVELLIDPWMIQIREIAFGNSEKDQVPILSS

SEQ ID NO: 2591 - protein, 346 aa, Mycobacterium tuberculosis H37Rv
MSTVAAYAAMSATEPLTKTTITRRDPGPHDVAIDIKFAGICHSDIHTVKAEWGQPNYPVVPGHEIAGVVTAVGSEVTKYRQGDRVGVGCFVDSCRECNSCTRGIEQYCKPGANFTYNSIGKDGQPTQGGYSEAIVVDENYVLRIPDVLPLDVAAPLLCAGITLYSPLRHWNAGANTRVAIIGLGGLGHMGVKLGAAMGADVTVLSQSLKKMEDGLRLGAKSYYATADPDTFRKLRGGFDLILNTVSANLDLGQYLNLLDVDGTLVELGIPEHPMAVPAFALALMRRSLAGSNIGGIAETQEMLNFCAEHGVTPEIELIEPDYINDAYERVLASDVRYRFVIDISAL

SEQ ID NO: 2592 - protein, 330 aa, Neisseria gonorrhoeae
VAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAVLNIVPNSTGAAKAIGLVIPELNGKLDGSAQRVPVATGSLTELVSVLERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 2593 - protein, 325 aa, Listeria monocytogenes EGD-e
MNLKKHSERKFDLITVGRACIDLNAVEYNRPMEETMTFSKYVGGSPANIAIGTAKLGLKVGFIGKISDDQHGRFIEKYMRDLAINTDGMVKDTEGRKVGLAFTEIKSPDECSILMYRENVADLYLTPEEISEDYIKEARVLLISGTALAQSPSREAVLKAVSLARKNDVVVAFELDYRPYTWKNSEETAVYYSLVAEQADVIIGTRDEFDMMENQVGGKNEATKAYLFQHQAKIVVIKHGVEGSFAYTKAGETFQAQAYKTKVLKTFGAGDSYASAFLYGLFSDESIETALKYGSAAASIVVSKHSSSDAMPTADEIKALIAQAE

SEQ ID NO: 2594 - protein, 498 aa, Arabidopsis thaliana
MAFAKAPRLSRDDILGNRVSTRSFKIFSDNQKTDPASTIGTSQKKTRIPLRRKIRESQERAKAVLKTGEMERCKNGKSEKENVSKRTTELGNNNLYKTASKASNQAVPQLSSAGTYTWKTRTSVGSIQSDGNKQSKNNVRFIQTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRERSMLKQLKFRLNAPTPYVFMLRFLKAAQSNKKLEQLAFYLIELCLVEYEALKYKPSLLCASAIYVARCTLHMTPVWTSLLNNHTHYNVSQMKDCSDMILRFHKAAKTGNLRVTYEKYINPDRSNVAVLKPLDKLPL

SEQ ID NO: 2595 - protein, 527 aa, Shigella flexneri 2a str. 301
MSPEINGHAARGSLRPDVHKLHISDRRETGVIMNFHHLAYWQDKALSLAIENRLFINGEYTAAAENETFETVDPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 2596 - protein, 326 aa, Zea mays
RAIKGENIRNRHDRLRRALPPFLAPPLALLLLAAIVLSRAVSHAHGGGGGFYDPASVTQLSSRPRAFLYSGFLSDTECDHLVSLAKGSMEKSMVADNDSGKSVASQARTSSGTFLAKREDEIVSAIEKRVAAWTFLPEENAESLQVLRYETGQKYDAHFDYFHDRNNLKLGGQRVATVLMYLTDVNKGGETVFPNAEERIACFQGSHLQYKDETWSECSRSGLAVKPKKGDALLFFNLHVNATADTGSLHGSCPVIEGEKWSATKWIHVRSFDNPPDVRTDAPCSDDKELCPRWAAIGECHRNPTYMVGTKDTLGFCRKSCGICDA

SEQ ID NO: 2597 - protein, 545 aa, Zea mays
QRGKFNLLASSIGEGRARLTQWRESQLNVLTTLDQAKTQWYHFMAIVIAGMGFFTDAYDLFCIALVTKLLGRIYYSDPTSKDPGSLPPNVSAAVTGVALCGTLAGQLFFGWLGDKLGRKSVYGFTLILMVLCSVASGLSFGHTPKGVIATLCFFRFWLGFGIGGDYPLSATIMSEYANKKTRGAFIAAVFAMQGFGILFGTIVALAVSAAFRNAFPAPPYFVDAQASLVPEADYVWRVILMFGTVPAALTYYWRMKMPETARYTALIARNTKQATADMAKVLKKEIEKEDEQVERQVVGADTWGLFSAQFLRRHGLHLLATSSTWFLLDIAFYSQNLFQKDIFTKVGWIPPARTMNAIEEVYRISRAQALIALCGTIPGYWFTVGLIDIVGRFWIQIMGFFMMTVFMLALGVPYEHWTKASNHTGFVVLYGLTFFFANFGPNSTTFIVPAEIFPARLRSTCHGISAAAGKAGAIIGAFGFLYAAQDPKKPDHGYSPGIGIRNTLFVLAGTNFLGMLMSVFVPESKGMSLEEISKENVDDEAEAEV

SEQ ID NO: 2598 - protein, 248 aa, Triticum aestivum
  unsure (1)..(248): unsure at all Xaa locations
MSTAVARPFGGFPGSGRAKGDELLGKKMSDGFFIEEEEEEEAEEVLTESSSIGRAXSPSSSSIGEDSSSEVGGEGEDEEVESKLKEEPGLGCLDALEDSLPIKNGLSSFYAGKSKSFTSLAEAAARDAVKELAKPENPFNKRRRILATWSRRASCSSLATATYLPPLLAPDHALPEGDEGEEDDDSDSGSDEQHRGKNGWEAPALPPPRLSVNTQMGASAARRGGSFRSPRSYSLSDLRNGGDASYNQ

SEQ ID NO: 2599 - protein, 709 aa, Pseudomonas aeruginosa UCBPP-PA14
MSEQNNEQRSQAAGTDTVDRGNSNAKLEQLEAYREDATGEALSTNTGTRIADNQNTLKAGERGPSLLEDFIMREKITHFDHERIPERVVHARGSAAHGYFEAYEDLSDLTKAGFLAEAGKRTPVFVRFSTVQGPRGSADTVRDVRGFAVKFYTDEGNFDLVGNNMPVFFIQDAIKFPDFVHAVKPEPHNEIPTGASAHDTFWDFVSLTPESAHMVMWLMSDRAIPIAYRNMQGFGVHTFRLVNAAGESVLVKFHWRPKSGTCSLVWDEAQKLAGKDPDFNRRTLWEDIEKGDYPEWELGLQVIPENQQDSFDFDLLDPTKLVPEELVPVRVVGRMVLNRNPDNFFAETEQVAFHVGHLVPGIDFTNDPLLQGRLFSYTDTQLLRLSGPNFNEIPINRPLCPFHNNQRDAPHRQTINRGRASYEPNSIDGGWPKETPPAARNGGFSSYHEPVSGSKLRKRADSFADHFSQAALFWHSMSEAEQAHIVAAYSFELSKVERQSIREREVNQILLNIDPQLAARVAANVGVQLAAPANPAPQPKPSPALSQMNLLSGDIRSRKVAILIADGVAESDVSDLRDALRQEGADAKLIAPSASPVQAENGAELNPEGTWDGLPSVAFDAVFVPGGAASSQAIGADGRGLHYLLEAYKHLKPVAFAGDAQALASQLSLPGDPGVLLGATATDVFPGLRQALMQHRIWQREAATKAIPA

SEQ ID NO: 2600 - protein, 263 aa, Arabidopsis thaliana
MFGFFKSPGNNKLPNESSNNKGGTITAGRRTSSEPILITPDFDDDDKYKNGFNDSGGLQSQTTEELEKYAVYKAEETTKGVNNCLKIAEDIRSDGARTLEMLHQQGEQINRTHEMAVDMDKDLSRGEKLLNNLGGMFSKPWKPKKTKNITGPMITPDKPSKKSENHKEEREKLGLGAKGRSSSQPALDQPTNALQKVEQEKAKQDDGLSDLSDILGDLKSMAVDMGSEIDKQNKALDHLGDDVDELNSRVQGANQRARHLLSK

SEQ ID NO: 2601 - protein, 449 aa, Oryza sativa
MAATLSSAPAPSKHCSIVRAQHSPPPSILSSSTVSQKTAFHGLSLVDRRWAASVGGGSGRRRRVLQVNARTAGAAKNIEVEVDKPLGLTLGQKTGGGVVITAVDSGGNAARAGLKSGDQVLYTSSFFGDELWPADKLGFTKTAIQAKPDSVYFVVSRGAQVDVKRLPKRPAPPRFGRKLTESQKARATHICLDCGYIYFLPKPFEEQPDEYGCPQCNAPKKRFAKYDAETGRAIGGALPPITVIKELKEEEVIMSYYRGTSPAWGLGRRGGGGGPSPVVPLLIVVALVWVNYNETLTEWYDKAANLPGTVADNAVTLVAAGGLLLLAAVLLSRRSEVVVVPVAIVLSVMLLQNIMAFLVLLLVVAYFAGIYYYPADAAKYGVTAGGEWCGGGGFWSGLGFYMLLLLCLVLCAMFADEGVRWWIPGTLLAASLLCLNLFSGGQVLGYGHL

SEQ ID NO: 2602 - protein, 512 aa, Oryza sativa (japonica cultivar-group)
MENAGAGDGAPKHYPGKMTVFVFIACLVASSGGLIFGYDIGISGGVTSMDPFLSRFFPSVYAKEKEVVDTNQYCKFDSEPLTLFTSSLYLAALIASLFASVITRKLGRKMTMLGGGFIFLIGAVLNGAAVNVAMLIIGRILLGIGVGFSIQAVPLYLSEMAPAKMRGMLNIIFQLMITVGILFANLINYFTDKIAGGWGWRVSLGLAAVPAVIMTVGSILLPDTPNSLLSRGKENEARTMLRRIRGTEDIGPEYDDLVAASEATKAIENPWRTLLERRYRPQLVMSVLIPTLQQLTGINVVMFYAPVLFKTIGFGGTASLMSAVITGLVNMFATFVSIATVDRFGRRVLFIQGGIQMIIAQFILGTLIAVKFGTAGVANISQGYAIVVVLFICLFVSAFAWSWGPLGWLVPSEIFPLEIRSAAQSVVVVFNMAFTFFIAQIFLMMLCRLKFGLFFFFGAMELIMTGFVLVFLPETKGIPIEEMDRIWGEHWYWSRFVGAGRNRVMQMASTNV

SEQ ID NO: 2603 - protein, 339 aa, Bacteroides thetaiotaomicron VPI-5482
MELLVTIIILALIFDYINGFHDAANSIATIVSTKVLTPFQAVLWAAFFNFVAFFIAKYIIGGFGIANTVSKTVVEQYITLPIILAGIIAAIFWNLITWWKGIPSSSSHTLIGGFAGAAIMANGFEAIQLNIILKIAAFIFLAPFIGMIIAFGFTLLVLYICRRTNPHTAEMWFKRLQLVSSAMFSVGHGLNDSQKVMGIIAAAMIAAHSMGLGMGINSISDLPDWVAFSCFTAISLGTMSGGWKIVKTMGTRITKVTPLEGMVAETAGAFTLYITEMLKIPVSTTHTITGAIIGVGATKRLSAVRWGVTKSLMTAWVLTIPVSGLLAACIYCVVSLFLK

SEQ ID NO: 2604 - protein, 415 aa, Schizosaccharomyces pombe
MDVSTQTRHATYFQDENQLQKDHIYVKKKSHIKLNTGVRAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRADSYDHDIRMLAKYLQEVTLMDEIFIGAHISFIAATAYYLSMQMLGHLDWTPCHVYYSGYTARQLKPCAIIIMECLVDAPNHHNAIYRKYSENRMKRVSAFAHNWVLSVI

SEQ ID NO: 2605 - protein, 809 aa, Streptomyces venezuelae
MTGKTRIPRVRRGRTTPRAFTLAVVGTLLAGTTVAAAAPGAADTANVQYTSRAAELVAQMTLDEKISFVHWALDPDRQNVGYLPGVPRLGIPELRAADGPNGIRLVGQTATALPAPVALASTFDDTMADSYGKVMGRDGRALNQDMVLGPMMNNIRVPHGGRNYETFSEDPLVSSRTAVAQIKGIQGAGLMTTAKHFAANNQENNRFSVNANVDEQTLREIEFPAFEASSKAGAASFMCAYNGLNGKPSCGNDELLNNVLRTQWGFQGWVMSDWLATPGTDAITKGLDQEMGVELPGDVPKGEPSPPAKFFGEALKTAVLNGTVPEAAVTRSAERIVGQMEKFGLLLATPAPRPERDKAGAQAVSRKVAENGAVLLRNEGQALPLAGDAGKSIAVIGPTAVDPKVTGLGSAHVVPDSAAAPLDTIKARAGAGATVTYETGEETFGTQIPAGNLSPAFNQGHQLEPGKAGALYDGTLTVPADGEYRIAVRATGGYATVQLGSHTIEAGQVYGKVSSPLLKLTKGTHKLTISGFAMSATPLSLELGWVTPAAADATIAKAVESARKARTAVVFAYDDGTEGVDRPNLSLPGTQDKLISAVADANPNTIVVLNTGSSVLMPWLSKTRAVLDMWYPGQAGAEATAALLYGDVNPSGKLTQSFPAAENQHAVAGDPTSYPGVDNQQTYREGIHVGYRWFDKENVKPLFPFGHGLSYTSFTQSAPTVVRTSTGGLKVTVTVRNSGKRAGQEVVQAYLGASPNVTAPQAKKKLVGYTKVSLAAGEAKTVTVNVDRRQLQTGSSSADLRGSATVNVW

SEQ ID NO: 2606 - protein, 247 aa, Triticum aestivum
  unsure (1)..(247): unsure at all Xaa locations
GRVGNEIRTQPLKPSLFIYXSTVESVTLWHVHTGICILIFAGGGAHPSALASVDFHPSDIYRIASCGMDNTVKIWSMKEFWPYVEKSFTWTDLPSKFPTKFVQFPLMTSVVHSNYVDCTRWLGDFILSKSVDNEIVLWEPKIKEQGPGEGSIDVLQKYPVPDCDIWFIKFSCDFHFNQLAIGNREGKIYVWEVQASPPVLITRLSSPQCKMPIRQTAVSFDGSTILACGEDGSIXRWDEVEHQAAKN

SEQ ID NO: 2607 - protein, 426 aa, Arabidopsis thaliana
MQNQRLIKQQQQQQQQQHQQAMIQQAMMQQHPSLYHPGVMAPPQMEPLPSGNLPPGFDPTTCRSVYAGNIHTQVTEILLQEIFASTGPIESCKLIRKDKSSYGFVHYFDRRCASMAIMTLNGRHIFGQPMKVNWAYATGQREDTSSHFNIFVGDLSPEVTDAALFDSFSAFNSCSDARVMWDQKTGRSRGFGFVSFRNQQDAQTAINEMNGKWVSSRQIRCNWATKGATFGEDKHSSDGKSVVELTNGSSEDGRELSNEDAPENNPQFTTVYVGNLSPEVTQLDLHRLFYTLGAGVIEEVRVQRDKGFGFVRYNTHDEAALAIQMGNAQPFLFSRQIRCSWGNKPTPSGTASNPLPPPAPASVPSLSAMDLLAYERQLALAKMHPQAQHSLRQAGLGVNVAGGTAAMYDGGYQNVAAAHQQLMYYQ

SEQ ID NO: 2608 - protein, 293 aa, Desulfitobacterium hafniense
PRCRHNSGFPTPRRKPTMQYPEWIWHNGSIKRWADATTHVMSHALHYGSSVFEGIRTYDTPNGPIIFRLNDHNQRLFASAKIYDMAIPYSLAQINAACHEVIKANGNTTDYLRPVAYRGLGGFGLSADTPTDVAVATWKMGQYLGPSVLEEGIDACVSSWQRFAPNTIPAGAKAGGNYLSGQLVAREARRLGFGEGIALASTGLLSEGAGENLFLVFNGALHTTPVSAALLNGLTRNTIITLARDVGIEVVERDLPREYLYLCDELFMCGTAAEITPIRSVDGRQVGSGRRGP

SEQ ID NO: 2609 - protein, 568 aa, Gibberella zeae
MAQEARPVAKTSGGNNAFHNFHNDFAHIADPNERRRLALAEIDKAPFGWYHVRACIVAGVGFFTDSYDIFCVSMLTIMLGIVYYPGKGKLPTSSDNAIKLSTSAGTVIGQFGFGMLADIVGRKRMYGLELIVTIFATLAQALTAGSPSTSLVGLIIFWRVIMGVGIGGDYPLSSIITSEFATTKWRGAMMAAVFAMQGIGQLVAALVMMFLTLGFKSSLEQAADTKSCTGDCQIAVDKMWRTLVGFGAVPACIALYYRLTIPETPRYTFDVARDVEQADEDVKAYINGKSEGNTDEVTRAQNLQSAKTNLEVPKASWRDFFQHYSKWKNASLLLGTAGSWFCLDVAFYGLSLNNGTILKVIGYSTKDATNVYEFLHNTAVGNIIIVLAGAVPGYWVSVATIDTLGRKTIQLGGFIILTILFIVMGFAYNHIPSNGLLAIYVLAQFFFNFGPNTTTFIVPGEVFPTRYRSTSHGISAASGKIGSIIGQGAISILRTHGATDKNEAPWMDHVLEIYALFMLLGIFTTLLIPETARKTLEELSGEDDYANHDHALESETQASHDKARRTSV

SEQ ID NO: 2610 - protein, 214 aa, Oryza sativa
  unsure (1)..(214): unsure at all Xaa locations
TIDQLFNPAEIFHDIVLDYPLDAVTRPNVAHSCECFAMLXGHINKSLFLYVNNIGRYVEYMYRCTSRWYGSRGICFTYGTGFGIKGLVAAGXTFRTSSAIRKATDSMLXGGWGESYLSHFNARXNSLFGLHTHAVNTSWXILTLIDAAGQDXDDVLVHRLREDPMLLHRAAKDGEFPQQVLLPIWVLGMGWSKSIHKNSNLLLPLSTFDSHISS

SEQ ID NO: 2611 - protein, 394 aa, Zea mays subsp. mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 2612 - protein, 269 aa, Mycoplasma hominis
PEFEIVAINDLTDAATLAHLLKYDTAHGKLNENISHTENSIVVDGKEYRVYSEKDPLNLPWKELNVDIVIEGTGRFVTKEGAELHIQAGAKKVFITAPAKSEGVKTVVYSVNEDIITPEDKILSGASCTTNCLAPIANVLEKNFGIEKGFMTTVHSYTADQRLQDAPHKDLRRARAAASNMVPTTTGAAIAIGKVIPSLDKKLNGLSLRVPTITGSFVDLTVELKKDATVQEINEAIKKSASESLEYSTEPIVSSDIIGAKAGSIFDSL

SEQ ID NO: 2613 - protein, 568 aa, GIBBERELLA ZEAE PH-1
MAQEARPVAKTSGGNNAFHNFHNDFAHIADPNERRRLALAEIDKAPFGWYHVRACIVAGVGFFTDSYDIFCVSMLTIMLGIVYYPGKGKLPTSSDNAIKLSTSAGTVIGQLGFGMLADIVGRKRMYGLELIVIIFATLAQALTAGSPSTSLVGLIIFWRVIMGVGIGGDYPLSSIITSEFATTKWRGAMMAAVFAMQGIGQLVAALVMMFLTLGFKSSLEQAADTKSCTGDCQIAVDKMWRTLVGFGAVPACIALYYRLTIPETPRYTFDVARDVEQADEDVKAYINGKSEGNTDEVTRAQNLQSAKTNLEVPKASWRDFFQHYSKWKNASLLLGTAGSWFCLDVAFYGLSLNNGTILKVIGYSTKDATNVYEFLHNTAVGNIIIVLAGAVPGYWVSVATIDTLGRKTIQLGGFIILTILFIVMGFAYNHIPSNGLLAIYVLAQFFFNFGPNTTTFIVPGEVFPTRYRSTSHGISAASGKIGSIIGQGAISILRTHGATDKNEAPWMDHVLEIYALFMLLGIFTTLLIPETARKTLEELSGEDDYANHDHALESETQASHDKAGRTSV

SEQ ID NO: 2614 - protein, 551 aa, Kluyveromyces lactis
MSLKNWLLLRDIQYEGTFYKKFPHVYNIYVIGFIACISGLMFGFDIASMSSMIGTDVYKDYFSNPDSLTYGGITASMAGGSFLGSLISPNFSDAFGRKVSLHICAALWIIGAILQCAAQDQAMLIVGRVISGMGIGFGSSAAPVYCSEISPPKIRGTISGLFQFSVTVGIMVLFYIGYGCHFIDGAAAFRITWGLQMVPGLILMVGVFFIPESPRWLANHDRWEETSLIVANIVANGDVNNEQVRFQLEEIKEQVIIDSAAKNFGYKDLFRKKTLPKTIVGVSAQMWQQLCGMNVMMYYIVYIFNMAGYTGNTNLVASSIQYVLNVVMTIPALFLIDKFGRRPVLIIGGIFMFTWLFSVAGILATYSVPAPGGVNGDDTVTIQIPSENTSAANGVIASSYLFVCFFAPTWGIGIWIYCSEIFNNMERAKGSALSAATNWAFNFALAMFVPSAFKNISWKTYIIFGVFSVALTIQTFFMFPETKGKTLEEIDQMWVDNIPAWRTANYIPQLPIVKDEEGNKLGLLGNPQHLEDVHSNEKGLLDRSDSASNSN

SEQ ID NO: 2615 - protein, 548 aa, Photobacterium profundum
MTGAELVVHALQQQGITTIFGYPGGAIMPIYDALYDGGVEHILCRHEQGAAMAAIGMARATQDVAVCMATSGPGATNLVTGLADAFLDSVPMVAITGQVASSHIGTDAFQEMDVIGMSLSCTKHSYLVTDINDLAPTLAEAFIVAKAGRPGPVIVDIAKDVQLAQAPVELLPFIEEPSIPVATPESIAKAQCLLAASQRPVLYVGGGVQIAKATDTVRTFLKLNPMPAVSTLKGLGTVERHAPHYLGMLGMHGTKAANLVVQESDLLIVVGARFDDRVTGKLDTFAPHAKVIHLDIDASEFNKLRIANAPLRGDVNVILPQLELSQDISAWVQHSETLRSDFKWRYNHPGDLIYAPLLMKQLSDMMPDSSVISTDVGQHQMWAAQHIQPREPQNYITSAGLGTMGFGLPAAMGAKVARPNDESILISGDGSFMMNVQELGTLKRKQIPVKMVLINNQRLGMVRQWQSLFFNERHSETILDDNPDFVVLASAFGIPGKTITKKEEVEPALREMLASKTAYLLHVLISEEENVWPLVPPGAANQDMLENT

SEQ ID NO: 2616 - protein, 408 aa, Methanopyrus kandleri
MSKRKYRGFVYTDDLAKPEEFIRFLRRFLSPPEPETVEVGPELSGRVLAEDVRAERPSPPFTRSAMDGYAVRSEDAEPGARLKVVGESRIGEGTDVKVGPGEAVYVDTGAPVPEGADAVIPVEFVERDGDEIIVEEGVDPGDNLDPAGCYVEEGEVLYRSGHLVEPVDVGVMLEHGVEEVDVHRPLRVSIVVTGNELVHRPSELESETQVVDCIGPVLTAELENMGCVEVVGTSLVKDDPGEIRETVEDYADRSDVVLITGGSSVGERDHVKDILDDTFDAFIHGIRARPGRPFGIAAREGTVAFTLPGWPTSCYSTFRVWVVPSLLVLAGADPLVVGFETEATGIKSKREVGVIARVRLTSDGAEGLSRDRSSHFALFRETDGFALVPPGGSERALILPLRVPQLVR

SEQ ID NO: 2617 - protein, 293 aa, Streptomyces nogalater
MKGIILAGGTGSRLHPTTLAVSKQLLPVGDKPMIYYPLSVLMLAGVTDILIISTPHELPRMRRLFGDGAQLGLRLAYAEQEKPRGIAEAFLIGADHVGSDAVALALGDNIFHGSSFQGVLRKEAEELDGCVLFGYPVKDPQRYGVGEANASGRLVSIEEKPVRPRSNRAITGLYFYDNEVVDIARRLRPSARGELEITDINRTYMERGRARLVDLGRGFAWLDTGTPESLLQASQYVSALEERQGIRIACIEEVALRMGFINAQACYELGARLSGSGYGQYVMAIAEECTGRV

SEQ ID NO: 2618 - protein, 225 aa, Brucella suis 1330
MRPIAIAPSILSADFARLGEEVDAVLEAGADWVHIDVMDGHFVPNITFGPQVVKAIRPRTKAFFDAHLMIAPCDPYLEPFAEAGCDLITVHAEAGPHTHRSLQSIRALGKKAGLALNPATPAEALTNVLDDLDLILVMTVNPGFGGQKFIAPMLDKIRRVREMVGDRPIDIEVDGGITPETAGSVVAAGANILVAGSAVYKGNSVESYRANIDAIRAAAEAARNR

SEQ ID NO: 2619 - protein, 291 aa, Glycine max
  unsure (1)..(291): unsure at all Xaa locations
LAFFFFFFFFFFFFFLLGSIDATDMDNELAAAEYLDDIYKFYKXTEKKGWVGXDGGSHXFFNAKMRSILGDWLIEVHRKFELMPETLYLTLNIVDRFLSVKAVPRRELQLVGISSMLIASKYEEIWAPEVNDFECISDNAYVSQQVLMMEKTILRKLEWYLTVPTPYHFLGRYIKASTPSDKEMENMVFFLAELGLMHYPTAILYRPSLIAAAAVFAARCTLGRSPFWTSTLKHYTGYSEEQLRDCAKIMVNLHAAAPGSKLRAVYKKFCNSDLSAVALLSPAKENCLEQA

SEQ ID NO: 2620 - protein, 548 aa, Vibrio parahaemolyticus RIMD 2210633
MTGAQLVVAALRQQGIKTVFGYPGGAIMPIYDALYDGGVEHILCRHEQGAAMAAIGMARSTQDVAVCMATSGPGATNLVTGLADAFLDSVPLVAITGQVASSHIGTDAFQEMDVIGMSLACTKHSYLVTDIEDLAPTLAEAFEVAKTGRPGPVIVDIAKDVQLAQAPTELLPPYVAPEIEDVSAEDIKRAQDVLAASTRPVLYVGGGVQLAKATDAVREFLRLNPMPAVSTLKGLGTIERHDPHYLGMLGMHGTKAANLVVQEADLLIVVGARFDDRVTGKLDTFAPHAKVIHIDIDAAEIHKLRHANAPLRGDINTILPQLELTQDISSWVHHSESLRSGFKWRYDHPGDLIYAPLLLKQLSDMMPDSAIVSTDVGQHQMWAAQHIQPRDPQNFITSAGLGTMGFGLPAAMGASVARPDDQSILITGDGSFMMNVQELGTLKRRQIPVKIVLLNNQRLGMVRQWQSLFFDGRHSETILDDNPDFVMLAKAFDIPGKTITKKEEVEPALKEMLASETSYMLHVLIDEEENVWPLVPPGASNSDMLENT

SEQ ID NO: 2621 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNMRQVQCVSFIAFRPPGCEESGKA

SEQ ID NO: 2622 - protein, 710 aa, Corynebacterium efficiens YS-314
MSANPGIPSSGTPEVNEPTTPVPPLPRKPDQATAEPYSPTGCPMHISPDVNAQQGEYLTTAQGGRLRDTDHSLKAGERGPLLMQDHHFREKITHFDHERIPERVVHARGAAAHGVFKANGAASSICRAGVFAEGKETPVFTRFSTVLGNRGSADTVRDTRGFAVKFYTDEGTWDLVGNNIPVFFIQDGIKFPDVIHAAKPHPDRDIPQAQSAHDTFWDFVTLHTEATHHTIWNMSDRGIPRSYRMMEGFGVNTFRMINDKGETSLVKFHWKPKLGVHSQVWEEAQITGGVDPDFHRRDLADAIESGAFPEWDLGLQVFPDNKEQMFEGIDLLDPTKIVPEELAPVQIVGTMTLNKNVSNFHEETEQVAFHPGHLPPGIDVTADPLLQGRLFSYLDTQISRLGGPNFAQLPINRPHAPVNDMFREGMHQQGQHIGVAPYQPNSLDGGNPFPAEPSNGALIDVPVPVEGEITRSAPASFDDHYSQARLFYVSLSPIEQKHVADAYTFELGKCYEKAIKERAVHVLSNVDHDLASTVAKGLGVPAPEKKDLPEPTPSPALSQVGKTWPIDGRQIGILVTDDLPEDQVADVASLSKAIEDAGMVPLVTSTSGGTIGEPEEATGVAVSRTYVTVRSIEFDAAVVVETPEQPEVSILLSEMIRHGKAVALVGDATAQVPDRMGDAPGVVTVNAAADALDVLTPMLKGHRTWAANPA

SEQ ID NO: 2623 - protein, 309 aa, Oryza sativa
MGFKGFVEGGIASIVAGCSTHPLDLIKVRMQLQGEASAAAAAVAPAQAALRPALAFHAGQAVAIPHDVIAPPRKPGPIAVGAQILRAEGAAGLFSGVSATMLRQTLYSTTRMGLYDILKKKWTQENGGVLPLHRKIAAGLIAGGVGAAVGNPADVAMRRGTPIGRMARDEGVRSLWRGSSRPVNRAMIVTASQLATYDQAKEAILARRGPGADGLGTHVVASFAAGLVAAAASNPVDVVKTRVMNMKVAPGAPPPYSGAIDCALKTVRSEGVMALYKGFIPTVSRQGPFTVVLFVTLEQVRKVFNGVEF

SEQ ID NO: 2624 - protein, 516 aa, Arabidopsis thaliana
MGLGGDQSFVPVMDSGQVRLKELGYKQELKRDLSVFSNFAISFSIISVLTGITTTYNTGLRFGGTVTLVYGWFLAGSFTMCVGLSMAEICSSYPTSGGLYYWSAMLAGPRWAPLASWMTGWFNIVGQWAVTASVDFSLAQLIQVIVLLSTGGRNGGGYKGSDFVVIGIHGGILFIHALLNSLPISVLSFIGQLAALWNLLGVLVLMILIPLVSTERATTKFVFTNFNTDNGLGITSYAYIFVLGLLMSQYTITGYDASAHMTEETVDADKNGPRGIISAIGISILFGWGYILGISYAVTDIPSLLSETNNSGGYAIAEIFYLAFKNRFGSGTGGIVCLGVVAVAVFFCGMSSVTSNSRMAYAFSRDGAMPMSPLWHKVNSREVPINAVWLSALISFCMALTSLGSIVAFQAMVSIATIGLYIAYAIPIILRVTLARNTFVPGPFSLGKYGMVVGWVAVLWVVTISVLFSLPVAYPITAETLNYTPVAVAGLVAITLSYWLFSARHWFTGPISNILS

SEQ ID NO: 2625 - protein, 500 aa, Shigella flexneri 2a str. 2457T
MLKRKKVKPITLRDVTIIDDGKLRKAITAASLGNAMEWFDFGVYGFVAYALGKVFFPGADPSVQMVAALATFSVPFLIRPLGGLFFGMLGDKYGRQKILAITIVIMSISTFCIGLIPSYDTIGIWAPILLLICKMAQGFSVGGEYTGASIFVAEYSPDRKRGFMGSWLDFGSIAGFVLGAGVVVLISTIVGEANFLDWGWRIPFFIALPLGIIGLYLRHALEETPAFQQHVDKLEQGDREGLQDGPKVSFKEIATKYWRSLLTCIGLVIATNVTYYMLLTYMPSYLSHNLHYSEDHGVLIIIAIMIGMLFVQPVMGLLSDRFGRRPFVLLGSVALFVLAIPAFILINSNVIGLIFAGLLMLAVILNCFMGVMASTLPAMFPTHIRYSALAAAFNISVLVAGLTPTLAAWLVESSQNLMMPAYYLMVVAVIGLITGVTMKETANRPLKGATPAASDIQEAKEILVEHYDNIEQKIDNIDHEIADLQAKRTRLVQQHPRIDE

SEQ ID NO: 2626 - protein, 466 aa, Gelidium sp.
  unsure (1)..(466): unsure at all Xaa locations
YAKMGYWDPDYAVKETDVLALFRVTPQPGVDPVEASAAVAGESSTATWTVVWTDLLTACDLYRAKAYKVEQVPNNSDQYFAYISYDIDLFEEGSIANLTXXXXXXXXXXKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAXTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVIARNEGRDYVEEGPQILRDAAKTCGPLQTALDLWKDISFNYTSTDTADFVETPTANV

SEQ ID NO: 2627 - protein, 126 aa, Zea mays; identical to SEQ ID NO: 1969

SEQ ID NO: 2628 - protein, 463 aa, Gymnogongrus turquetii
MGYWDPDYVVKETDVLALFRVSPQPGVDPVEASAAIAGESSTATWTVVWTDLLTACDLYRAKAYKVDAVPNTSDQYFAYVAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQSMAIWARANDMILHLHRAGNSTYSRQKIHGMNFRVICKWMRMAGVDHIHAGTVVGKLEGDPLMIRGFYDTLLLPYLKVNLPQGYFFEQDWASLRKVTPVASGGIHCGQMHQLLDYLGIDVVLQFGGGTIGHPDGIQAGATANRVALESMVIARNEGRDYVAEGPEILQNAAKTCGPLQTALDLWKDITFNYTSTDTADFVETPTANV

SEQ ID NO: 2629 - protein, 376 aa, Arabidopsis thaliana
MATPVDPPNGIRNQGKHYFSMWQTLFEIDTKYMPIKPIGRGAYGVVCSSVNRESNERVAIKKIHNVFENRIDALRTLRELKLLRHLRHENVVALKDVMMANHKRSFKDVYLVYELMDTDLHQIIKSSQVLSNDHCQYFLFQLLRGLKYIHSANILHRDLKPGNLLVNANCDLKICDFGLARTSNTKGQFMTEYVVTRWYRAPELLLCCDNYGTSIDVWSVGCIFAELLGRKPVFPGTECLNQIKLIINILGSQREEDLEFIDNPKAKRYIESLPYSPGISFSRLYPGANVLAIDLLQKILVLDPSKRISVTEALQHPYMAPLYDPSANPPAQVPIDLDVDEDEDLGAEMIRELMWKEMIHYHPEAATINNNEVSEF

SEQ ID NO: 2630 - protein, 221 aa, Oryza sativa
MSEVFEGYERQYCEVSASLFRKCTTASALDGEKKKQKLSEIQSGVEEAESLIRKMDLEARSLQPSVKAGLLAKLREYKSDLNNLKSELKRISAPNARQATREELLESGLADTLAASTDQRGRLMMTTERLNQSNDKIKESRRTILETEELGVSILQDLHQQRQSLLHAHTTLHGVDDNVGKSKKILAAMSKRMDRNKWIIGGIIAALVLAILLILYFKLAY

SEQ ID NO: 2631 - protein, 309 aa, Hordeum vulgare subsp. vulgare
MSATRPSFFPSNNNRNKPATRNPFDSDSDDDGGMARRGPARASSVPTPAAGPARASSAPIPADEADQRGALFGAGPAPSGFASSSSAAARGRYRNDFRDSGGVEAQSVQELEGYAAYKAEETTRRVDGCLRVAEEMRDTASKTLLQVHQQGQQIRRTHAMAVDIDQDLSRGEKLLGDLGGLFSKKWKPKKNGAIRGPMLTRDDSFIRKGSHMEQRHKLGLSDRPHRSNARQFLSEPTSGLEKVEVEKAKQDDGLSDLSDILTELKGMAIDMGTEIEGQTKDLGHAEKDFDELNYRVKGANARTRRLLGR

SEQ ID NO: 2632 - protein, 495 aa, Thermus thermophilus
MPLITTETGKKMHVLEDGRKLITVIPGDGIGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGPKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 2633 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQSALEAMLDTL

SEQ ID NO: 2634 - protein, 252 aa, Oryza sativa
  unsure (1)..(252): unsure at all Xaa locations
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPQTHRPVSAGSSAAAASGLTTTASTAAFPSLAPAPPPQQHRLHNPVHASEDGHSSSGGSSDAPRCPDLNLDLDLXTASRHHHHQQQKTICLCYHLGVRNGDVCSCKAAAPSPAGPRAFRFLRPLEEGQYI

SEQ ID NO: 2635 - protein, 215 aa, Campylobacter jejuni subsp. jejuni NCTC 11168
MYVAPSLLSANFLKLEEEVKAIEAAGADLLHIDVMDGHFVPNLTFGPCVIEKISTISKLPLDVHLMVKDVSKFVDLFISLKPKFISFHMESEVHPIRLCEYIRSQGIHPAIVLNPHTPIDSIKHMLEFVDMVLLMSVNPGFGGQKFLPLIHEKIKELRQMIDKKNAKVFIEVDGGVNGLNASDLEESGADILVAGSYIFSSNDYKTAISSLKLEF

SEQ ID NO: 2636 - protein, 404 aa, Oryza sativa
MASAAAEVPSYFVCPISLQLMRDPVTLPTGISYDRAAIARWLAAPGARRTCPVTRQPLEHGLELTPNHTLRRLIQSWAASVSPGSAVDEEVAALRPVSSDEVASLLSDAAAAQVGALRRLRELAAECEDSRAMLESQGGVFDVLSRVVTSGSACSTAREEAVGVLASLRIPEQELIGVSTRHGNLAESLTAVLRSSNLQSRAHAVQLVRTLADAVVPAWVIGLNAELLAEVVGVVRDRVSARATKASLHALAALCPYGRHRVKIVGAGAVAALVELLLDEPERRVCELALAVLDRLCTCAEGRAELVAHAAGVAVVGKKVLRVSEAASERAVRVLRSVARHAATPAVLQEMAQCGVVGKLCLALRSEQCGVKTKEKAHEVLKLHSRVWRASPCLSPSFLALYPS

SEQ ID NO: 2637 - protein, 909 aa, Neurospora crassa
MSRGGPGAMNSQPRSTSFSTSVPQIPNQRARRPSVSSRFSYAVSIAEQGEAQTAQGVAAQHQIEEEIAQIKRYEDFTTIDWVQDAAREQLRRKARRKRNAGLWDAGRFDWRHRIRESYDAAQGWIVVTIIGAAIGVNAAFLNIITEWLADIKLGHCKTAFYLNENFCCWGEDNGCDDWQKWTGFSPINYLIYILFAILFACTSATLVKSYAPYAAGSGISEIKCIIAGFVMKGFLGFWTLVIKSLALPLAIGSGLSVGKEGPSVHYAVCTGNVISRLFAKYRRNASKTREILSACAAAGVAVAFGSPIGGVLFSLEEMSSYFPLKTMWRSYFCALVATAVLSAMNPFRTGQLVMFQVHYDRSWHFFEILFFILLGIFGGLYGAFVMKWNLRVQAFRKKYLTNYAILEATLLAAATAIVCYPNSFLRIDMTESMEILFLECEGAEDYQGLCERDHRFRNVVSLLLATVIRIFFVIISYGCKVPAGIFVPSMAIGASFGRSVGIIVQALHEANPQSPFFAACLPDVPCITPGTYAFLGAAAALSGIMHITVSVVVIMFELTGALTYILPTMIVVGVTKAVSELFGKGGIADRMIWFSGFPFLDNKEDHNLGVPVSHAMIKDVTSIPTNGMTLQQIEGLLAEDNYQGFPIVEDEHSKILVGYIGRTELRYAVDRAKRERTLSPQAKCTFAPPPSADVTTPGTDIITPGLARMDSFNTIGFAEPSTTASASSSNFINFSRYVDTTPVSAHPRLPLETVMELFRKIGPRVILIEYHGKLMGLVTVKDCLKYQFKVEAMEEVANNGQHSGHGQGNGAEQQGDERLWELMQRVAGWVSDKVSIASGGRIRLRDSLDLPRETLAGGAGARVGSGTNRTVRSQGGARDDQILDGTEDEDEDGVELENRQTYPHGSTSR

SEQ ID NO: 2638 - protein, 510 aa, Allium cepa
MPIPVLLLLTIFLALLLYLFFFVAKKHEGKRVPGPKGWPILGNLPQLGAKPHQSLCELSRTYGPLFGLRFGYVDVVVAASADVAEQFLRVHDVNFSNRPPNSGAEHIAYNYQDLVFAPYGPRWRMLRKLCALHLFSPKALEDLSPVRSLEVATLANTLYLRAQSDQPTVNLAQMLTTCTTNALSKAMMGRRVFVNETTDTETSKFKDMVLEIMSLAGVFNVGDFVPWLRPFDLQRVVRKMKDVHARFDSFLDKVIAEHRMVDNAHDLLSLLIRSKDDVDNDGVKLTNTDIKALLLNLFTAGTDTSSSTVEWALSEMIRHPDALKRAQRELDEVVGRDRLVSETDIRSLPYIQAIVKETFRLHPSTPLSLPRISSEACTVNGYLIPKNTTLLVNVWAISRDPGVWKEPLEFRPERFLGGGGYETVDLKGNDFELIPFGAGRRVCAGLSLGLRMVQFLTATLVHGFDWKLVDGQSAEKLDMEEAYGLPLQRAVPLMVRPVPRLDEKAYHVVV

SEQ ID NO: 2639 - protein, 466 aa, Oryza sativa (japonica cultivar-group)
MAVTAEVESSPAATGKLRYNSPLVQVSLIGLVCFCCPGMFNALTGLGGGGQLDHSTADNANTALYSCFAVFGVLGGAAHNLLGPRVTLLAGALTYPLYAASFLYYNHHPSRQAFPVTAGALLGVGAGLLWAAQGAIMTSYPPPSRRGSYISLFWCLFNLGGVLGGLLPFSLNYHRAADAASVNDATYIAFMAFMLLGAGLALLLLPASRIVRDDGSRATRMSYSSVSTEGWEILKLFANWRMLLVLPAAWASNFFYTYHSQRQWPPLHLPHQGPQQRLLLGRPDARCRGHRLLPRLRIRILQQEEEGPVRGRRRRRARHRHLAGGLANHVPYADGNWGERLIDFKDGRRYAGPFLLYFSYGLLDAMFQSLIYWIIGALANDTQILSRYVGFYKGVQSAGAAVAWQIDTHKTSLISQLIVNWALTTVSYPLLALLVFLAVKEEDSSVSSVEDGKEKDSKLSAPTSFH

SEQ ID NO: 2640 - protein, 304 aa, Saccharomyces bayanus
MSSNAQINTPLPPAPAPKKESNFMIDFLMGGVSAAVAKTAASPIERVKLLIQNQDEMLKQGTLDRKYGGILECFKRTAQQEGIISFWRGNTANVIRYFPTQALNFAFKDKIKAMFGFKKEEGYGKWFAGNLASGGAAGALSLMFVYSLDYARTRLAADSKSSKKGGARQFNGLVDVYRKTLKSDGIAGLYRGFLPSVVGIVVYRGLYFGLYDSLKPVLLTGSLEGSFLASFLLGWVVTTGASTCSYPLDTVRRRMMMTSGQAIKYDGAFDCMRKIIAAEGVSSLFKGCGANILRGVRRAGVISM

SEQ ID NO: 2641 - protein, 368 aa, Haloferax volcanii
MSVLQRDPQDRVRVLDEDGTVVGEVPDIDDETLVEMYRYMRLARHFDTRAVSLQRQGRMGTYPPLSGQEGAQIGSAIALDEQDWMVPSYREHGASLLRGLPLKQTLLYWMGHEKGNEMPEGVNLFPPAVPIASQIPHATGAAWAKKLRGEDDTAVICYFGDGATSEGDFHEGLNFAGVFDTPNVFFCNNNQWAISVPRERQTASETLAQKATAYGIDGVQVDGMDPLAVYSVTKAALDKAKNPGEGEGRPTLIEAVQYRFGAHTTADDPTVYRDDEEVEKWKAKDPIPRLEAFLRETGRIDDEGVEAIEEDVKGRVADAIEAAESDPRPDPSEMFNHAYAERTPEIQAQYEEFEALREKFGDEGFLRE

SEQ ID NO: 2642 - protein, 160 aa, Yersinia mollaretii
LMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFT

SEQ ID NO: 2643 - protein, 368 aa, Brucella melitensis 16M
MTDMQKPTRPQPKAGVLDIAAYVPGKEHVEGVAKVYKLSSNETPLGPSPHAREAYRHAGEKLELYPDGQALALRQAIAETQGLNISNILCGNGSDELLGLLCQTYLAPGDETIITEHGFAVYKIQTLAAGATPVTVKEKNERIDVDAILAGVTARTKIVFIANPANPTGTYLPFEEVRRLHAGLPQHVLLVLDAAYAEYVRRNDYEAGLELVSSNENVVMMRTFSKIHGLPGLRIGWIYAPLHIIDAMNRIRGPFNMNSAAIAAGAAAIRDRAHVEKSVAYNEKWLAWLTEEFTRLGLRVTPSVTNFLLIHFPDDAAHSADKADEWLSRRGYILRRVGGYGFPNALRMTVGPEEANRGVVAALTEFLK

SEQ ID NO: 2644 - protein, 177 aa, Lemna gibba
MASSMMASTAAAVARAGPAQTNMVPFNACRSSVPFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 2645 - protein, 399 aa, Bacillus subtilis subsp. subtilis str. 168
MEITPSDVIKTLPRQEFSLVFQKVKEMEKTGAHIINLGQGNPDLPTPPHIVEALREASLNPSFHGYGPFRGYPFLKEAIAAFYKREYGVTINPETEVALFGGGKAGLYVLTQCLLNPGDIALVPNPGYPEYLSGITMARAELYEMPLYEENGYLPDFEKIDPAVLEKAKLMFLNYPNNPTGAVADAAFYAKAAAFAKEHNIHLIHDFAYGAFEFDQKPASFLEAEDAKTVGAELYSFSKTFNMAGWRMAFAVGNEKIIQAVNEFQDHVFVGMFGGLQQAASAALSGDPEHTESLKRIYKERIDFFTALCEKELGWKMEKPKGTFYVWAEIPNTFETSHQFSDYLLEHAHVVVTPGEIFGSNGKRHVRISMVSKQEDLREFVTRIQKLNLPFGSLQETSR

SEQ ID NO: 2646 - protein, 195 aa, Zea mays
MQIKIGMDVAASEFLTKDGNYDLNFKNQPNDGAHILSAQHLGDLYRDFVKDFPIVSIEDPFDQDDWSSWASLQSSVDIQIVGDDLLVTNPKRIADAIDKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 2647 - protein, 633 aa, Clostridium tetani E88
MMLTNLLYKIPKEKHTEEELCTILKSHTEIKFVSFVGIDLSGNDTDEKIPISAFLEDISTFLKGAVQTDGSSVSFPGIATLNNAKLEMIADLDVNWFIDYNYEHIDKKTGKPIGTLRIPCYFYHDNKPIDSRYLLKSSIEFFKKELMNLLKSNNDILSYFSINYDDIEDIDVTCATELEFWVKTPNDKAEIEELSTSQVLHEQYWNRTKGAVRTSLEQSLLTLEYYGLEPEMGHKEVGGVKAKLDDSGKLTHIMEQLEIDWKYSSPLQCCDNELLARAIIKETFRSNGLDVTFLAKPVDGVAGSGKHIHVGIALKLKNKKKINLFSSNKDHFLSSIGYGSLMGMLKNYEIINPFTSSTNDAFKRLKPGFEAPTCIVTSIGRSVEVPSRNRTILVGVIRDIQKPLSTRFELRSPNPHTNTYLAIASMYMCMLDGIKYSLINNKSEDELLKELSKLPGKFYGYLDRERAYRSEEDVFDYYTDEERNSFFGKAPATVYENLCAFKNSPEKLKVLQEGNIFTDAIVNSFFLTTISRWTTEITNRLINNYFEEIKQCKMLHSLDNALDIDISRWLEINTLRHYLAKDSYTQKCLFSRIKEATNHNDYEELSKLQLELQNKISLLHDLYGTYKKNLLDL

SEQ ID NO: 2648 - protein, 479 aa, Streptomyces coelicolor A3(2)
MSTELRRLRNYIDGEFRDAADGRTTEVVNPATGEAYATAPLSGQADVDAAMAAAAAAFPAWRDLVPAERQKALLKIADAFEERAEELIAAEVENTGKPIGLTRSEEIPPMVDQIRFFAGAARMLEGRGAGEYMEGLTSFVRREPIGVCAQVAPWNYPMMMAVWKFAPALAAGNTVVLKPSDTTPASTALMADIIGSIVPKGVFNVVCGDRDTGRLMVEHETPAMASITGSVRAGMSVAESASKDLKRVHLELGGKAPVVVFEDTDIPKAVEGISEAGYFNAGQDCTAATRVLVHESVHDEFVSALAKAASEIKTGQPDDEDVMYGPLNNPNQLKQVSGFIERLPAHAKVEAGGHRVGDKGYFYAPTVVSGLKQDDEIIQREVFGPVITVQAFRDEDQAVEWANGVEYALASSVWTKDHGRAMRMSKKLDFGCVWINTHIPLVAEMPHGGFKKSGYGKDLSGYGFEDYTRIKHVMTSLDM

SEQ ID NO: 2649 - protein, 120 aa, Glycine max
TDTTVNQDDTGKIAPFTDLKSMAGFPTTKTNNDITSIASNGGRAQCMYVLPPVAKKKFETLSYLPKLDDAQLANEGEYHLRNGWIPCLEFEMEHGFVYREHNRSPGYYYGRYRTMRKQPM

SEQ ID NO: 2650 - protein, 135 aa, Haemophilus influenzae
EDLTPALEGADVVLISAGVARKPGMDRSDLFNINAGIVRGLIEKVAVTCPKACVGIITNPVNTTVAIAAEVLKKAGVYDKRKLFGVTTLDVLRSETFVAELKGLNVSRTSVPVIGGHSGVTILPLLSQVQYAKWN

SEQ ID NO: 2651 - protein, 594 aa, Brevibacterium flavum
MTGAQAIVRSLEELNADIVFGIPGGAVLPVYDPLYSSTKVRHVLVRHEQGAGHAATGYAQVTGRVGVCIATSGPGATNLVTPIADANLDSVPMVAITGQVGSGLLGTDAFQEADIRGITMPVTKHNFMVTDPNDIPQALAEAFHLAITGRPGPVLVDIPKDVQNAELDFVWPPKIDLPGYRPVSTPHARQIEQAVKLIGEAKKPVLYVGGGVIKADAHEELRAFAEYTGIPVVTTLMALGTFPESHELHMGMPGMHGTVSAVGALQRSDLLIAIGSRFDDRVTGDVDTFAPDAKIIHADIDPAEIGKIKQVEVPIVGDAREVLARLLETTKASKAETEDISEWVDYLKGLKARFPRGYDEQPGDLLAPQFVIETLSKEVGPDAIYCAGVGQHQMWAAQFVDFEKPRTWLNSGGLGTMGYAVPAALGAKAGAPDKEVWAIDGDGCFQMTNQELTTAAVEGFPIKIALINNGNLGMVRQWQTLFYEGRYSNTKLRNQGEYMPDFVALSEGLGCVAIRVTKAEEVLPAIQKAREINDRPVVIDFIVGEDAQVWPMVSAGSSNSDIQYALGLRPFFDGDESAAEDPADIHASVDSTEA

SEQ ID NO: 2652 - protein, 277 aa, Salmonella enterica
QLPSGSELSLYDIAPVTPGVAVDLSHIPTAVKIKGFSGEDVTPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKDVVECAYVEGDGQYARFFSQPLLLGKNGVEERKSIGTLSAFEQHSLDAMLDTL

SEQ ID NO: 2653 - protein, 214 aa, Bacillus methanolicus
MIKIAPSILSANFARLEEEIKDVERGGADYIHVDVMDGHFVPNITIGPLIVEAIRPVTNLPLDVHLMIENPDQYIGTFAKAGADILSVHVEACTHLHRTIQYIKSEGIKAGVVLNPHTPVSMIEHVIEDVDLVLLMTVNPGFGGQSFIHSVLPKIKQVANIVKEKNLQVEIEVDGGVNPETAKLCVEAGANVLVAGSAIYNQEDRSQAIAKIRN

SEQ ID NO: 2654 - protein, 488 aa, Streptomyces coelicolor A3(2)
MSRAARCSLGDMNESPRTPFPTPSHWIDGRAVTGSGPLIDVVNPADESVIAHLHEATADDVDMAVDAAVAAIPGWAATPPRHRADVMRRLAEGLQKRSEELAATITLEMGAPIAFSRQAQVGFPVASTLAAIAAAERFEWSERIENSLVVREPVGVVGAITPWNFPLQQLVTKVVPAMLAGNTVVLKPSELSPLSARMFAEIATEAGLPNGVFNVVQGTGPVVGEALSRHPKIDMISFTGSTRAGKSVSSAASVTVKRVALELGGKAAHIVLPEADLDSAVARGLAFAWANAGQACGAYVRMLVPEDLQTAVVDRLRTAAQEYVVGDPADEATRIGPLASETQRRRVDDYIRRGIADGATLVTGGPGRPEGFETGAYVRPTIFSDVAPESVIAQEEIFGPVLVVIPYTDDEHAVEIANGTVYGLNAAVTGDEDHAMAIAVRLRVGQVDVNGGRHNFQAPFGGYKQSGNGREMGRAGLEEFLETKAITS

SEQ ID NO: 2655 - protein, 206 aa, Limonium latifolium
RAYQYYGKNDELNKNMQYAMSGVSVPYMKALLGSGYDGFEGVKTLVDVGGSSGDCLRMIINKYKDIPKAINFDLPEVVAKAPKIPGITHVGGNMFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPVVEFQK

SEQ ID NO: 2656 - protein, 152 aa, Glycine max
RNETHEGNATRAFQFQDVFSLENEDSDDVTTLIDKKDNVFVMSNKKSKYPVLQVDLRLISDLVVVIVSAAIGGIVFSCLGQPVIVGYLLAGSLIGPGGLKFISEMVQVETVAQFGVVFLLFALGLEFSLAKLKTGGPCACLGGLLQIIISMV

SEQ ID NO: 2657 - protein, 258 aa, Chlorobium tepidum TLS
MSQNRREFLKKAGLGALAGLGAAAGLFPAFALENTDMSSFTTKPTPGKVRWGMLVDTRKCLGDCKECIVRCHHDHNVPDFGHTKNEVKWIWKSGYENAFPTASTQFQNPEVLERQVLTLCNHCTEPPCTKACPTEATFKRWDGIVSIDYHRCIGCRFCMAACPYGSRSFNWLDPRPHIKELSNTYPTRMRGVVEKCNFCSERLVKGELPACVVSCAENALTFGDLNDPNSEIRKMLATNETMQRKPELGTLPSVFYII

SEQ ID NO: 2658 - protein, 358 aa, Glycine max
MGLLDIVQPGVLNGGDVMKVYKYAQEHKFAIPAVNVTSSSTTNAALQAARDIKSPIIIQTSNGGAAFYAGKGIDNKNQNASVLGAIAAAYHVRAMAKHYGIPVILHSDHCAKKLLPWFDGMLEADEKYFAEHGVPLWSSHMLDLSEEPMEENVAISKKYFERMDQMGLILEVELGLTGGEEDGVDNSEVDNASLYSQPEDILLAYNELSSVSPYFTIAAAFGNVHGVYKPGNVKLHPEILGDFQKFVVKEKSLTTDKPVFFVFHGGSGSSAQEIETAVGNGVVKMNIDTDTQWAYWDGLRKFYEDKKDYLQGQIGNPDGADVPNKKYYDPRVWVRKSEESMIIRLQQAYRDLNCVNVL

SEQ ID NO: 2659 - protein, 477 aa, Helianthus tuberosus
HEWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSASGKEFREVITNIMVDSAKTNLVDVFPVLKRIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 2660 - protein, 687 aa, Saccharomyces cerevisiae [sequence omitted]

SEQ ID NO: 2661 - protein, 412 aa, Oryza sativa
  unsure (1)..(412): unsure at all Xaa locations
MRPALLRLAHQVSWRFVVGPGGSDGRSISCAHSPTRACTRPPTRPPTRPPTRPLPPPSPRRLHHHHLRLHSIDRSISIGGGREALEGGGTEGGMTRRCSHCSHNGHNSRTCPNRGVKIFGVRLTDGSIRKSASMGNLSLLSSAAGSTSGGASPADGPDAAPTAADGXYASDDFVQGSSSATRDRKKGVPWTEEEHRRFLLGLQKLGKGDWRGISRNFVVSRTPTQVASHAQKYFIRQSNMTRRKRRSSLFDMVPDESMDLPPLPGGQEPETQVLNQPALPPPREEEEVDSMESDTSAVAESSSASAIMPDNLQSTYPVIVPAYFSPFLQFSVPFWQNQKDEDGPVQETHEIVKPVPVHSKSPINVDELVGMSKLSIGESNQETVSTSLSLNLVGGQNRQSAFHANPPTRAQA

SEQ ID NO: 2662 - protein, 322 aa, Streptomyces avermitilis MA-4680
MPKTQSGTSNRTRSTTAGGSARGKWNAGDIPDQTGRTAVVTGANSGLGIATVEALARAGAHVVLAVRDLERGEAAAAGVHGSVEVRRLDLADLASVREFAAGWQGDLHLLINNAGVMNIPEASTKDGFEMQFGTNHLGHFALTNLLLPRIKDRVVTVSSGAHRMPGSPYIHFDNLNLTGEYAPLTAYSQSKLANLLFTLELQRRLAEAASPVRALAAHPGWAATNLQSHDGSALRRALMRVGNRFIAQDNRAGALPTLYAAVQDLPGASYVGPDGFGEMRGGPTLVGRSAAAGDPVSARRLWTASEDLTGVTFPRLTAAVSA

SEQ ID NO: 2663 - protein, 338 aa, Ralstonia metallidurans
MTRISLTRYLVEEQRKHNTIEPELRLLIEVVARACKAISNAVSKGALAGVLGSAGTGNVQGETQQKLDVIANEVLLDANEWGGHLAAMASEEMDSFYEIPNRYPKGEYLLLFDPLDGSSNIDVNVSIGTIFSVLHMHKPGQTVTEHDFMQPGTQQVAAGYAVYGPQTTLVLTVGNGVHMFTLDREAGSFVLTQSDVMIPEDTKEFAINMSNMRHWAPPVRRYIDECLAGDEGPRGKNFNMRWIASMVADVHRILTRGGVFMYPWDKREPEKPGKLRLMYEANPMAFLVEQAGGAATNGQQRILDVEPTKLHQRVSVILGSKNEVERVTRYHQEDAAKA

SEQ ID NO: 2664 - protein, 337 aa, Zea mays
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 2665 - protein, 355 aa, Clostridium thermocellum ATCC 27405
MSKYWSNIVKKISPYVPGEQPKDKKYIKLNTNENPYPPSEKVLKAISAAVNESLRLYPDPACESLRNTLAKYYGIKASEVFVGNGSDELLAFSFMAFFNPGDTIIFPDITYSFYEVYSSMFSVNYRLIPLDDEFNVPVEEFFTENDGIILANPNAPTGKALPLQSIRKILEKNDDKVVIIDEAYVDFGARSSVPLIKEFENLLVIQTLSKSRALAGLRVGFALGSEQLIEGLDRVKNSINSYTLDRLALIGAEEAIKDHEYFCEIRDKIINTREWVSKKLSSMGFKVIESKANFIFISHPKINGRLLFEKYKENNILVRHFNSPRIDNFLRVSIGSDEEMNIFCEKTKEIIESLN

SEQ ID NO: 2666 - protein, 473 aa, Nostoc punctiforme
MYEKITPPAAGAKIAFKNGEPIVPDNPIIPFIRGDGTGIDIWPATQKVLDAAVAKAYKGQRQISWFKVYAGDEACDLYGTYQYLPQDTLTAIEEYGVAIKGPLTTPVGGGIRSLNVALRQIFDLYACVRPCRYYAGTPSPHKNPEKLDVIVYRENTEDIYLGIEWRQGSEIGDRLIKILNEELIPATPEHGKKRIPLDSGIGIKPISKTGSQRLVRRAIKHALLLPKNKQQVTLVHKGNIMKYTEGAFRDWGYELATSEFRQETVTEQESWILSNKEKNPNISLEENARQIEPGFDNLTPDKKAQVVKEVETVLNTIWATHGDGKWKEKVLVNDRIADSIFQQIQTRPDEYSILATMNLNGDYLSDAAAAIVGGLGMGPGANIGDSSAIFEATHGTAPKHAGLDRINPGSVILSGVMMLEFLGWQEAADLIKKGLSDAIANSQVTYDLARLLEPPVEPLKCSEFADAIIQHFG

SEQ ID NO: 2667 - protein, 164 aa, Cleisostoma racemiferum
IENKINRQVTFAKRRNGLLKKAYELSVLCDAEVALIIFSNRGKLYEFCSSTSMLKTLEKYQKCNFGSPESTIISRETQSSQQEYLKLKSRVEALQRSQRNLLGEDLGPLGSKELEQLERQLDSSLKQIRSTRTQFMLDQLADLQRREHMLCEANKALKRRFEES

SEQ ID NO: 2668 - protein, 293 aa, Zea mays
MGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPICYEYLFDSLQGTRVLNCGHTMHLTCFEEMVAHNKYTCPICSKTALDLTHHWEMLDQEIEATIMPLVYRYKIWVLCNDCNKVSEVNFHVIGHKCSHCRSYNTRTTSRPADLSGSSSPSTDSSDNNI

SEQ ID NO: 2669 - protein, 360 aa, GIBBERELLA ZEAE PH-1
MGVQEVLSRKSGVIVGDDVLRLFEYAREHKFAIPAINVTSSSTVVAALEAARDAKAPVILQFSQGGAAYFAGKGVSNGDQAASIAGSVAAAHYVRSLAPTYGIPVVLHTDHCAKKLLPWLDGMLDADEAYFKEKGEPLFSSHMIDLSEEPVEWNIETTAKYLKRAAPMKQWLEMEIGITGGEEDGVNNEDVDNNSLYTQPEDILNIYNTLSPISPYFSIAAGFGNVHGVYKPGNVKLHPELLGKHQAHVKEALKSDNDKPVFFVFHGGSGSSKKEYLDAIGFGVVKVNVDTDMQFAYCSGIRDYMVNKREYVNTTVGNPDGEDKPNKKYFDPRVWVREGEKTMSKRVAEALEDFNTANQL

SEQ ID NO: 2670 - protein, 156 aa, Zea mays
  unsure (1)..(156): unsure at all Xaa locations
GLVGWPARKKWKDIKYLESAARXGDRTIPVQVGKNYACTELKQELITFSQFLERMWSSDSANLAYIAQHQLFDQIKELHEDIAVPEYCSAGGGKLQSLNAWFGPHGTITPLHHDPHHNLFGQVLGRKXYVRLYPASTSVGLYPNTESMLSNTSEVS

SEQ ID NO: 2671 - protein, 393 aa, Saccharomyces cerevisiae
MLQRHSLKLGKFSIRTLATGAPLDASKLKITRNPNPSKPRPNEELVFGQTFTDHMLTIPWSAKEGWGTPHIKPYGNLSLDPSACVFHYAFELFEGLKAYRTPQNTITMFRPDKNMARMNKSAARICLPTFESEELIKLTGKLIEQDKHLVPQGNGYSLYIRPTMIGTSKGLGVGTPSEALLYVITSPVGPYYKTGFKAVRLEATDYATRAWPGGVGDKKLGANYAPCILPQLQAAKRGYQQNLWLFGPEKNITEVGTMNVFFVFLNKVTGKKELVTAPLDGTILEGVTRDSVLTLARDKLDPQEWDINERYYTITEVATRAKQGELLEAFGSGTAAVVSPIKEIGWNNEDIHVPLLPGEQCGALTKQVAQWIADIQYGRVNYGNWSKTVADLN

SEQ ID NO: 2672 - protein, 595 aa, GIBBERELLA ZEAE PH-1
MAPHDVERGSISKMKEESLAPGSSFSMREPEYADILPPSYWGRFVDGFRRDQRSSLFTNDPLGQQEGLGRVHDGAHYYDLQSAMLETANSGLARELKGRHLQMIAIGGSIGRALADGGPASILLAFTIVGAMLFCTCQALGELAVIFPIAGSFSSWATRFIDPSWGFAMGWNYAMQWLIVLPLEIIAASLTLSYWDESLTRAIFVSAFLVLIIVINMFGVKGYGEAEFIFSIIKVIAVIGFILLGIVLNCGGTPDSGYIGGRFWHEPGAFNNGFKGMCNVFVTAAFSFAGTELIGLAAAETANPRKSLPTALKQVFWRITLFYIVALTLVGLLVPYNDPRLTKGTSDADAAASPFVIAIEEAGIQVLPSVMNAVILCAVLSVGNSAVFGSSRTLAALANLRQAPKILGYVDRKGRPLVAIAIASAFGLIAFLADLPQQGAVLDWLMSISGLSTIITWGSICVCHIRFRRAWAARGRSVSELPFQSQVGVVGSWIGITLNVLVLIAQFWVGAFPIGWQDLTSSQVAQNFFHKWVGAPCVLAFYIFHKLYFRTTFVRTRDMDVDTGRRDFNVPILVAQEKQERARWPRWKRYYKFMC

SEQ ID NO: 2673 - protein, 530 aa, Blumeria graminis
MGISESFMFPYLQPLLQLGFGIALASGILSLLLLLTFLNVLKQLLFKNPNEPPIVFHWIPIIGSTISYGMNPYKFFHESQAKYGNIFTFILLGKKTTVYLGRQGNNFILNGKLRDVNAEEIYTVLTTPVFGTDVVYDCPNSKLMEQKKFMKAALTTEAFRSYVPIIQNEVKSFIEKCDDFRKSKGIINIDAVMAEITIYTASHTLQGKEVRDRFDSSLAVLYHDLDMGFTPINFMLHWAPLPHNRARDHAQRTVAKIYMEIINSRRTQKETDDSNLDIMWQLMRSSYKDGTPVPDKEIAHMMIALLMAGQHSSSSSSTWIMLWLAARPDITEELYQEQLELLGSELPPLKYEDLSKLSLHQNVLKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 2674 - protein, 471 aa, Glycine max
TLLPLIHHPHPKRPELHHLLLLPFPHSSTPHKPPSFQRSKTLLRASTVESPTPKRRGRKKKPETQTPSNNTPPPQNADNKTEEDELHDYDDGVDFPYSDPPLICCFGLARKEFVPAVRVQDYPMHPDIYSEWKMLQWKPPEFARAPGGPPSNVAVAHARLGGRAAFLGKVGDDEFGEEMVLMMNEERVQTRGVKIDSKCRTGCSYMKVKFEEEGRMKMETVREAAEDSLLANELNLAVLKEARIFHFNSEVLTCPSMESTLFRAIKWTKKFDGLVFFDLNLPLPLWRSHDETREIIKKAWNEADIIEVSRSELEFLLDEEYYERKRNYRPQYFAENYEQTKNRQEYYHYTAEEVSPLWHDRLKFLFVTDGTLGIHYYTPSFDGSVMGTEDVLITPYTCDRTGSGDAVVAAILRKLTTCPEMFENQDVLERQLRFAVAAGIISQWTIGAVRGFPTESATQNLKEQVYVPSLW

SEQ ID NO: 2675 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGH

SEQ ID NO: 2676 - protein, 246 aa, Malus x domestica
MGRGRVELKRIENKINRQVTFAKRRNGLLKKAYELSVLCDAEVALIIFSNRGKLYEFCSSSSMLKTLDRYQKCSYGAVDQVNRPAKELESSYREYMKLKGRYESLQRTQRNLLGEDLGPLNTKELEQLERQLEGSLKQVRSTKTQYMLDQLSDLQNKEQLLIEANRDLTMKLDEISSRNQLRQSWEGGDQGMAYATQHHHAQSQGFFQPLDCNPTLQMGYSAVGSEQMSATTNAQQVNCFIPGWML

SEQ ID NO: 2677 - protein, 307 aa, Pseudomonas syringae pv. syringae B728a
MSLPRVALIGECMIELQQHADGSLRQSFGGDTLNTAVYLSRLLGERAKVDYVTALGDDSFSDAMCRIWADEGIGLGKVQRLPGRLPGLYCIQTDANGERRFLYWRNEAAVRDCFMTPAAEPILAALASYDVLYFSGITLAVLGEQGRAKLLEALARARQRGVRVAFDNNYRPRLWASVEQAREAYLACLQHVDLALLTEDDEQALYGYADSEQLLAAYRGRGIGEIVVKRGAQSCLVEAGGERFDIAAQKVERVVDTTAAGDSFSAGYLAARLTGQHPLQAAEAGHRLASIVIQHPGALVPKSVMPV

SEQ ID NO: 2678 - protein, 415 aa, Magnaporthe grisea
MSDLQGRKIFKVFNQDFIVDERYTVTKELGQGAYGIVCAAVNNQTSEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMAKKPFPTLFPNANPDALDLLDRMLAFDPSSRISVEQALEHPYLHIWHDASDEPDCPTTFNFDFEVVEDVGEMRKMILDEVYRFRQLVRTAPGAGGHGAPHAPQVPIPAGAGQGQWKAEDPRPQEYVGQMNDLEAELAGGLDQRR

SEQ ID NO: 2679 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKIDPGEAMDINLFKLTLDEIREKGIKQMPHTLRRSLEEMLADKQYLKEGQ

SEQ ID NO: 2680 - protein, 190 aa, Glycine max
MESATVSSSESETALPLPLASESQQPYVSELLSFTLDRLHKEPELLRVDADRIRRQMQEVAVGNYRSFIAAADALIAIRQEVSSIDNHLESLINEIPKLTSGCTEFIESAEQILEKRKMNQTMLTNHSTLLDLLEIPQLMDTCVRNGNYDEALDLEAFVGKLSTMHPKLPVIQALAADVRLTTQSLLSQL

SEQ ID NO: 2681 - protein, 437 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKACKRGGKETKQIEEDGLVDVDGEKSKLAEDLSKIRMVESLDASASKQKEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 2682 - protein, 108 aa, Oryza sativa (japonica cultivar-group)
MEGGRGVTRVLLVDDSPVDRRVVQLLLSSSACAGSFHVIAVDSAKKAMEFLGLKEEGKEQAIDMVLTDYCMPEMTGYELLKAIKALSPLKPIPVIVMSSENEPQRISR

SEQ ID NO: 2683 - protein, 274 aa, Zea mays
MATPSSSLCSSFASLRTASIGHPRGIASSTPRKAFQVRASARVDKFSKSDIIVSPSILSANFAKLGDQVKAVEVAGCDWIHVDVMDGRFVPNITIGPFVVDALRPVTDLPLDVHLMIVEPEQRVPDFIKAGADIVSVHCEQTSTIHLHRTVNQIKSLGAKAGVVLNPATPLTAIDYILDVVDLVLIMSVNPGFGGQSFIESQVRKIAELRRLCAEKGVNPWIEVDGGVGPKNAYKVIEAGANAIVAGSAVFGAPDYAEAIKGIKTSQRPAAVHA

SEQ ID NO: 2684 - protein, 476 aa, Pseudomonas syringae pv. tomato str. DC3000
MYPDVQLYIDGQWRASRDGRSIPVIDPATGQSLGSVAHAGIADLDEALSAAERGFATWRATSAYDRYKLMQKAADLVRERADSIARIMTQEQGKPLAEARMETLSAADVIDWLAEEGRRSYGRIVPSRGVSIEQKVIKEPVGPVAAFTPWNFPINQVVRKLSSALAAGCSIIVKAPEETPGSPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLQAFTEKFVGLTREIKVGNGLESGTTMGPVANDRRIPALVDLIEDAVSAGATVSAGGKAVEGQGYFFEPTVLSGLTPAMRIMNEEPFGPVALLVPFDTVEEAIVESNRVPFGLASYAFTTSMKTAQALSTYIEAGMLSINHQGIGLPEVPFGGIKDSGYGSEGGTEAIEAYLNTKLVTQYS

SEQ ID NO: 2685 - protein, 522 aa, Candida tropicalis
MTVHDIIATYFTKWYVIVPLALIAYRVLDYFYGRYLMYKLGAKPFFQKQTDGCFGFKAPLELLKKKSDGTLIDFTLQRIHDLDRPDIPTFTFPVFSINLVNTLEPENIKAILATQFNDFSLGTRHSHFAPLLGDGIFTLDGAGWKHSRSMLRPQFAREQISHVKLLEPHVQVFFKHVRKAQGKTFDIQELFFRLTVDSATEFLFGESVESLRDESIGMSINALDFDGKAGFADAFNYSQNYLASRAVMQQLYWVLNGKKFKECNAKVHKFADYYVNKALDLTPEQLEKQDGYVFLYELVKQTRDKQVLRDQLLNIMVAGRDTTAGLLSFVFFELARNPEVTNKLREEIEDKFGLGENASVEDISFESLKSCEYLKAVLNETLRLYPSVPQNFRVATKNTTLPRGGGKDGLSPVLVRKGQTVIYGVYAAHRNPAVYGKDALEFRPERWFEPETKKLGWAFLPFNGGPRICLGQQFALTEASYVTVRLLQEFAHLSMDPDTEYPPKKMSHLTMSLFDGANIEMY

SEQ ID NO: 2686 - protein, 782 aa, Zea mays
MDAEAGVAGADQLPRRQYYMNLLLLAYQSFGVVYGDLSTSPLYVYKSTFSGKLNQYQDEETVFGVLSLIFWTFTLIPLLKYVTIVLSADDNGEGGPFALYSLLCRHTKLSLLPNQQAADEELSSYYRNGFAPSNGSSPWLRRFLEKHKKMRAVLLLIVLCGASMVIGDGVLTPAISVLSSMSGLHVRATGLKHSSVVLLSCIVLVGLFALQHRGTQKVAFMFAPIVIIWLLSIGGIGLYNILHWNPNVYQALSPYYMVKFFRKTGKDGWIALGGILLSMTGSEAMFADLGHFTSASVRVAFITVIYPCLMLQYMGHAAFLSKNTFHMPTGFYDTIPEPVFWPVFVVATLAAVVGSQAVISATFSIVKQCHALGCFPRVKVVHTSRWIYGQIYIPEINWILMVLCVAVTIAFRDTTLIGNAYGIACMTVMLVTTFLMALIVIFVWQRNIIFSLVFLVFFGSIEAVYLSSSLMKVPQGGWVPLVLAFIFMSVMYIWHYGSRRKYQFDLQNKVSMRSILSLGPSLGIVRVPGVGLIYTELVTGVPSIFSHFVTNLPAFHEVLVFLCVKSVPVPYVSPDERYLVGRIGPKEYRMYRCIVRYGYKDVQRDDDNFENMLVMNIAKFIMMEAEDASSASYDVSNEGRMAVITTTDASGSPLAMRDFDGLADSMTMRSSKSETLRSLQSSYEQESPSVSRRRRVRFEVPEEDGMGRQVKEELMALVEAKHAGVAYIMGHSYIKARRSSSFLKKFAIDVGYSFLRKNCRGPSVTLHIPHISLIEVGMIYYV

SEQ ID NO: 2687 - protein, 319 aa, Solanum tuberosum
MAVNGSALSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEAEARKAIKVSDVELEFLTGSDKIDDESAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTESEALTLLKGGA

SEQ ID NO: 2688 - protein, 540 aa, Lupinus albus
MAREHIHVLNALDVAKTQWYHSLQIIIAGMGFFTDAYDLFCISLVTKLLGRIYYHVDGAGKPGTLPPNVSAAVNGVAFCGTLSGQLFFGWLGDKMGRKKVYGMTLMIMVICSIGSGLSFGHSPNSVLATLCFFRFWLGFGIGGDYPLSATIMSEYSNKKTRGSFIAAVFAMQGFGILGGGIFAIIISAAFKARFDAPAYEVDPVGSTVPQADYIWRIIVMVGALPAALTYYWRMKMPETARYTALVAKNAQQAAADMSKVLQVEIQSETNKEEAQGKPSFGLFSKEFLRRHGLHLLGTASTWFLLDIAFYSQNLFQKDIFSAIGWIPPAKTMNALDEVYRIARAQTLIALCSTVPGYWFTVALIDRIGRFAIQLMGFFFMTVFMFALAIPYDHWTHKDNRIGFVVIYSLTFFFANFGPNATTFVVPAEIFPARFRSTCHGISSASGKLGAIVGAFGFLYLAQNKDKSKTDAGYPAGIGVKNSLIVLGVVNILGFCFTFLVPEPNGKSLEEMSGENEEEEPTKEGSYNNNNNNNNRTVPYV

SEQ ID NO: 2689 - protein, 348 aa, Ipomoea alba
ETLAGSGIERIPKEYIRPEEERRSIGDIFEEEKMGGGPQVPTVDLKGINSDDLEVREKCREELRKAAVDWGVMHLVNHGIPEELTGRVKAAGEGFFAQPIEEKEKYANDQAAGNVQGYGSKLANNASGQLEWEDYFFHCIFPQDKTDLSIWPKTPSDYIAATREYAKQLRALATKVLAVLSLGLGLDEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSEAEPPRFPPRTFAQHIKHKLFRQSDQGADTPKT

SEQ ID NO: 2690 - protein, 1182 aa, Cryptococcus neoformans var. grubii
MFVTRPPSSSVDHRGSLLDGHTNHTNTPGSSRDDVPSSDSTSTAFHKFKNSSRFSPHYLNIPPGLAFKSYLEKWGPEQVIGFLAIHGCEHHSGIFIKNSIDGKLLLDLDMGILTSLGITKVGERIRLMAGIKCLRQRVAHEAEKHNIPSAHLCNGSLEMDRVKVIIHPKLSASLYVHRHGPFDSGPITARRCPLTPSSSADPEGDPSPMQRSQEVMKHSFITRSSRRQVIPPLPPGQIHNHGIDNSPMPSLRHIPLRSGVSYSDIDVKGMPPLVTQSTNSVFNHTFAVTGSHDTTSCLGGHLRRPDYFRSTNDTFQTCTKRGDNTISELPQRNQESSPSMWKQSGVICEDKAMRNGSLFAPTSHKPFAISITGDNVMEYPHNLPIKNGLPLRSFQSPDKSADDDRLNINPSAPSLDDLRRQLVKFVNAEDGTTRTVNVMKTTSGVEVLERALRKFGKTGTGRALLLDDESHNGGKHEGPLCIDGWGVFAENLQGEEMGPMSEEDLLDICASLRNGAAMQRDALILRQTSKSQKRKDMRFYLGSMPVLPTPVNLPISFSSSHSGQFEQNSALQYTAQHQPLRSKNRSRASMMSIMSGLGVSHPDIKQPTHDSLQSPASVTMPSSKKKSMYNFFGHRPPSELISSHLTDYFPSAKKRDVAKARGSMLRLNIAHSAERNPRSVENLGMIEADDVPFSSTEQSLTEQRDHYFDSSTCQPADTSSPGHVDHNITDPAGNSEGNYRLPYDQKVLPTPITQELHSANSVNPILRTYPPNLPSTYLSARLTDLHRDSFLSQLQPLQHSSSLSSAQPFSSHRRTVDEITAEMQHRQTSLSCDRPTSTIDSDISGPPCNSEISLDHTSEASGISESSSEYCDDHSSVSSEDSEDNSAAHTRAFTTKRNIKWIKGALIGAGSFGSVFLGMDAQSGLLMAVKQVELPRGIAKMEARRRDMLSALEREIELLKDLQHDNIVQYLDSSMDANHLNIFLEYVPGGSVAALLNNYGAFEEALAGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSRAFALDYRMRPSAASLLKHAFMVHDGNGGNDEPIQNTYA

SEQ ID NO: 2691 - protein, 229 aa, Triticum aestivum
  unsure (1)..(229): unsure at all Xaa locations
IYYYFERNPTQAWMSLGGXLLCATGSDAMFADLCXFSWFRSVQLTFVCLVLPCLLLGYLGQAAFLMENLTPNEPGFSSXLCPGQVFWPVVFIATLAALIASRTMTTAIFSIIKQATALGCFPRLKIIHTSRKFMGQIYIPVMNWXLLSFLSRVCYDIWGALMRLGNAYGIAELGGMMMTTILVTXIMLLIWQVNTLSFXAFSTSSLGPGSIFFPPGGNVPALSLGAYTK

SEQ ID NO: 2692 - protein, 396 aa, Pichia stipitis
MLRTAAVRPLKGGVVIARRAMASSSDLVSIELPESSFEGYNLEIPELTFETEKETLLKMYKGMIIIGGMEMASDALYKAKKIRGFCHLSVGQEAIAVGIENAITPEDTVITSYRCHGFAFMRGASVKEVLGELMGKRSGVSYGKGGSMHMFAPGFYGGNGIVGAQVPLGAGLAFSHKYRGQKAAAFTLYGDGASNQGQVFEAYNMAKLWNLPCIFACENNKYGMGTAAARSSAITEYYKRGQYIPGLKINGMDVLATYQASKFAKDWAAQGNGPLVLEYETYRYGGHSMSDPGTTYRTREEVQHMRSRNDPIAGLKATLLDKGIATEEEIKSYDKAARKYVDEQVAAAEADAPPEAKMDLLFEDVYVPGSEIPVLRGRISDDSWDFKNKTFLNKVY

SEQ ID NO: 2693 - protein, 366 aa, Triticum aestivum
  unsure (1)..(366): unsure at all Xaa locations
MRRWFCCSQFHASYREHEHEFPSSPDEKEGNGFDSKSDPTKAPPPIEIPELSLDELKEKTDNFGSKALMRSXGRYGIEVYYCXLDSGKHLAVKKLDTSADPEPDNEFLTQLSIVSRLKHENFVEMLGYCVEGNQRLVAYEFATMGSLHDILHGRKGVPGAQPGPALDWMQRVKIAIDAAKGLAYLHEKVQPSIVHRDIRSSNVLLFEDYRAKVADFNLSNQSPDMAARLHSTRVLGTFGYHAPEYAMTGQLTQKSDVYSFGVVLLELLTGRKPVDHTMPRGQQSLVTWATPRLTEDTVKQCIDPRLKGECPPKGVAKLAAVAALCVQYESEFRPSMSIVVKALSPLLQQKPQAPPAAAPNTTTSEA

SEQ ID NO: 2694 - protein, 173 aa, Zea mays
LQIVYGVFGYMQVLSACFMSFAHGGNDVSNAIGPLAAALSILQGVASSAEIVIPTEVLAWGGFGIVAGLTMWGYRVIATIGKKITELTPTRGFAAEFAAASVVLFASKLGLPISATHTLVGAVMGVGFARGLNRVRAETVREIVASWLVTIPVGAVLSIFYTLILTKILAYFM

SEQ ID NO: 2695 - protein, 341 aa, GIBBERELLA ZEAE PH-1
MSTSSGVPESWISSFCSLLGHEYFAEVSEEFIEDDFNLTGLQTQVAMYKEALEMILDVEPEDDEDEEEEEEEEDENDSDPERLTRASSERRHHRMASDLSVIESSAEMLYGLIHQRFICSRAGIQQMSEKYELGHFGCCPRTNCDQARTLPVGLSDIPGEDTVKLFCPSCLDVYVPPNSRFQTVDGAFFGRTFGSLFLLTFPEYDLTKRGIEVLSSSGPRVNEGDGLMNGMYAKNIGPGLGRERIYEPRIYGFRVSERARSGPRMQWLRERPTDINELDEARLYAEQNPDSEDDDESGGQVGMNGRVMVRRRPPGNARLRQRQTQNGSPMAMSTNGAESEL

SEQ ID NO: 2696 - protein, 313 aa, Prochlorococcus marinus subsp. pastoris str. CCMP1378
MNSILNWFLMILPFALWGTSMAAMTPLVSSAGPEFVASLRLLPAGILVLITTYLLKRDLKIYKCDLKWFLVFTIVDATFFQLFLTYGISKTGAGLGSVLIDSQPLIVALLARAIFGNLINPIGWLGLLFGLGGIIFLGVPKELLESWWLMSDKSIIDIAFNVGELWMLGASLAMALGTILIRFTCTKSDPVAVTGWHMVLGSVPLIIKHCLQTNFQLIPNWSIFDWGLMSFASIFGGALAYGLFFYFANNKEITGFSTLAFLTPIFALLSGGVYLNERLTIVQWIGVVFVLISVFFVSQRKSIWEFSNTKTNI

SEQ ID NO: 2697 - protein, 146 aa, Eremothecium gossypii
MSRQLIRTLRVGSMCASKWNPQLSAEQLRVLRDRGTERPHTGTYLYNKSTGIYHCANCDVPLYSSSAKFDSGCGWPAFYQEVRPGALRYIRDSSLGMERVEIRCSACDGHLGHVFEGEGFAQRLGLPKDVRHCVNSCSLRFRGEGN

SEQ ID NO: 2698 - protein, 334 aa, Neisseria meningitidis Z2491
MSIKVAINGFGRIGRLALRQIEKAHGIEVVAVNDLTPAEMLLHLFKYDSTQGRFQGTAELKDDAIVVNGKEIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 2699 - protein, 428 aa, Methanosarcina mazei Goe1
MSYIGLQQDSGEYKIQKIHAREILDSRGNPTVEVDVFTPKGFGRASVPSGASTGTNEALELRDADPNRYGGKGVLTAVKNVNTIIQKELLGLDVRNQREIDELMIELDETENKSNLGANAILGVSMAVAKAAADSLNIPLYRYFGGSNAFTLPVPTMNVLNGGKHAGNELAIQEFMIQPKGAETFYEALQIGAEIYQTLGKFLENKYGRSSTNVGYEGGYAPKMGESTEALDALVHAIEEAGYTESEVTIGLDAAATEFYEEEFYNIDGKKLAAPELLDYYVELVNSYPILSIEDPFYEEAFEDFEALTNELWDTIIVGDDLFVTNIERLSKGVDMGAANALLLKVNQIGSISEAFDAASMASRNGYTVIVSHRSAETEDTTISDLAVAIGAEMIKTGAPARGERTAKYNQLLRIEEDLGEVAHYVQL

SEQ ID NO: 2700 - protein, 310 aa, Zea mays
MGSEQKKPAYIKYLFGGLSGMGATLFVQPLDLVKNRMQLSGAGGGKKEYKNTFDALSKILRTEGITGIYKGLGAGFLRQATYTTTRLGVYTGLNDSYKIKFGGSPNLLASMLMGVIAGASGAFVGTPAEVALIRMTADGRLPLNERRNYASVFNALTRITREEGVLTLWRGCIPTMGRAMVVNAAQLASYSQAKQYLIRSGYFTEGIKLHFVASMMSGFITTVASMPVDIAKTRLQNMKVSADGKAEYRGTVDVLSRVIRQEGLFALWKGFTPYFCRLGPHTVLTFIFLEQMNSMYNKFVLGDSGSGSGL

SEQ ID NO: 2701 - protein, 294 aa, Brassica napus
MDQYEKVEKIGEGTYGVVYKARDKVTNETIALKKIRLEQEDEGVPSTAIREISLLKEMQHSNIVKLQDVVHSEKRLYLVFEYLDLDLKKHMDSSPDFSKDLHMIKRYVYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPTEDTWPGVTSLPDYKSAFPKWKPTDLESFVPNLDPNGIDLLSKMLLMDPTKRINARAALEHDYFKDIGVMP

SEQ ID NO: 2702 - protein, 307 aa, Nostoc sp. PCC 7120
MKGFDRLDTVDLSNWVTLAKTKTNCGRVVERIPKLAVADTAWFAVHICCQSGKFYSEGDTQCVFPLMSVIKPFTFLYLLEHMGVEKVLSWVGTKPSDAPFNSLEQLVADGGYPRNPMINSGAITLADKLPGEDADHRTRFFCKWLNQLAGSQIQLDESMLASVRLSRSPANQAIANYLAEKGYLEDLDVALDTYEQICCLSGTVEDLALLGKLLALESSSISPQHQQLVNSVMLTCGLYEASAEYAVTIGLPMKSGIGGGLLAIVPTAGAIACYSPALDRIGNPVGAIAFVEVLSRSLGLCGRFSHL

SEQ ID NO: 2703 - protein, 806 aa, Caulobacter crescentus CB15
MNTTLTRRLFGASLAALSAAALPSLAQAAGQAPKTSGGKPLYKDPTQPVDARIQDLLSRMTLEEKAAQLIGIWLTKAKIQTPEGEFSAEQASKNFPHGLGQISRPSDRKGAKPVTVIGAAAGADDGAINRNAAETARYTNAAQKWAIEKTRLGIPLLMHDEALHGYVARDATSFPQSIALASTFDTELTEKIFAVAAREMRARGSNLALAPVVDVARDPRWGRIEETYGEDPHLCAEIGLASIRGFQGATLPLAKDKVFVTLKHMTGHGQPENGTNVGPAQIAERTLRENFFPPFERAVTELPVRAVMPSYNEIDGVPSHANRWLLTKILREEWGYKGSIQSDYFAIKEMISRHKLTSDLGETAVMAMRAGVDVELPDGEAYALIPELVKAGRIPQFEVDAAVARVLEMKFQAGLFENPYCDEKTADAKTATPDAVALAREAARKSVVLLKNDKGLLPLDGKKFKRMALLGTHAKDTPIGGYSDIPRHVVSIHEGLTAEAKAQGFALDYAEAVRITEQRIWAQDAVNFTDPAVNAKLIAEAVEVAKKADIVVMVLGDNEQTSREAWADHHLGDRDSLDLMGQQNDLARAIFDLGKPTVVFLLNGRPLSINLLKERADAIIEGWYLGQETGHAAADVLFGRANPGGKLPVSIARDVGQLPVYYNRKPTARRGYLDGETTPLYPFGFGLSYTTFDVSAPRLAKAKIGQGETVKVEVDVTNTGKVAGDEVVQLYVHDEAASVTRPVLELKHFKRVTLAPGAKTTVTFEIKPSDLWMWNLDMKRVVEPGDFSILVGPNSVDLKKTTLTVA

SEQ ID NO: 2704 - protein, 454 aa, Caulacanthus ustulatus
IKDTDVLALFRVTPQPGVDPVEASAAVAGESSTATWTVVWTDLLTACDLYRAKAYKVDEVPNTSDQYFAFIAYDIDLFEEGSIANLTASIIGNVFGFKAVKALRLEDMRIPVAYLKTFQGPATGVISERERMDKFGRPFLGATVKPKLGLSGKNYGRVVYEGLRGGLDFLKDDENINSQPFMRWKERFLYSMEGVNRSVAATGEVKGHYLNVTAATMEDMYERAEFAKQLGSIIIMIDLVIGYTAIQSMAIWSRKNDMILHLHRAGNSTYSRQKIHGMNFRVICKWMRMAGVDHIHAGTVVGKLEGDPLMIRGFYNTLLLPYLDVNLTQGIFFEQDWASLRKVTPVASGGIHCGQMHQLLDYLGVDVVLQFGGGTIGHPDGIQAGATANRVALESMVIARNEGRDYVTEGPQILQDAAKTCGPLQTALDLWKDITFNYTSTDTADFVETPTASV

SEQ ID NO: 2705 - protein, 194 aa, Triticum aestivum
SLLLLDQDGHFVPNLTIGAPVIESLRKHTKAYLDCHLMVTNPSDYVEAFGKAGASGFTFHIEVARDNWKELIQSIKAKGMRPGVSLKPGTPVEDVFPLVEAETPVELVLVMTVEPGFGGQKFMPEMMDKVRTLRKKYQSLDIEVDGGLGPSTIDAAASAGANCIVAGSSVFGAPDPGQVISALRKSVEASQIKS

SEQ ID NO: 2706 - protein, 144 aa, Glycine max
PVVGSLIPAKKKDYRVTNRLQEGKRPLYAIVFNVLDSRYLDVFATVGGNRVTVYQCLKEGVIAVLQSYVDEDIFVGHGDSINEVKAQILNPSLVDESIRLWNAHTGIYILIFAGARGHRNEVLSVSFGHVEKSSTWTYPSSKFP

SEQ ID NO: 2707 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAALKGKLPTEVEVPVIGGHSGVTILPLLSQIPGVSFTEQEAADLTKRIQNAGTEVVEAKAGGGSATLSMGQAAARFGLSLVRALQGEKGVVECAYVEGDGQYARFFSQPLLLGKNGVEERKSIGTLSAFEQRSLEG

SEQ ID NO: 2708 - protein, 995 aa, Oryza sativa
MAFSSEAWKSSATAGHGDGDGDGDRTPPPTPPLPTPLLPPTLAPLQRSLVFGRVEGEAMSSEARESSATAVDRTPPPTPPSPPPPPPPPPTNGTLTPPPSSAPSGGRATSSEARESPHATSVDDGGRAPPPPPLPRPTSARATPATTPSADGSSSSSSSTSGGDEDKDSFMHLVSRYLIREEKEMIDWNKVERPTPEMVVPYDSLVQAPRGTHVVLDASFDFSLMIRCCCAGFVYIPEIRNLLNKLAVLKLNGGLGTTMECVAPNFTHLQFLNKKYGCSVPILLMNSFNTSLVNKHLDYDLLFLKIVEKYTNIEIHTFNQRVQRTWALQSILVSKYEYNILINVSWLASEIESLTSTEILNHLIHNKNEYCMELLEIFQVPYENVEFEPLLTAFGYRRVNLKAIKRLVKAEALKMEIIPNLKEVDGVKVLQLEKEAGSAIQCFEKAIGVTVPRSRFLAVKNTSDLFLILSDLYIVMDGTVTRNPARDNSTNPLIDLGPEFRKVDSFLDRFKSIPSIVALDSLKISGDVWFGSRITLKGEVTIAAQLGLKLDILDGSVFDNKHSTHSSGAIKYTMKLDEGADCASIDSALNRLNPGSTLILKKDDFYRYIDPIQARNRAMFHSESNCIITATLKDNWFAKLVQGKLWLIILVFHQFKLLSRRRLRWGERRRRTLRSIHQDIQSYLDNYSDSDMWHLIVHSVARVISNVLEDVNRKYMKNHYLGFLAIHSTVFAIEVIGSYAVELNYDIEHYAEPPEQVLKVPFLQGEPKIKFKIMMPAQLNPVPDPDPTQAKKRSRAHSHITAWYTLGKGRRLITTSSTPHESEKPIPTAAVWKSDDLIAAREAADARSPPPPDAERIPFFFFADRSIPPPPSSVPINFLFQSVVFSRPPLASKSPANGIFLHRGVTGRQKQPVLISHNSRCTEDVCQVCHEYRKVYPIFIGEKNIACQQDEIKGLADEMESAGKHLDDDDLVSYIVASMDVDFNPVVTYASCKPD

SEQ ID NO: 2709 - protein, 517 aa, Neurospora crassa
MSHSAVTTIGQFLTPLALDNAVALKLSREFYSNFKHLCTESLNQFLPTPISMSILRPVGRQSTGRVHGFHSTRYLILTFDFSGGSNLRVGFVELLSEGQDRRLNRLLEQSWPILDHLKHENSEHLFGWVGEHIAQVVRKGCETWGLSSDEELPMGVTFSFPMKQTSLSEATLMAMGKGFAITSDLDLGGHLIKGYEQHRTAGLPPLKIAAITNDAVATLVSFVYQYPAAPNQKAAMGLIVGTGCNATIPLQFSKLHKNKFPGLISVQQDWDLLDVGIAVNTEWSINGSASPLRMLGLISRWDDELDKACEAPGFQPLEYMTAGRYLGELARLIFVDFLTTVQGVPPEDLPQGLHQRFGLSTTFLSHFYPGSDKGDILEQLQKEFDLSTDSTFTWTSDHADTLYHIAKAIQTRAAGIVAAATIGLLRCADELPDPSEPVRVGVANGDNVEELVVGYTGGCIQHFQDYLKDTQAFLDFITQEEFAAQGKRIRVKLEPCHDGGITGAGILVPAALASTQA

SEQ ID NO: 2710 - protein, 160 aa, Zea mays
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 2711 - protein, 358 aa, Pseudomonas syringae pv. syringae B728a
MVKTYSYAAQSAQDTLKPHQFERCSPGADDVQIDILYCGVCHSDLHTARNEWHNTLYPSVPGHEIVGRVTAVGSDVKQFKVGDLAGVGCMVDSCQQCASCAEGDEQYCESGFTGTYNGPVFGGENTFGGYSDKIVVKEKFVLRISHDANLAAVAPLLCAGITTYSPLRHWKVGPGKKVGIVGLGGLGHMGVKIAHAMGAHVVLFTTSPDKREDGLRLGADEVVVSRDAGQMAAQANSLDFILNTVAAPHDLDAFLSLLKRDGTMTLVGAPAEPHPSPAVFNLIFKRRSLAGSLIGGIQETQEMLDFCAEHGIVSDIEVIAMQDINEAYERMLKGDVKYRFVIDMDSLKQEAAADSNAA

SEQ ID NO: 2712 - protein, 304 aa, Escherichia coli O157:H7
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTEIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVDCVDSTGAGDAFVAGLLTGLSSTGLSTDEREMRRIIDLAQRCGALAVTAKGAMTALPCRQELE

SEQ ID NO: 2713 - protein, 411 aa, Glycine max
NFSSSQLLIEIEFKFEKAYLCHCTFTDLRLRASLSYFCVDLVSVKRLPFHHSPLFISFFYIDLKLKMESEKKSSAISDVGAWAMNVVSSVGIIMANKQLMSNNGYAFSFASSLTGFHFAVTALVGLVSNATGYSASKHVPMWELIWFSLVANMSITGMNFSLMLNSVGFYQISKLSMIPVVCVMEWILHNKHYSREVKMSVVVVVIGVGVCTVTDVKVNLKGFMCACIAVLSTSLQQISIGSLQKKYSIGSFELLSKTAPIQALFLLILGPFVDYYLSGKLITNYKMSSGAILFILLSCSLAVFCNVSQYLCIGRFSAVSFQVLGHMKTVCVLTLGWLLFDSELTFKNIMGMVIAVVGMVIYSWAVELEKQSNAKTLPHAKNSMTEEEIRLLRDGVEKSPLKDVELGEAQG

SEQ ID NO: 2714 - protein, 295 aa, Medicago sativa
MGNTNSSHNLLITVTVFAVTVTVFFILYFILRRRRFSPSSSSTVRVSPVTPTSSTSSSVVDSLPIFTFSSIKRRSSTVVSGDCAVCLSKFEQNDLLRLLPLCCHAFHTECIDAWLASNQTCPLCRSSVFVSESEIMKIFRSSSTSSGNNSFRLEIGNISHRREATATDNNNNNNNVAGETDRRTYSVGAFDYFVDEEAEIPVGNTNRRIFSGEKDDAAVLSVEVETPVDSQASLIGEGNWLKDYVDGLTRVMSFRGSGSSRRNDVVAGVGDFDVEANGNGFGEEISEMFRWISGV

SEQ ID NO: 2715 - protein, 226 aa, Oryza sativa
  unsure (1)..(226): unsure at all Xaa locations
FQIDALCMAFYARSEETRQXHSVHKLALGTLALEDALSTGSPIRTEVDQLRKSLEGIDKDSLLELALSSIPEXVLEYGSDTPMDLKQKVSSLCCNKFGYPIISPEXMIYHYFLLQFNSLKETVRHFSLIPAGGGGMLTHAVAHVASSIKVKIKDQSGDGIESLLNRVENLIIHGDLSAAAEALERGLQGSEAAEIASEWVKQARKRAIAEQTLTLLHSYASSITFS

SEQ ID NO: 2716 - protein, 513 aa, Arabidopsis thaliana
MAGGSFGPTGVAKERAEQYQGKVTSYVIIACLVAAIGGSIFGYDIGISGGVTSMDEFLEEFFHTVYEKKKQAHESNYCKYDNQGLAAFTSSLYLAGLVSTLVASPITRNYGRRASIVCGGISFLIGSGLNAGAVNLAMLLAGRIMLGVGIGFGNQAVPLYLSEVAPTHLRGGLNMMFQLATTIGIFTANMVNYGTQQLKPWGWRLSLGLAAFPALLMTLGGYFLPETPNSLVERGLTERGRRVLVKLRGTENVNAELQDMVDASELANSIKHPFRNILQKRHRPQLVMAICMPMFQILTGINSILFYAPVLFQTMGFGGNASLYSSALTGAVLVLSTFISIGLVDRLGRRALLITGGIQMIICQVIVAVILGVKFGDNQELSKGYSVIVVIFICLFVVAFGWSWGPLGWTIPSEIFPLETRSAGQSITVAVNLLFTFIIAQAFLGLLCAFKFGIFLFFAGWVTVMTIFVYFLLPETKGVPIEEMTLLWSKHWFWKKVLPDATNLEDESKNVSV

SEQ ID NO: 2717 - protein, 145 aa, Triticum aestivum
  unsure (1)..(145): unsure at all Xaa locations
WPRPXTSVAPFQGXLKSTAGLPVKPPAPTGLASXGVSNGGRIRCMQVXWPIEGIKKFETLSYLPPLXSTEALLKXXSDYLIRSXWGAXPSEFSKGLGFIFREAQTQSPGVLTMGRVLQMWELALCFGADGHGESERWAEGKGSNP

SEQ ID NO: 2718 - protein, 117 aa, Buchnera aphidicola
NLFGDIVSDECAIITGSIGMLPSASLNEKKFGLYEPAGGSAPDIEGKNIANPIAQILSVSMLVRYGMNLKKIADKIDQSVISVLKKGYRTADISNNNNYLKTNEMGDVIANTLISGE

SEQ ID NO: 2719 - protein, 367 aa, Lentinula edodes
MDDRTTAFIVGSSYQPLDIIGEGAYGVVCSAVHIQSQRKVAIKRITPFDHSMFCLRTLREIKLLRHFQHENIIGILDILKPNLGPDGSLDGMTEVYLVQELMETDLHRVIKTQELSDDHCQYFIYQTLRALKALHSADVLHRDLKPSNLLLNANCDLKLCDFGLARSASPLPDHPVDASTFMTEYVATRWYRAPEVMLTFKQYTKAIDKWSLGCVLAEMLSGKPLFPGRDYHHQLSLILDVLGTPTLDDFYAISSSRSREYIRALPFRKKKVFGKPVHEGGVKGFEGKNPLAIDLMEKCLSFNPKRRIDVEGALAHPYLAPYHDPSDEPGAERIDSEFWSFDTFNNGKGLSKEELKVLIYEEVMRGA

SEQ ID NO: 2720 - protein, 328 aa, Podospora anserina
MVCALFLNRIGVEDLLIAGIGLFLGSGRSLASAGPGGAVLCYILMGTVQNYHLFCVICPDLLTVTSHRVKMTALMSVNAPVMEFPRRFMSRGVGFAVGWVYWFAYAVLAGEQLVAVSNAINSRWVRGLIMPCGYPCFRPMLMLPFKVFGELEYIFGCFKLMFIILLIMVGHSIEGSLGTLLGVWTTFTSVMSSYIGMDIVAATAAESRALSDVESMKMAARKINLRVITLYSLAMLPASFVVPMDHPFINGHSTSVGARSIFIIAVVEAGMPKVAHFFNAVFVFSAFTCGINSMYIATRVLHTLALRGQTGPEFITRRLRQCRSGVPS

SEQ ID NO: 2721 - protein, 330 aa, Magnetospirillum magnetotacticum
MTHPTRILVVDNYDSFVYTIVGYLDQLGAQTVVVRNDAVPEPDAEGRFRDADGTVFDGVLVSPGPGTPKEAGQSEHVIRTCAASRTPMLGVCLGHQALAEVYGATVTHAPELMHGKTSLVEHEGEGVLAGLPHPFTATRYHSLAVVSDTVPAELEVTATNAGGVIMGLQHKDLPLHGVQFHPESVLTEGGHRLLANWLEACGLEGAVERSAGMAPLVRQIASTERHRPRICRTNSDAPERQTGEKKDRERREREQKHKEQRTQSRRTAEERNRQEKKREPHTETKQSNIHKANKTKRNKKERERGHPHSKKERRDETANDRNKANQETER

SEQ ID NO: 2722 - protein, 136 aa, Triticum aestivum
PTHLQYWGVGMVLQGIGEAFGGKIIRVPSGVMHGKSSPVYYEEVLGKSICEGLSNPFTAARYHSLVIEEETFPHDELEVTAWTEDGLVMAARPRKRTHIQGVQFHPESIITPEGKRIILNFARYVEEFEKQTSEGK

SEQ ID NO: 2723 - protein, 857 aa, Oryza sativa
  unsure (1)..(857): unsure at all Xaa locations
MEALAGGRPLSGRARQVGRSREEELLGLLSDFSGDSGEFGRELSFSDLVVVEDTANNPSPRGGDGGGDRAAPTAAAAENGQARPSSSSEQEEAAEAASRRQQQQQAAAAARERRLRRRRSDSRGSCGGSGDGVLLNFYVPGLLTRSMTTPRPAARGTLPGAAAAAAAPATAAAGKARMDAPLAVGCWPALWGGGGRRDRRKPAKPAAGRRDTRVVTTVTLGGSVRVDKKKKSFNKIVRKQKQLFSRVQCVMLSCENRKPNAAHRIGMGHGPPVPGAPRRALGRDFHRARFAVESTPRHPGRRSSRPLEASPSAPDKARAPHRAAPPTPTHLRVSPLRSKQIKQEQEILERELEERREKRRRRGRPPASVREGVRRSSWRSWSPEEEEEEQQEAVRMATRHQRAAAAPQPANRGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTXARSKHACGITEKPKEVVEDIDKLDGDNQLAVVEYIEDIYNFYRTAQICSETDSVVLAQLERRPTDYMSSQVEVNPKMRAILADWIIDVHYKFELMPETLYLTMYVIDRYLSLQPVLRRELQLVGVAAMLIASKYEEMWAPEVQDLMHVCDTAYSRQHILAMEKNILNRLQWNITVPTPYVFLLRFIKAAGGDKELENMVFFFSEMALKEYGMASLCPSLVAASAVYAAQCTLKRSPLWTSTLKHHTGFTESQLRECAKVLVNAHAAAPESKLKTAYRKYASEQLGRVSLRPPAVCLA

SEQ ID NO: 2724 - protein, 454 aa, Azoarcus sp. BH72
MNDVQFPTAAAARPHPRGTAATAALLMLGLSGTALAQEAAPATLNSGDTAWMMVSSVLVLMMLVPGLALFYGGMVRAKNVLSVFTQCFGVAGVIGMLWVIYGYSIFSDTTAMEAGVVNLHSFIGGFKQAISPTSTAPASPASIPESVFATFQMTFALITPVIIAGSFAERMKFSAVLLFTALWFTFWYAPLAHMAWSAPGGPAWDWGILEFAGGTVVHINAGVAGLVAALVLGRRRGYPHVAMPPHNLGFALAGAALLWVGWFGFNVGSAVAANENAGMAMLTTQIAACAGVVGWLVVEWLKAGKPSALGAASGALAGLVAITPACGFVGPSGALYMGLITGAVCFFAIGWLKRKLGYDDSLGPFGLHGIGGIVGSLLTGVFASKSLGGFQDIEIASQVQIQAQSVLFTVLYCAIVTWVLLKLTGLVTRGLRVSADDEQEGLDQSQHNERAYNV

SEQ ID NO: 2725 - protein, 626 aa, GIBBERELLA ZEAE PH-1
MSHDIKKTTDIKVEVALARDVEAIEMNDMSASSSQYKDDGNNNNTTKAWAVSVPSSEEQSREQSDWLDGFRRADRRKMKKGWDKQYQSEEPPQIPGDNRYFDIRAANAKTATSALARELKGRHLQMIAFGGAIGTGLFVTSGTALHEGGPGSVLISYIAIGALQYCTMQSLAELAVIFPIAGSFSAFSTRFLDPSWGFAMGWNYCLQWLFTLPLEIIAGAFTITYWNEGITKSVFVVIFLAAIFIINLFGVKAYGEAEFVFSTIKVTAIVAFILLGIVINIGGEPTGSYIGGRYWVDPGFFNNGFKGFCSVLVTSCFSFTGTELIGLAAAETANPRKSLPSAIKQVFWRITLFYIVSLMLVSLLVPHNDPRILDASSSNSAASPFVVAIESMGTTVLPSVMNAVILIAVISVGNSSVFGSSRTLAALADQSMAPAIFSYVDKQGRPLVAIIFASCVGLLAFIVDLKAQNVIFNWLLSVSSLATLFTWGSICLTHIRFRKSWAHASHTLEQLPFRARSGTAGSWFALCGYTLILLSQVWTAVSPVEMKADATTGDIVQNVFLRLMAVPIVLVMYVGHKLWYRTSFVKLEDIDIQTGRRYYRVHLMNEEDREARGAWPLWKKIYRQVC

SEQ ID NO: 2726 - protein, 477 aa, Corynebacterium efficiens YS-314
MAFNTPEEVTKFIKDENVEFVDVRFTDLPGIEQHFSIPASALDEDAIEEGLAFDGSSIRGFTTIDESDMNLLPDLATAKIDPFRKAKTLNIKFFVHDPFTREAFSRDPRNVARKAEQFLASTGIADTCNFGAEAEFYLFDSVRYSTDINSGFYHVDTNEGWWNRGRETNLDGTPNTGSKNRLKGGYFPVAPYDQTVDVRDEMVRNLRDAGFHLERFHHEVGGGQQEINYRFNTLLHAADDIQTFKYIVKNTAALHGKAATFMPKPLAGDNGSGMHAHQSLWKDGKPLFHDESGYAGLSDIARYYIGGILHHAGAVLAFTNPTLNSYHRLVPGFEAPINLVYSQRNRSAAVRIPITGSNPKAKRIEFRAPDPSGNPYLGFAAMMMAGLDGVKNRIEPHAPVDKDLYELPPEEAASIPQAPTSLEASLKALQEDSDFLTESDVFTEDLIEAYIQYKYDNEITPVRLRPTPQEFELYFDC

SEQ ID NO: 2727 - protein, 322 aa, Archaeoglobus fulgidus DSM 4304
METLILTQEEVESLISMDEAMNAVEEAFRLYALGKAQMPPKVYLEFEKGDLRAMPAHLMGYAGLKWVNSHPGNPDKGLPTVMALMILNSPETGFPLAVMDATYTTSLRTGAAGGIAAKYLARKNSSVFGFIGCGTQAYFQLEALRRVFDIGEVKAYDVREKAAKKFVSYCEDRGISASVQPAEEASRCDVLVTTTPSRKPVVKAEWVEEGTHINAIGADGPGKQELDVEILKKAKIVVDDLEQAKHGGEINVAVSKGVIGVEDVHATIGEVIAGLKDGRESDEEITIFDSTGLAIQDVAVAKVVYENALSKNVGSKIKFFRI

SEQ ID NO: 2728 - protein, 828 aa, ASPERGILLUS NIDULANS FGSC A4
MTFNKAMSSMPVSSSSRSPLPSPSPLTERRLFRTFSGLSASSRPRSPTGNGHAPVTEEISEIKRYEDFTTIDWVQDAVHEQARRRIKRQEGSGFWDKEGTFKWRLKVRESYDAGQAWLVITIVGAVIGLIAAVLNIITEWLSDIKLGYCTTAFYLNQQFCCWGAEGAAKLVKSFAPYAAGSGISEIKCIIAGFVMKGFLGGWTLLIKSIALPLAIASGLSVGKEGPSVHFAVCTGNVISRFFTKYKRSASKTREVLTATAAAGVAVAFGSPIGGVLFSLEEVASYFPLKTLWRSYFCALVATGVLSVMNPFRTGQLVMFQVRYDRSWHFFELIFFVIIGIFGGLYGALVIKWNLRVQAFRKKYLSQHAVVESVILAVVTAVICFPNMFLKINMTEMMEILFQECEGEHDYHGLCESKYRWSMVFSLATATILRIFLVIISYGCKVPAGIFVPSMAIGASFGRMVGIMVQALHESFPDSKFFAACEPDLPCITPGTYAFLGAGAALSGIMHLTISVTVIMFELTGALTYILPTMIVVGVTKAVGDRFGNGGIADRMIWANGFPFLDNKEDHVFNVPVSHAMTTDPVSLPASDFPVREAEHLLNDNKFQGFPIIEDRSSKILVGYIGRTELRYAIDRARREGMISPSAQCVFTKDAAEASVARRASSTLQRTLLTPDTFDNIESSSGASFVDFSRYIDNTPLTVHPRLPLETVMEIFKKMGPRVILVEHRGRLTGLVTVKDCLKYQFKVEAEEQALAATHHPELPLGAYQAKDNGTLEERIWNLMQKIGSRFSKSSGQPRDAMPLPQDDQSPIGVGNDADGRMVELEERP

SEQ ID NO: 2729 - protein, 138 aa, Oryza rufipogon
SDDKALKRHLLRKYSGYLGGLRKELSKKRKKGKLPKEARQKLLTWWELHYRWPYPSEMEKIALAESTGLEQKQINNWFINQRKRHWKPTEETQFAVMEAYHHQSTDAAAAFYVDVDARLVGATAVAPASAVYTARPDH

SEQ ID NO: 2730 - protein, 223 aa, Xylella fastidiosa Temecula1
MSNCLIAPSILSADFARLGAEVDAVLAAGADWIHFDVMDNHYVPNLTFGPMVCKALRSYGITAPIDVHLMVEPVDRIVPDFAQAGASMISFHMEASRHVHRTIQLIKSHGCMAGLVFNPATPVDMLDWVLPELDLVLLMSVNPGFGGQRFIPGTLDKLRLVRKKIDLLGRPVRLQVDGGVGIDNIGAIAEAGADTFVAGSAIFHARDYADVVAQMRAAVAAVR

SEQ ID NO: 2731 - protein, 1228 aa, ASPERGILLUS NIDULANS FGSC A4
MHSISTSRAMPDHIGRWKNGGHLSPDANGDLKTDYSRWRLLDDDGRQTWHYLETDEENHEWPQSIADKYFLGLPTGLPQLPKAKTPMQCAENGLEFFSKLQLPPGNWACEYGGPMFLLPGLIITYYVTNTPIPPEYATEIIRYLFARQHPEDGGWGLHIEAHSSVFGTSMNYVVLRLLGVGEDDPRMIKARGLLHSFGGAVYGPHWSKFWLSILGVMDWDCVNPVPPELWFVTVNIAALDVRANLNRLLPDWVPFAPWRWWIHMRQVFLPMSYLWSKKFTYPLTPLTKQLRHELYTQPYDSIDFASHRNSIHKADNYYPKTWLLNSLNSLLVNVWNPFFRTSAIVKRAEDWTWELIRMEDENTDYAGLGPVNNPMNMIACLVHDGPDSYSVRRHRERLHDYMWMKDEGMLMNGTNGVQVWDTAFITQAIVVAGFADDPKWRPMLTKALGFLDAHQLRENVPNQEKCYRQHRKGAWPFSNKTQGYTVSDCTAEGLRSTIQLQEMHNFPKMISEERLKDSVDCLLLMQNPSGGFTEYETTRGSPKIEWLNAAEVFGGIMIGYDYPECTTASVTALSLFSKFYPNYRAEEIKAAKDKAVKYIKRVQRADGSWYGSWGICFTYAAMFALESLASIGETYETSNYARRGCEFLISKQKEDGGWGESYLSSEKHVYVQHEKSQVCQTAWACLALMEAGYPHKEPLQKAMKLIMSRQQPNGEWLQEAIEGVFNQSCMISYPNYKFYWPIRALGLYSRKFGNEELHFLIHNMNAASQGDAALAKSDFVSALQHYTRALCELPRAPAYYIKRSIAYLRLKPADGGPNVKNALRDAEIAVILARERAKRDLICSAQMRRAIALYQMERYGDAAFLFGLLEEKVLGDKKEGGDAADKVKDVMNASKASGPMKGVAQELQIWLMKINAKLGGLEDGDERMKVTVEEVPVGVKVPSDKELKKQWEAMKSGNISGENTSAGAGPVAGKKETEETSAEAVKEKAAPPVSAPPQTQDKIRHEWYQSNDSVVVTLYAKGVDKEKVDAEIKSDSVSVQFPLPSGADYAFNLDPLFASIDESASKVTTFSTKIELVLRKQVPGQKWGSLESSSTDIKSSTITPTAASSAPKSAPSYPTSSRHGTKDWDKLASTLTAKKSKKPRAKQDEKAKEKTEGEDEEDSDNEGSVDSEYGGDPVDGFFKKLYAGADEDTRRAMVKSFVESNGTSLSTNWGEVGKGKVEPYPAND

SEQ ID NO: 2732 - protein, 266 aa, Schizosaccharomyces pombe
MPANYQSVPQDDPSVPNLAQAPPAYSEYNESATENPAVDQFKNTTPVAECAKSIRMAFLRKVYAILTAQLFVTSLFGGIFYLHPAFSFWVQMHPWFLILNFFISLVVLFGLIMKPYSYPRNYIFLFLFTALEGLTLGTAITFFSARIILEAVFITLGVFVALTAFTFQSKWDFSRLGGFLYVSLWSLILTPLIFFFVPSTPFIDMAFAGFGTLVFCGYILFDTYNILHRYSPEEFIMSSLMLYLDFINLFIRILQILGMLQNNDNN

SEQ ID NO: 2733 - protein, 497 aa, GIBBERELLA ZEAE PH-1
MSDVTTAITTACTYKARDSDNIATTSGSDIRPDAGPRKRRHSFFIPRRRSIVGHIMDGEEGLLLKVDLFLSELERRLDFIENYVDLSKDSSISRTFSTLQAVRSRCSHASEEVLGAGRRRLHIMVDTLETRYKETLEAAESLNEKAHMGVDLLETMLSDFETRAYKLREQGFANAANAAEAFMDEGRRVANEGIERAIQAAYSLEEHIQQAIVLAKEGRLISYDDLPSPWRNNPHIHKGYRFTESKLECIRSVFTPSNELFNIWSHALGLVLVLAIALYFYPNTVNFTLSSKSDVFVAGVFFVMACLTLVCSTIWHTMNAVADVDAISIFACVDYTGISLLIAASIMTTEYTAFYCDPVSRYIYMGLTAFLGIGGVILPWHPRFNGADMAWVRVAFYVGLALTGFLPMVQLGWTHGLDFVYDFYSPISKSMLVYLSGAFVYASKIPERWYPGCFDYIGGSHNLWHAAVLGGILFHYSAMQAFFANAFHRAEGGCPSY

SEQ ID NO: 2734 - protein, 147 aa, Vibrio parahaemolyticus RIMD 2210633
MPKIVKKEPKFVEQSGKKVTKSDEQWREQLSDEEFRVCREQGTEPPFSGKLLHNKETGVYACTCCNAPLFISDNKYDSGCGWPSFDAPLNNEAIRYLEDLSHGMVRTEIRCASCDSHLGHVFEDGPKTTGERYCVNSVSLIFNKSDE

SEQ ID NO: 2735 - protein, 112 aa, Triticum aestivum
MAATSGAKITATEPPKIVWNAGKHRFETEDHEAFIDYKLRNNGKVMDLVHTYVPSSKRGLGLASLLCIAAFEHASSHSLSVVPSCSYVSDTFLPRNPTWKPLVHSEDPKSSI

SEQ ID NO: 2736 - protein, 363 aa, Thermoproteus tenax
MEAAILEKYNSELVIEEVDVEPPKSGEVALRVKAAGVCHSDLYVLEGATPVPPPLVPGHEAVAEVIEVGPDVQGLSRGDLVVTSFIWPCGRCRNCARGHENLCERFSEVRLKGVLLDGTTRLRRRKSGEPLRIFLGGLWAQEAVVPASAVAKLPPRLANRPELAMLGCAFLTAYGAVVNSGSVQPGDTVAVIGTGGVGLAIVQVARAVGARVIAVGRNPEKLKLAAEMGAEVVNARDGDAVAEVRKLTDGRGADVVVEAVGSEQTVEQAIDMASTGGRVVLVGLMGLGKKAPLHVARVVRGGISVIGSYGARPRVDLPKVIGMVERGLLRPELMARDFYKLEQINEAVEALRSGRSIRPIVLP

SEQ ID NO: 2737 - protein, 266 aa, Triticum aestivum
  unsure (1)..(266): unsure at all Xaa locations
MGSNEGGGCDGKPVVVVPEIKYTKLFINGEFVDAASGKTFETRDPRTGDVLAHIAEADKADVDLAVEAAREAFEHGKWPRMSGYERSRAMNKLADLMEQHIEELAALDGADAGKLLLWGKFIDIPSAVQMLRYYAGAADKIHGESLRVSGKYQGYTLKEPIGVVGIIIPWNFPSLMFFLKISPALAAGCTVVVKPXPSQTPLSALYYAHLAKLAGIPDGVINVVPGFSPTAGAAIASHMDVDSVAFTGSGEVRRLIMEASARSNLK

SEQ ID NO: 2738 - protein, 249 aa, Yersinia pseudotuberculosis
MIIFVTGATSGFGEAIARKFISHGHQVIAAGRRQERLEALQAELGAQLHIVRLDVRNRAAIQQVIDELPAELRNIDLLVNNAGLALGLEPAHKANVDDWDTMIDTNTKGLVNMTRALLPAMVERNVGHIINIGSTAANWPYAGGNVYGATKAFVKQFSLGLRADLHGTHIRVTDIEPGLVGGTEFSAVRFKGDGEKVNKTYDGADPLMPEDIAEAVYWVATLPARVNINSLEMMPVSQSFAGLNIHRGS

SEQ ID NO: 2739 - protein, 552 aa, Sarcina ventriculi
MKITIAEYLLKRLKEVNVEHMFGVPGDYNLGFLDYVEDSKDIEWVGSCNELNAGYAADGYARLRGFGVILTTYGVGSLSAINATTGSFAENVPVLHISGVPSALVQQNRKLVHHSTARGEFDTFERMFREITEFQSIISEYNAAEEIDRVIESIYKYQLPGYIELPVDIVSKEIEIDEMKPLNLTMRSNEKTLEKFVNDVKEMVASSKGQHILADYEVLRAKAEKELEGFINEAKIPVNTLSIGKTAVSESNPYFAGLFSGETSSDLVKELCKASDIVLLFGVKFIDTTTAGFRYINKDVKMIEIGLTDCRIGETIYTGLYIKDVIKALTDAKIKFHNDVKVEREAVEKFVPTDAKLTQDRYFKQMEAFLKPNDVLVGETGTSYSGACNMRFPEGSSFVGQGSWMSIGYATPAVLGTHLADKSRRNILLSGDGSFQLTVQEVSTMIRQKLNTVLFVVNNDGYTIERLIHGPEREYNHIQMWQYAELVKTLATERDIQPTCFKVTTEKELAAAMEEINKGTEGIAFVEVVMDKMDAPKSLRQEASLFSSQNNY

SEQ ID NO: 2740 - protein, 492 aa, Capsicum annuum
MDLSKYRPSSAYDSPFLTTNAGGPVYNNVSSLTVGPRGPVLLEDYHLIEKLATFVRERIPERVVHARGASAKGFFEVTHDISHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKAGKAHYVKFHWKPTCGVKSMTEEEAIRVGGTNHSHATKDLYDSIAAGNYPEWKLFIQIMNPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRSWAPDRQDRYINKWVESLSDPRATHEIRSIWISYLSQADKSCGQKVASRLTVKPTM

SEQ ID NO: 2741 - protein, 346 aa, Solanum tuberosum
MRTSMLKSIVRRSSTAGESYVSRRGFASGSAPERKVAVLGAAGGIGQPLSLLMKLNPLVSSLSLYDIAGTPGVAADVSHINTRSEVVGFAGEEQLGKALEGADIVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSNEEIVALTKRTQDGGTEVVEAKAGKGSATLSMAYAGAIFADACLKGLNGVPDVVECAFVQSNVTELPFFASKVRLGKNGVEEVLGLGPLNEYEKQGLEALKPELLSSIEKGIKFAKEN

SEQ ID NO: 2742 - protein, 297 aa, Bacillus cereus ATCC 14579
MYMTNVTGTERVKRGMAEMQKGGVIMDVVNAEQAKIAEEAGAVAVMALERVPADIRAAGGVSRMADPTIVEEVMGAVSIPVMAKCRIGHLVEARVLESLGVDYIDESEVLTPADEVYHLNKRDYTVPFVCGCRDIGEAARRIAEGASMLRTKGEPGTGNIVEAVRHMRQVNAEIRQVASLREDELMTYAKNTGAPYEVLLEIKRLGRLPVVNFAAGGVATPADAALMMQLGADGVFVGSGIFKSENPEKFARAIVEATTHYEDYELIASLSKGLGNAMKGVEISTLLPEQRMQERGW

SEQ ID NO: 2743 - protein, 152 aa, Pennisetum glaucum
MSLVSRSSVFDPFSMDLWDPFDSMFRSIVQSAGSPDSDTAAFAAARIDWKETPEAHVFKADLPGVKKEEVKVEVEDGNVLVISGQRSKEKEDKNDRWHRVERSSGQFMRRFRLPGNAKVDQVKAGLENGVLTVTVPKAEEKKPEVKAIEISG

SEQ ID NO: 2744 - protein, 297 aa, Candidatus Carsonella ruddii
MNLLNYLYINKKISIDSADLNLIKKYKFNSITSNPTLILKSFLNKTYNLLLNLFFYKNNKKILLDSDIQISLYDKILILIVGNLIPFINDKISIEIPARISFNYNLIIIYSKKIIFLCNKYGINIKKILIKIPGTDSGIKAAKKLKEIGIETNITLIFDINQVKKCLDYGVYIISPFVGRISDSIFCKYDSGVNFVKNIFIYKNNNNYKTKIMAASFRNINQILNLTFCDCLTISPIYFSKLLKFNLKLLFTNNIKKSIKINFLNKHSSKLIINGINIFDKDHKKFINIISTIINNL

SEQ ID NO: 2745 - protein, 197 aa, Syrrhopodon ciliatus
GGAKKVVISAPSKDAPMFVMGVNEEKYTSEDIVSNASCTTNCLAPLAKVINDKFGILEGLMTTVHATTATQKTVDGPSNKDWRGGRSAATNIIPSATGAAKAVGKVLPELNGKLTGMAFRVPTTDVSVVDLTVRLEKPASYDTIKSALKEASEGKLKGILGYTEDDVVSSDFITDSRSSIVDAKAGIALSDTFVKLG

SEQ ID NO: 2746 - protein, 167 aa, Listeria monocytogenes
ARGAGAHGKFVTKKSMKKYTIAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMIMYLFSDEGTPASYREIRGSSVHAFKWINEEGKTVYVKLRWIPKAGI

SEQ ID NO: 2747 - protein, 420 aa, Rhizobium tropici
MVEKRFPAAGRDAMAYVLAGGRGSRLKELTDRRAKPAVYFGGKTRIIDFALSNALNSGIRRIGVATQYKAHSLIRHMQRGWNFFRPERNESFDILPASQRVSETQWYEGTADAVYQNIDIIEPYGPEYMVILAGDHIYKMDYEWMLQQHVDSGADVTIGCLEVPRMEAVGFGVMHVDDKDRIIDFVEKPADPPGIPGNPDFALASMGIYVFHTKFLIECLKRDAADPNSSRDFGKDIIPHIVKNGKAVAHRFTQSCVRSDFEREAYWRDVGTIDAYWQANIDLTAVVPELDIYDKSWPIWTYAEISPPAKFVHDDEDRRGSAVSSVVAGDCIISGASLYNSLLFTGVRANSYSKLEGAVVLPSVKVGRRAQLKNVVIDHGVTIPEGLVVGEDPELDAKRWRRTESGICLITQSMIDKLDL

SEQ ID NO: 2748 - protein, 479 aa, Chondrus pinnulatus
SIKNERYESGVIPYAKMGYWDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKALGSIIVMIDLVIGYTAIQSMAIWARKNDMILHLHRAGNSTYSRQKIHGMNFRVICKWMRMAGVDHIHAGTVVGKLEGDPLMIQGFYNTLLLPYLEVNLPQGIFFEQDWASLRKVTPVASGGIHCGQMHQLLDYLGDDVVLQFGGGTIGHPDGIQAGATANRVALESMVIARNEGRDFVAEGPQILQDAAKTCGPLQTALDLWKDISFNYTSTDTADFVETPTANV

SEQ ID NO: 2749 - protein, 210 aa, Saccharomyces cerevisiae
MSRNSAAGLENTLFQLKFTSKQLQKQANKASKEEKQETNKLKRALNENEDISRIYASNAIRKKNERLQLLKLASRVDSVASRVQTAVTMRQVSASMGQVCKGMDKALQNMNLQQITMIMDKFEQQFEDLDTSVNVYEDMGVNSDAMLVDNDKVDELMSKVADENGMELKQSAKLDNVPEIKAKEVNVDDEKEDKLAQRLRALRGKNMLTG

SEQ ID NO: 2750 - protein, 403 aa, Streptomyces coelicolor A3(2)
MHNTTAVLIELGAIILALGLLGRIAGRVGFSPIPLYLLAGLAFGHGGMLPMQASEEFTATGAEIGVILLLLLLGLEYSASELVTNLKTQYPSGAVDFVLNAVPGAVAALVLGWGPVAAVALAGVTWISSSGVIAKVLGDLGRLGNRETPVVLGVLVIEDLAMAVYLPILTALLAGVSLAGGAVTLLISLGTVGAVLYLALRHGRLISRAVSSDSAETLLLVVLGLTLVVAGLAQELQVSAAVGAFLVGIALSGEVAEGASSLLTPLRDLFAAVFFVFFGLSTNPADIPPVLVPALLLAAVTALTKVATGWYAAHRAGLRGAGRWRAGGTLVARGEFSIVIAGLAVGVEPRIGPLATAYVLILVVIGPLTARFTEPLARRLTRGPRKAAPATATTPAESTHANA

SEQ ID NO: 2751 - protein, 191 aa, Pyrococcus furiosus DSM 3638
MVDMSKVKLRIENIVASVDLFAQLDLEKVLDLCPNSKYNPEEFPGIICHLDDPKVALLIFSSGKLVVTGAKSVQDIERAVAKLAQKLKSIGVKFKRAPQIDVQNMVFSGDIGREFNLDVVALTLPNCEYEPEQFPGVIYRVKEPKSVILLFSSGKIVCSGAKSEADAWEAVRKLLRELDKYGLLEEEEEEL

SEQ ID NO: 2752 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 2753 - protein, 219 aa, Chloranthus spicatus
MGRGKIEIKRIENSTNRQVTFSKRRGGILKKAKELSVLCDAQVSLIMSSSTGKFYEYCSPATNTKKIFDRYQQASGINLWNSQYEKMQEYFEKLKETNNKLRKEIRQRRGEDLNGLNINELRSLEQNLDDSLKIIRERKYHVIKTQTETYGKKLKHRQEEHEKLLHRLEGIDMNQGYDMLDREGDYETAFGLANGGGHVFAFRLQPIQPNLHDNGYGTH

SEQ ID NO: 2754 - protein, 458 aa, Oryza sativa
MATGQCMQALPMEVWNSWLLEKAVLPALDVAPPVKIGGPRRTSVLRNPNMEKLQKGYLFPEISIKREEHLKKYPDAKVISLGIGDTTEPIPSIVTSAMAEDVPFPFCRYALALSTPEGYQGYGPEQGHKNLRKEIADKVYPDMGIKESEVFISDGAQCDIARLQTLFGPNVTIAVQDPTFPGYVDNGVIMGQTGKADDGGRYAGIEYMRCAPENAFFPDLSRVRRTDVIFFCSPNNPTGHAASREQLRQLVELARRNGSIIVFDSAYSSYISSSSSSSTPRSIYEIPGAREVAIEVSSFSKFAGFTGVRLGWAVVPDELLYSDGVPVARDFDRVVCTCFNGASGIAQAGGVACLSTEEGRGAVARVVGVYRENARVLVETFRSLGKEVHGGGDAPYVWVRFPGRRSWDVFAEILEKTHVITVPGSGFGPGGEGFIRVSAFNSRDKVLEACQRLKSFLA

SEQ ID NO: 2755 - protein, 680 aa, Streptomyces coelicolor A3(2)
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGLPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQETDGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKPRAADAPAEAAPAEVKGS

SEQ ID NO: 2756 - protein, 396 aa, Aspergillus fumigatus
MATGKAEPSTHSEIPSSSPPSRGVDTPLEDVQKREKQMVASFRPPHQRSVNPFVIKDRLEERQLGISTRTLCVNDFTLIKTLGTGTFARVWLAKFKDETIRRDNVYALKVLRKADVIKLKQVEHVRNERKALAAVAGHPFITTLIASFSDEQSLYMLLDYCPGGEIFSYLRRARRFNETTSRFYAAEITLTIEYLHDVEGIVYRDLKPENILLDADGHIKLVDFGFAKQINDRETYTLCGTPEYLAPEVIHNSGHGLAVDWWALGILIYEFLVGQPPFWDQNPMRIYEQIVEGRLRFPPNMSPAAQNIISCLCKTNPSERLGHISGGSARVKAHPFFEDIDWDDLFHRRMKGPIIPRVDHPADTGNFEDYPDVDVKGQAIYTDDMKKKYEALFSDF

SEQ ID NO: 2757 - protein, 584 aa, ASPERGILLUS NIDULANS FGSC A4
MKKLSTIFLNNRSEEAQCRLGRSGEQHHQEQLDREKQDEMNESPVPFVTWRSLALGAFVSIGGIIFGYDTGQISGFLEMDNFKRRFGQRQLDGTYAFNNVRSGLIVSMLSIGTLLGALMAGPLADRLGRKWSIAFWCIILHVGLIIQISSPHPKWYQFMMGRFVTGFGVGACSLLVPLYQGETSPKQIRGAMVCSYQLFVTLGIFVAYCINYGTEGMSNSASWRIPLGITFLWALLLGIGIIFFPESPRYDFRHGRADKARQTMSKLYGVPQNHRAIIEELTEIREQLEAESSSRGGFHGWIEMFQGPRMFYRITLGIVLQALQQLTGANYFFYYGTTVFNGAGISNVFVTQMILGGVNFGTTFFGLYVVEHFGRRKSLVTGGIWMFVNFMVFASVGHFSLNVEDPSATPGAGKAMVVFACLFITGFATTWGPMIWAIVAELYPSRYRAKAMAMATASNWLWNFLIGHREIRFFTPFITGDIDFAYGYVFAGCLFAAILIVYFFVLEGKGKTLEEMDMMYVMRVPPWKSSKWVPPPPEERVTTAHILDQRAAREFANEDESSKRNQVPAHQHIDQNDAGVGPSA

SEQ ID NO: 2758 - protein, 99 aa, Ficus carica
DEMDFEFLGNVEGKPWRFQTNLYGNGSTSRGREERYRLWFDPSKEFHRYSILWTPDNIIFYIDEVPIREVVRREEMGGDFPSKPMSLYATIWNGDDWAT

SEQ ID NO: 2759 - protein, 431 aa, Escherichia coli O157:H7 EDL933
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 2760 - protein, 292 aa, Neisseria meningitidis Z2491
MNYAKEINALNNSLSDLKGDINVSFEFFPPKNEQMETMLWDSIHRLQTLHPKFVSVTYGANSGERDRTHGIVKRIKQETGLEAAPHLTGIDASPDELRQIAKDYWDSGIRRIVALRGDEPPGYEKKPFYAEDLVKLLRSVADFDISVAAYPEVHPEAKSAQADLINLKRKIDAGANHVITQFFFDVERYLRFRDRCVMLGIDVEIVPGILPVTNFKQLGKMAQVTNVKIPSWLSQMYEGLDDDQGTRNLVAASIAIDMVKVLSREGVKDFHFYTLNRSELTYAICHILGVRP

SEQ ID NO: 2761 - protein, 223 aa, Synechocystis sp. PCC 6803
MSRAQPLLPPLPKGKPSHGEKRITKTGLGQIWGLRRHPAISLLQWQRSPQPLKRASLSQVVNIPTLDTLAQELAAIQQTGSKRIALLGSRHVPITHQQLIEMMSYALVLGGNHLVTSGATGTNSAVIKGAMRADPNLLTVILPQSLDRQPRESRNQLGQVVHLVENTENDSLSLGEASTICNREIVSRCQQLICFAFHESHTLLQTCAEAEEQRKLVTLFYFD

SEQ ID NO: 2762 - protein, 135 aa, Haemophilus influenzae
EDPTPALEGADVVLISAGVARKPGMDRSDLFNINAGIVRGLIEKVAITCPKACVGIITNPVNTTVAIAAEVLKKAGVYDKRKLFGVTTLDVLRSETFVAELKGLNVSRTSVPVIGGHSGVTILPLLSQVQYAKWN

SEQ ID NO: 2763 - protein, 797 aa, Escherichia coli [sequence omitted]

SEQ ID NO: 2764 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 2765 - protein, 579 aa, GIBBERELLA ZEAE PH-1
MAIAMGWQKPDNVAGSSAPAIMVGLFVASGGLLFGYDTGAINGILAMTEFKEQFGKHTNCVDENGAVDICTKDSSIIVAILSAGTALGALLAAPTGDSLGRRKTLLLAVAIFCVGAIFQVAANNIDLLLVGRFFAGVGVGLISVLVPLYQSEMAPKWIRGTLVCAYQLSITFGLLAASIVNILASKLNNSSAYRIPLGLQIVPAIILTGGLLLLPETPRFLVKKGLHEAAGLSLSRLRRLDITHPALVDELQEMIANHQYELTLGPDSYKQLFIGSPHLGRRMFTGCGLQMLQQLTGINFIMYYSTSFFDGAGVESPYTKSLIINIINVVSTIPGLLVIEKWGRRRLLMIGALGMAGCQLLMASFDTATGQSYEKASQTILIAFCAINIFFFAASWGPVVWVVTSEIYPLKVRAKAMSVSTASNWLLNFAIAYCAPYLVGTGPGNASFGPKIFFIWGAFCILAVFFVWCMVYETSKISLEQIDEMYERVNHAWNSKSFEPSWSFQQMLNDGWSPSAQPPADHELQTTTSASSADTTLGDGDASSITVSQSNNNSSSPNNNNDQNKGPPAMSMANVDFSY

SEQ ID NO: 2766 - protein, 351 aa, Streptomyces peucetius
MKALVLSGGSGTRLRPFTHTSPKQLVPVANKPVLYYVLEDIAQASITEVGIVVGETSNEIRKAVGSGDRFGLRVTYLPQEAPLGLAHAVLIARDYLGEEDFVMYLGDNFVVGGIAGNSSTFRAERPDAQILLTRVSDPSSFGVAEIGCDGRVVALEEKPRHPRSDLAVVGIYLFTPVVHEAVRALTPSRRGELEITDALQWLLDGPYDVRYTTISGYWKDTGNVADMLEVNRAVLDGIEPGMEGQADAASELVGRVRIEAGAQIRASRIVARRHRAGRVTDRTSALHVDRGDCSIETARSSLHHAGRLPAHGTRRVQHSLLGRNVTVAPAPRVPAGSRLILGDDSRVEISS

SEQ ID NO: 2767 - protein, 321 aa, Oryza sativa
MGILSLITGKAGASGFGSGSTAEQVTAGVDATGLTVIVTGGASGIGLETSRVFAMRGAHVIIAARNTEAASVVRKKIIEENPKAHIDVLKLDLSSLKSVRAFADQFNSMNLPLNILINNAGVMFCPFGLSEDGVEMQFATNHLGHFLLTNLLLDNMKATAKSTGIEGRIVNLSSVAHLHTYPKGIEFDKLNDEKTYDDKMAYGQSKLANILHAKELSRRLKEEGANITINCVHPGLIMTNLMRHSFFLMRVLQFATYILWKSVPQGAATTCYVGLNPQLKGVTGQYFADCNVEKTSRFARNDALAKQLWEFSEKLIKSSSK

SEQ ID NO: 2768 - protein, 513 aa, Vicia sativa
MELETLISWLLFSTSLFWFLFLATKTKSKPPKTPSSTTNTPIPKSYPIFGSAFSLLANFHRRIQWTSDILQTIPSSTFVLHRPFGARQVFTAQPAVVQHILRTNFTCYGKGLTFYQSINDFLGDGIFNADGESWKFQRQISSHEFNTRSLRKFVETVVDVELSDRLVPVLSQASNSQTTLDFQDILQRLTFDNICMIAFGYDPEYLLPSLPEIPFAKAFDESSQLSIERLNALIPLLWKVKRFLNIGVERQLKEAVAEVRGLATKIVKNKKKELKEKALQSESESVDLLSRFLSSGHSDESFVTDMVISIILAGRDTTSAALTWFFWLLSKHSHVENEILKEITGKSETVGYDEVKDMVYTHAALCESMRLYPPLPVDTKVAVHDDVLPDGTLVKKGWRVTYHIYAMGRSEKIWGPDWAEFRPERWLSRDEVGKWSFVGIDYYSYPVFQAGPRVCIGKEMAFLQMKRVVAGIMGRFRVVPAMVEGIEPEYTAHFTSVMKGGFPVKIEKRSPLV

SEQ ID NO: 2769 - protein, 456 aa, Lycopersicon esculentum
MATWFLRRLNNHGVMQKLSMAFSGKSTTAIGRRYFVSMEVGQKLDPYSCDDDYRENIDHQNQDLDFPGGKIPLTSQMKFISEASEKRLPCYRVLNDDGSLISNSIHDQLGEEVAVNMYSAMVTLKTMDTYLYEAQRQGRISFYMTTFGEEAINIASAAALSPHDFVLPQYREAGVLLWRGFTVQECTNQCFGNKDDKGKGRQMPVHYGSNKHNVITISSPLATQISQAAGVAYSLKMDKTGACAVAYTGEGATSEGDFHAGLNFAAVLEAPVIFLCRNNGWAISTPVHEQFRSDGIVSKGLGYGIRSIRVDGNDVIAVYNAVRAARTMAISEERPILVEAMTYRVGHHSTSDDSTKYRPTNEIEYWKTARCPINLFRKHIQRNGWWSDVQESELYTHVKNQVLEAIKTAEGMEKPALTELFSDVYEKMTPNLQEQERCIRDAIHKYPKDYPTDFQA

SEQ ID NO: 2770 - protein, 366 aa, Zea mays
FGSSNNTPVFFLRDPTKFPVFIHTQKRNPQTNLKDATMFWDYLSTHQESAHQVMHLFSDRGTPYSYRHMNGYSGHTFKWIKPDGTFNYVQIHCKTDQGNKTLTNEEAGELAKSNPDWHTQDLFQAIERGENPSWTCYVQTLSPEQAEKFRWNVFDLTKVWPQSEVPLRRFGRFTLNKNPENYFAEIEQAAFAPSHLVPGVEPSADPVLQARLFSYPDTHRHRLGVNYQQIPVNCPLHAFNPYQRDGAMAVNGNYGANPAYPSSFRAMNFEPVKASQEHEKWVGAVTSQQIPVTDEDFVQANALWRVLGRTPGQQENFVKNVSVHLCNANERVRKQTYGFFTRINAILGEKIKKATEKNVSREQARL

SEQ ID NO: 2771 - protein, 508 aa, Petunia x hybrida
MVLLSELAAATLIFLTTHIFISTLLSITNGRRLPPGPRGWPVIGALPLLGAMPHVSLAKMAKKYGAIMYLKVGTCGMVVASTPDAAKAFLKTLDLNFSNRPPNAGATHLAYGAQDMVFAHYGPRWKLLRKLSNLHMLGGKALENWANVRANELGHMLKSMFDMSREGERVVVAEMLTFAMANMIGQVILSKRVFVNKGVEVNEFKDMVVELMTTAGYFNIGDFIPCLAWMDLQGIEKGMKRLHKKFDALLTKMFDEHKATSYERKGKPDFLDCVMENRDNSEGERLSTTNIKALLLNLFTAGTDTSSSAIEWALAEMMKNPAILKKAQGEMDQVIGNNRRLLESDIPNLPYLRAICKETFRKHPSTPLNLPRISNEPCIVDGYYIPKNTRLSVNIWAIGRDPEVWENPLEFYPERFLSGRNSKIDPRGNDFELIPFGAGRRICAGTRMGIVMVEYILGTLVHSFDWKLPSEVIELNMEEAFGLALQKAVPLEAMVTPRLPIDVYAPLA

SEQ ID NO: 2772 - protein, 506 aa, Shewanella oneidensis MR-1
MIYAQPGTAGALVNFKEKYANFIGGKWVAPVNGKYFDNRSPVNGQNFCKIPRSDAQDIELALDAAHAAKDAWGKTSVTERSNILLRIADRVEQNLEYLAVAETWENGKAVRETLNADLPLFVDHFRYFAGCIRAQEGSAADIDGNTVSYHFPEPLGVVGQIIPWNFPLLMAAWKIAPALAAGNCVVLKPAEQTPVSILVLLELIEDLLPPGVLNVVNGFGAEAGQALATSKRIAKLAFTGSTEVGFHILKCAAESLIPSTVELGGKSPNLYFADVMDQEDEYLDKAVEGMLLAFFNQGEVCTCPSRVLIQESIYDRFIEKVLARAQTIKQGNPLDTATQVGAQASQEQFDKILSYLAIGKDEGAQVLLGGSLCQLEGEQSKGYYISPTIMKGHNKMRIFQEEIFGPVISVTTFKDEAEALAIANDTEYGLGAGVWTRDMNRAQRMGRGIQAGRVWINCYHAYPAHAAFGGYKKSGIGRETHKMMLNHYQNTKNLLVSYDINPLGFF

SEQ ID NO: 2773 - protein, 263 aa, Triticum aestivum
MDGAGAGGAYVARTAEEVFRDLRGRRAGMIKALTEDVDKFFKLCDPEKENLCLYGYPNETWEVTLPAEEVPPEIPEPALGINFARDGMNEKDWLALVAVHSDSWLLSVAFYFGARFGFDKENRRRLFNMINNLPTIYEVVTGIAKKQSKEKTPNSSSKSSKPSMKVLSRVEPRAKAKVPAPKDEEESGEDEGDDEEEEHDNTLCGTCGTNDGKDEFWICCDNCEKWYHGKCVKITPARAEHIKHYRCPECTNGGSNSNKRVKT

SEQ ID NO: 2774 - protein, 784 aa, Bacillus cereus ATCC 14579
MKGVILAGGKGRRLRPLTCNTPKPMLPLLEKPVLEYNIELLRQHGIREIAITVQYMSTTIKQYFGDGSKWGVNLYYFEDSPPLGTAGSIKQAEQFLDETFVVISGDALTDFQLSEGIRFHEQKKRMVTMFVKEVENPLSFGLVVMNKDQEVTRYIEKPGWNEVVSNVVNTGIYIMEPEIFSYIPPRQFFDFSHDVFPLLANKNVLFAYLSEGYWLDIGTFNQYRQAQFDLLTKKLQVPIPYTEVLPMVWMGEGVTIGKGTKIHGPSFIGEGAKIGTGAVIEPYSIIGKNSIVSNYSHLQKSIVFANTHIGKYCELLETTIGERTIVEDDVTLFQKSVVADHCHIGRSTVIKQKGKLWPYKAIDSHSIVGAAGIQESEMSAGWLQKSRIVGRGNVEITPQFIVKIAMAYGSLFKKGESILIGSQENIETTSYKNLFLHAIHGIGIHTMECKEMNESLFQYSVHHLQCAGGVFIQVENENEIVIKLYGQAGMPLTYKQQKEIEQVYMSELFYYVHEKEMGRNKLVHVSMNEYIEVILEHIDIEKIQMQKFHLLINKRNDTLQHLLMLFLQRLGCTVTWIYASEQKDHVKALMKSSKANMALMFSEQGNHFELYDKHSNIYQGTDLEEVDIPDFLLESTGNIYPMSLKLGECYLLFYTQDERKSFQVRWKRDILYRIGKLFELIALQGKTFLSIVEQSPPLYLLYDEVVCSWNEKGEIMRKLLDDIERKGEGIFEGVQFKYTEKEWSYIVSDTKQPKFLVYSHARNPVIARENMKNLIEKIRQYQKV

SEQ ID NO: 2775 - protein, 251 aa, Zea mays
  unsure (1)..(251): unsure at all Xaa locations
MAREQLEVLTALDAAKTQWYHFTAIVIAGMGFFTDAYDLFCISLVTKLLGRIYYYREGADAPGSLPPNVAAAVNGVAFCGTLSGQLFFGWLGDRMGRKRVYGMTLMCMVLCSIASGLSFGSTPGSVMATLCFFRFWLGFGIGGDYPLSATIMSEYANKKTRGAFIAAVFAMQGFGILTGGVVTLIVSAAFRAAFPTQAYQDAPLASTPAQADFVWRFILMFGAVPXLMTYYWRMKMPETARYTALVAKNAK

SEQ ID NO: 2776 - protein, 252 aa, Glycine max
MEDIGPNSCTRQVAEKKARPQEQLNCPRCSSTNTKFCYYNNYSLTQPRYFCKTCRRYWTEGGSLRNVPVGGGSRKNKRVTSSKVPPDLNPPSLSSVSAISSQNPKMQGVHDLNLAFPTAIDNYHGMSPYVEMPKLEIGGDHSTSHSHHHSPSAVELLRSGMASRGLNPYAPNSMMSTSDHSLYTTGYPMQEIKPNLSFSVDDGFGNRSYGVQENGGGRLLFPFGDIKHLSAGVEVEHNKERGNNSTGYWTGW

SEQ ID NO: 2777 - protein, 345 aa, Glycine max
MAHPTSSGQSHDLKKEDCKETRSLVVCFGEMLIDFVPTVGGVSLAEAPAFKKAPGGAPANVAVGISRLGGSSAFIGKVGADEFGYMLGNILKQNNVETSGMRFDSNARTALAFVTLRADGEREFLFFRNPSADMLLQESELDKDILKQARIFHYGSISLIDEPCKSAHLAAMSIAKNSGCILSYDPNLRLALWPSADSARKGIMDIWDQADVIKISEDEITFLTGGDDPYDDNVVLKKLFHPNLKLLIVTEGSQGCRYYTKAFKGRVAGVKVKPVDTTGAGDAFVSGILYCIASDQTIFQDEKRLRKALYFANVCGALTVTERGAIPALPTKEAILQFLLEAAVI

SEQ ID NO: 2778 - protein, 489 aa, ASPERGILLUS NIDULANS FGSC A4
MSTVVEEATRIARQFEYSPEQVQRGVKEYIREVEEGLSEEGTTLSQIPTFVTSVPNGTEKGLYLAVDLGGTNFRVCSIDLHGNHTFSLTQSKIMIPREMMTSGSAKELFLFLARQIESFLRIHHNEHFEAHLKRKIAGTAREEDLFDLGFTFSFPVRQLGINKGTLIRWTKGFDIPDAVGQDVCALLQNAIEELNLPVRVAALVNDTVGTLMARSYTSPGETGTFLGAIFGTGTNGAYVEKLNKITKMAKIEHSDYDKSTGEMIINAEWGSFDNHLSVLPTTEYDRQLDADSNNPGIQMFEKRVSGMFLGEILRLVLLDLHKSQGLFKPASGSDVFIPESSSLYRQWGIDTSLLSIVEADKSKDFEQVKSALKDHLKVERASENDCKAVQTVVHAIGKRAARLAAVPIAATLISTGKLKEELVDIGVDGSLVEFYPNFEGYMREAMREVPEVGDAGDKKVRIGISKDGSGVGAALIALVASKEGTKPPL

SEQ ID NO: 2779 - protein, 344 aa, Desulfitobacterium hafniense
MNELIVVKGEEKAQNIRTKAVRGTILTLIGGISWGFSGACGQYLFSVKGIDPHWVTVVRMLTAGLLLFCLVLFKYREQMVGLLSNKRDRRTLIVFSIFGLIACQYTYLLAISHSNAGTATVLQYLGPLLIMIFVCGMDRRLPTKTEGVAIALAVTGTFLLATHGNVSNLVISTQGLFWGLMAALGLMLYTIIPGKIINKWGSIVVTGCGMLMGGSILLVVIRPWQIPVSLDWQVFWGMLAIIVIGTVVSFTLYLQGVSDIGPVKASMIASVEPVSAALFSAFWLNTAFVWIDMVGFALIITTVILLTRQGSSRDSRHREQQLHGMLKTVVSTPYQLTICHQLLT

SEQ ID NO: 2780 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTASAIVFNPFSSDGGLGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDEWGPSQMETTFDVMSGLDMADTMVLFRNAVKQICRRRGYLASFMCKPKIEGFCASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 2781 - protein, 86 aa, Zea mays
MAKHHPDLIMCRKQPGIAIGRLCEKCDGKCVVCDSYVRPCTLVRICDECNYGSFQGRCTICGGVGISDAYYCKECTQQEKDRDGCP

SEQ ID NO: 2782 - protein, 559 aa, Methanosarcina acetivorans C2A
MLHKRFRRYSMLKRYGQIIEVLQKYGFGYIVDQIGLGSFGDFTSRLKKQEKRDEHNLSGPVRTRRILEELGPTYIKLGQLLSMRRDLVPLEYAAEFSKLQDDAPSFGFEEVELIIREELGLPVEDLFESFEKKPLACASIGQVHRAKLKNGDDVVVKVQRPGIKEVIESDLDIMYSLSRLLTEHIPEARLYRPVELVDELSRSILAEIDYSQEGWNTDRFAENFKDSEQIHIPKVYWDYTGTRVLTLEYIEGIKGGRVDLLEKQGFDRSAIALAVAGSFLKQVFEDGFFHADLHPGNILIMEDGIVAFLDFGMVGHLSSETRDMFLNGMTAMVKGDSSLFVEVLRDMGGIDSHVDTKVLKVDFDYFRSKYYGRALKNLDASVIIEELIEVLRKNQVKVPYNITLLVRGTLAVEGFGLIIDPDLNLAELVEPYAKNAIKESFYPQNIARVLYDNISSWSRIFQRAPTKISHILDNAENGYLGIKLESEETKRLISEINTASNRLSFSLIISAIIVASSLITQTNMKPLLWGVPLLGIFGFLLASIFGMWLIFNIFRTGRI

SEQ ID NO: 2783 - protein, 498 aa, Rhodobacter sphaeroides
MTLLTTEDYKAIAAGLTLPTGAFIDGRFRPAQSGATFETRNPATGQLLAEVAACGPADVDLAVQKARDAFEDGRWSRLPPRARKEVLIRLAKLLKRHARELAVMESLDSGKTIYDCETVDLPETIHCLTWHAELIDKIYDQTAPASDDHLALVLREPVGVVGLVLPWNFPLLMLAWKIGPALAAGCSVIVKPAEETPLTALRVAELATEAGVPPGVFNVLPGHGPEVGEPIGRHMDIDAVSFTGSTETGRRFLRYAAESNLKEVTLEMGGKNPAVVLDDAENLDRVAAHVVTGAFWNMGENCSAASRLIVQSGVKEALIARILAHAREWPMGDPLDPANRVGALVSPAHLDKVRSYLAEGPTVLLGGKAHGAFVEPTILEITDREAAPAREEIFGPVLSVLTVESFDEAIALANDTPYGLAASIFTANVKKALRGARALRAGTVTVNSFGEGDITTPFGGFRQSGFGGRDNGIHAHDQYTQLKTIWIDLADDAAEAVS

SEQ ID NO: 2784 - protein, 320 aa, Arabidopsis thaliana
MDSDFVPPSVSFQLPVIDFSDQNLKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIEKYIDEHLNSTYYLTRLMKYTSPPDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGRIAQSALHAFAAF

SEQ ID NO: 2785 - protein, 469 aa, Pantoea agglomerans
MSAEHVLSMMNEHEVKFVDLRFTDTKGKEQHVTIPAHQVNADFFEEGKMFDGSSIGGWKGINESDMVLMPDATTAVMDPFFEDSTLIIRCDILEPGTMQGYDRDPRSIAKRAEDFLRSSGIADTVLFGPEPEFFLFDDIRFGSSTSGSHVAIDDIEAAWNTGKEYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKGGQNLFAGDKYGGLSEMALFYIGGIIKHAKAINALANPTTNSYKRLVPGYEAPVMLAYSARNRSASIRIPVVASPKARRIEARFPDPAANPYLAFTALLMAGLDGIINKIHPGDAMDKNLYDLPPEEEAEIPKVAGSLEEALNALNEDREFLTRGGVFTDESIDAYIELRKAEMDRVRMTPHPVEFELYYSV

SEQ ID NO: 2786 - protein, 165 aa, Aegilops longissima
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 2787 - protein, 422 aa, Nicotiana tabacum
MAYNPNHMSQEMDMHHFSDENSAVLRSILPEQLAQSSPDVKPLDHQQPPTWLNSAILRQESHYTGTGGRGVGENFLNLHSNSESSAAASQASNQWLSRSILRRNVSDVQTSNNSSAVIAAADLKNDDGNNNNDNGNNNAGGQLTDSEVVGGGGTDGILNWQNAGYKAEILAHPLFEQLLSAHVACLRIATPVDQLPRIDAQLAQSQQVVAKYSTLGQNIGDDKELDQFLTHYVLLLCPFKEQLQQHVRVHAMEAVMACWEIEQSLQSLTGVSPGEGTGATMSDDEDDQVDSEANLFDGSLDGHDGMAFGLPTESERSLMERVRQELKHDLKQGYKEKLVDIREEILRKRRAGKLPGDTTSVLKAWWQSHAKWPYPTEEDKAKLVQETGLQLKQINNWFINQRKRDWHSNASSSTTSKSKRKR

SEQ ID NO: 2788 - protein, 62 aa, Brassica napus
MRGILVDWLVEVAEEYTLVPDTLYLTVYLIDWFLNGNYVERNRLQLLGVTCMLIASKYEEIY

SEQ ID NO: 2789 - protein, 120 aa, Triticum aestivum
  unsure (1)..(120): unsure at all Xaa locations
KMLQCRVFAYADTQRYRLGPNYLMLPVNAPKCGFKNNHYDGAMNFMHRDEEVDYYPSRHAPLRXAXPXXFPXXTRPVVGKRGEDKDQEGRKFXKPGXRXQXGPEXKXXFFXXAERFANPR

SEQ ID NO: 2790 - protein, 444 aa, Bacillus subtilis
MAKYTREDIVKLVKEENVKYIRLQFTDILGTIKNVEIPVSQLEKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKDGVNAFYDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 2791 - protein, 553 aa, Zea mays
  unsure (1)..(553): unsure at all Xaa locations
MARRAASSLVSRCLPXRGPLAGAAAPLPPSALRRTVPADGMHRLLPGVLQRFSTXAAAVEEPITPSVHVNYTKLLINGNFVDSXASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMFAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFNKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 2792 - protein, 637 aa, Oryza sativa
  unsure (1)..(637): unsure at all Xaa locations
MLCIAKTASCILYSFAVSAQRNSSPALISADEPWSSIIGHLSEKDRYLKTVKGILNKLTXPEKFDLLKGXQLMESGITTADILXKDVISLIFVRTHFDNNVLPFYAILWVYLNEKLPSFPXSEEPGGKEITFKRVLLNNCQEAFEGAESLRAEIAKLTGPDQEMERRDKERIVKLRTLGNIRLIGELLKQKMVPEKIVHHIVQELLGSGPDKKACPEEENVEAICQFFNTIGKQLDENPKSRRINDTYFIQMKELTTNLQLAPRLRFMVRDVVDLRSNNWVPRREEIKAKTISEIHDEAIKTLGLRPGATGLTRNGRNAPGGPLSPGGFPMNRPGTGGMMPGMPGTPGMPGSRKMPGMPGLDNDNWEVPRSKSMPRGDSLRNQGPLLNKPSSINKPSSINSRLLPHGSGALIGKSALLGSGGPPSRPSSLMASPTHTPAQTAPSPKPVSAAPAVVPVTDKAAGSSHEMPAAVQKKTVSLLEEYFGIRILDEAQQCIEELQCPEYYSEIVKEAINLALDKGPNFIDPLVRLLEHLHTKKIFKTEDLKTGCLLYAALLEDIGIDLPLAPALFGEVVARLSLSCSLSFEVVEEILKAVEDTYFRKGIFDAVMKTMGGNSSGQAILSSHAVVIDACNKLLK

SEQ ID NO: 2793 - protein, 78 aa, Glycine max
  unsure (1)..(78): unsure at all Xaa locations
VSMGDKGFIKPLLEKRGKVHFDKVCIKPGKPFTFAEIDFQSTESTILAFGLPGNPVSSLVCFHLCXVPAIRYPAGWTN

SEQ ID NO: 2794 - protein, 247 aa, Zea mays
MSAAEPEAHAASDGFDRRRRELQAFDDTKAGVKGLVDAGVTAITAIFRHRPAGVPGGDDLVPAAAAGIIPVIDLAAAPRQEVAARVRRAAETAGFFQVVNHGVPRELMAAALAGVRRFNEQQAEAKRRFYTRDTARKVRFTSNYDLFQSAAASWRDTLFCELAPDPPRPEELPEAVRGAMLEYGDAATELALRVLELLSESLGLPSDHLREMGCARSLNVASHYYPPCPEPHLTLGTSRHADATFLT

SEQ ID NO: 2795 - protein, 196 aa, Neisseria meningitidis Z2491
MLLFIDNYDSFTYNIVQYFTELGQEVAVRRNDDITLEEIEALNPQYLVIGPGPCSPKEAGISVAAMRHFAGRLPIMGVCLGHQTIGEAFGGRIVRAKTLMHGKVSPVYHSGKGMFKGLPNPVTCTRYHSLVIERGTLPECLEITAWTEDGEIMGVRHKEYAVEGVQFHPEALLTEYGHDMLNNFLIEFQNFKPQKI

SEQ ID NO: 2796 - protein, 434 aa, Elaeis guineensis
GTRDKGGAFLSFSFFHSLPPLSLSPKGEKRKEERRRKEERAMASMVAFRPEAFLCFSPPKTTRSTRSPRISMASTVGPSTKVEIPKKPFMPPREVHVQVTHSMPPQKIEIFKSLEDWAENNILVHLKPVEKCWQPQDFLPDPSSEGFHEEVKELRERSKEIPDGYYVCLVGDMITEEALPTYQTMLNTLDGVRDETGASLTSWAVWTRAWTAEENRHGDLLNKYLYLSGRVDMKQIEKTIQYLIGSGMDPRTENSPYLGFIYTSFQERATFISHGNTARHAKEHGDVKLAQICGTIASDEKRHETAYTKIVEKLFEIDPDGTVLSFADMMKKKISMPAHLMYDGQDDNLFEHFSAVAQRLGVDTAKDYADILEFLINRWKVGELTGFSGEGKRAQDFVCTLAPRIRRIEERAQERAKQAPRIPCSWIYGREVQL

SEQ ID NO: 2797 - protein, 474 aa, Burkholderia fungorum
MKTYEQLYIDGKWIAPCGTGTIDVIDSGTEEIMGRIPEGVEADAESAIAAARVAFDAWAATPAAERGEYLRKVAANLKARTDELAGLIAGEVGMPLKLARAIQVGSPVYNWGAYAKLASEFQYEERVGNSLVVREPVGVVAAITPWNYPLNQVTLKVAAALAAGCTVVLKPSEIAPLTAFVLAEAIHEAGLPAGVFNLVSGYGPVVGEVLASHPSVDMVSFTGSTRAGKRVSELASATVKRVALELGGKSASVILDDADFAAAVKGTVSACFLNSGQTCSAHTRMLVPEARYDEARVLAKQAAETYVAGDPRNETSRLGPLASAAQQARVQQYIAKGIEEGAELVTGGVGLPDGLSKGFFVKPTVFGRVHPKATIAQEEIFGPVLSILTYKDEEEAVRIANDSPYGLGGAVWAGSDERAVGIARRIRTGQVDINGGTWNMAAPFGGFKQSGFGRENGVYGLEEYFELKSMQFRV

SEQ ID NO: 2798 - protein, 274 aa, Zea mays; identical to SEQ ID NO: 1814

SEQ ID NO: 2799 - protein, 391 aa, Hordeum vulgare
MERVFSVEEIPDPFWGQPSPRQRGRRPPEGAMNRCPSEWYFQKFLEEAVLDSPAADPSPMSGASGRGQAACRPRGVAGTATGPAVDPVEYNAMLKQKLEKDLAAVAMWRASGAMPPERFAASPSCPNADGQHIGTINPIGGNVVPLQNKLAGGASGVSGPHLVQNADALVKQAASSSSREQSEDDDMEGEDEITGNGVPTDQRLRRRKQSNRESARRSRSRKAAHLNELEAQVSQLRVENSSLLRRLADVNQKYNGAAVDNRVLKADVETLRAKVKMAEDSVKRVTGMSALFPAGSDMSSLSMPFTGSPSEATSDAAFPDDLSAYFSTSEAGGNNGYMPEMASSAQEDDNFLNETMDTSKMGRPDSLHRVASLEHLQKRMCGGPASSGSTS

SEQ ID NO: 2800 - protein, 178 aa, Zantedeschia aethiopica
MASSMMVSTAAVSRTSPAQSNMVVPFAGLHSSAAFPVTRKFADSSKLPSNGLRVRCMQVWPPEGKKKFETLSYLPPLTREQLGQEVDYLIRNGWIPCIEFCKVGFVYREYHNSPGYYDGRYWTMWKLPMFGCTDSSQVLKEVDECSKAYPDYFNRIIGFDNTRQVQCISFLTYKPEGN

SEQ ID NO: 2801 - protein, 489 aa, Escherichia coli O157:H7 EDL933
  unsure (1)..(489): unsure at all Xaa locations
MVSETKTTEAPGLRRELKARHLTMIAIGGSIGTGLFVASGATISQAGPGGALLSYMXIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 2802 - protein, 382 aa, Corynebacterium glutamicum ATCC 13032
MTATYTTETAINFLFLSEPDMIAAGVKDVAQCVDVMEETLVLLAQGDYKMAGLNSNSHGAMITFPENPEFEGMPKDGPDRRFMAMPAYLGGRFKNTGVKWYGSNAENKASGLPRSIHTFVLNDTVTGAPKAIMSANLLSAYRTGAVPGVGVKHLAVADATTLAVVGPGVMAKTITEACIAERPGITTIKIKGRSERGINAFATWALEKFPEIEVVAVGSEEDVVKDADIVIAATTTDAAGSSAFPYFKKEWLKPGALLLLPAAGRFDDAYLLDDARLVVDYMGLYEAWAEEYGPQAYQLLGIPGTHWYDLALQGKLDLAKISQIGDICSGKLPGRTNDEEIILYSVGGMPVEDVAWATQVYENALEKGVGTTLNLWESPALA

SEQ ID NO: 2803 - protein, 501 aa, Arabidopsis thaliana
MSCSATDLAVLLGPNATAAANYICGQLGDVNNKFIDTAFAIDNTYLLFSAYLVFSMQLGFAMLCAGSVRAKNTMNIMLTNVLDAAAGGLFYYLFGYAFAFGSPSNGFIGKHYFGLKDIPTASADYSNFLYQWAFAIAAAGITSGSIAERTQFVAYLIYSSFLTGFVYPVVSHWFWSVDGWASPFRTDGDLLFSTGAIDFAGSGVVHMVGGIAGLWGALIEGPRLGRFDNGGRAIALRGHSASLVVLGTFLLWFGWYGFNPGSFNKILVTYETGTYNGQWSAVGRTAVTTTLAGCTAALTTLFGKRLLSGHWNVTDVCNGLLGGFAAITGGCSVVEPWAAIICGFVAALVLLGCNKLAEKLKYDDPLEAAQLHGGCGAWGLIFTALFAQEKYLNQIYGNKPGRPHGLFMGGGGKLLGAQLIQIIVITGWVSATMGTLFFILKKMKLLRISSEDEMAGMDMTRHGGFAYMYFDDDESHKAIQLRRVEPRSPSPSGANTTPTPV

SEQ ID NO: 2804 - protein, 344 aa, Bacillus anthracis str. Ames
MGEKMLGIINATGSFPSLKKVTGHRSLAALPFGGRYRLIDFMLSNMVNSNIHSVAVFTSHKNRSLMDHVGSGKQWDLDRKRDGLFLFPPNCQCDQDEFGSFAHFRRHIDYFLRSREEYVVITNSHLVTALNFQAVLERHIHTAADITEVCHEGVSLQTYVLKKQLLLDLFEAYKDMEQYSLFDVVREKRGKSLHIATYEHTEYVAIIDSIESYYKHSLEILQPAIWKQVFKKEAPIFTKVKDEPPTRYVKGAAVKNTMIANGSIIEGEVENSVVSRSVKIGKGSIVRNSIIMQKSQIGDNCIIDGVIIDKDVKIGDGVVLKGNADEPYVVEKGSVQNSTINSYS

SEQ ID NO: 2805 - protein, 517 aa, Zea mays
  unsure (1)..(517): unsure at all Xaa locations
MASLWLARASSQLARRAAARRPPPRPARHGSGQPTSSWFLGSVPQAALGSPALDTSRRGFCSVRRFAGESSAAAAAAAVVDEEPESGFAAGDQQAVDFPGGKVSFVAEMNFLPESTRERINCYRVLDDDGRTISGSRFQEVSRELALKMYSEMVTLQIMDTIFYEAQRQGRISFYLTSNGEEAINIASAAALSMDDIVLPQYREPGVLLWLGLTGQVLANQCFGIKLDYGKGRQMPIHYGSNRLNYFTVSSPIATQLPHAVGAAYSLKMDKKDACAITYFGDGGTSEGDFHAALNFAAVMEAPVIFFCRNNGWAISTPTTEQFRSSNSVSSYTDPWQLQVNNAMSCXNSSRVAGDGVVIRGQAYGIRGIRVDGNDALAVYSAIHAAREMAVTEGRPILVEALTYRVGHHSTSDDSTKYRPVDEIEHWRTARDPISRYRKWVQGNDWWSDAEESELRSRVRKELLQAIQVAERMPKPPVTELFTDVYDKIPSNLHEQEQLLRDTIMRHPADYPTDVPV

SEQ ID NO: 2806 - protein, 639 aa, Clostridium perfringens str. 13
MRMTTGQALVKFLDNQYVSFDGKEEKFVDGIFTIFGHGIVVGLGEALYENPGELKVYQGRNEQGMAHVSTAFAKQNNRRKIIACSSSVGPGAANMVTAAATATVNNIPLLLLPGDSFATRQPDPVLQQIEQSYNLGITTNDAFKPVCKYWDRINRPEQLMSAMINAMRVLTDPAETGAVCIALPQDVQGEAYDFPEYFFKKRVHRITRPLAVQEEFEEALDIIMNKKKPIIICGGGVRYSEAGEALVDFAEEFNIPICETQAGKSAIKSSHPLNLGGIGVTGNLAANMIAKDTDLVIGVGTRFSDFTTSSKSLFKNPEVDFITVNVSKFHGGKMDAHKIIGDAKVCIEELQAMLEANNYESSYEDEIVNAKKAWKEEMKRLTNIKYDENFEALIKPKREGCIEEFSVLTGGLITQTAALGVIRETIDDDAIVVGAAGSLPGDLQRMWETDARDSYHMEYGYSCMGYEIAATLGAKLAEPEREVYSMVGDGSYLMLHSEMVTAMQEQKKINILLFDNCGFGCINNLQMSNGIGSLATEFRYRDENGKLEGGLIPIDFAKVASGYGLKTYSVKTLAQLKEALEDAKKQKVSTLIDIKVLPKTMTDGYDAWWHVGIAGESEIDGVNKAFENKEKNLKAARRY

SEQ ID NO: 2807 - protein, 375 aa, Arabidopsis thaliana
MPLSLQSPPCATLSASIQKGRWKTLAAGFSVTPLPAVNFSLRRSIPRILASASSSSSPASSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHERLLFKIPATWQGIEAARLLESEGIQTHITFVYSFAQAAAAAQAGASVIQIFVGRLRDWARNHSGDNEIESAIKSGEDPGLALVKRSYNYIHKYGYKSKLMAAAVRNKQDLFSLLGVDYVIAPLKVLQSLKDSPAIPEDEKYSFVRKLTPETATHYHFTNKELVKWDQLSLASSMGPASV

SEQ ID NO: 2808 - protein, 437 aa, Saccharomyces cerevisiae
MAVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 2809 - protein, 127 aa, Zea mays
SATFSVKVGLAQMLRGGVIMDVVTPEQARLAEEAGACAVMALERLPADIRAQGGVARMSDPALIRDIKSAVTIPVMAKGRIWHFVKAQILEAVGAVMIRTKVEADTNNVVQAVRHVRSVMGDVRALR

SEQ ID NO: 2810 - protein, 161 aa, Zea mays
  unsure (1)..(161): unsure at all Xaa locations
AGGGGFFFFFLLFPRAASFGGRCCPLSVLLFPARALFGSRRSPSAXVYLGGGGGLFFAAVPLGASSGVCDALALRALGXTRSLGKGVSLAVERFLSPVAPALVSWRRCVVVRVLFVPLLIAMGGSGNTSKFGASAVLGVSLAVCRAGAVVKXCPLYRRIAD

SEQ ID NO: 2811 - protein, 601 aa, Haemophilus somnus 129PT
MVAEGANPLVSVVTLLAAAVVAVPLFKRLGLGSVLGYLAAGLVIGPFGFGLFTDPEGIIHIAELGVVMFLFIIGLEMKPSHIWGLRNHIFLLGAFQITLCTSALTYIATLFGFDWKVAFVAASGFVLTSTAIVMQELSERNDLTSPRGQRIISILLFEDLLIVPLLAFVAFLSPDKVTSTDPLWHKIAISGGAFAVLVAAGLWLLNPLFKILAKTKTREVMTAAALLVVLGSALLMEEGGLSMAMGAFVAGVLLSESSFRHQLEADIEPFRGLLLGLFFLGVGMSLDLSVVAENWFLIIFGVLVFMLVKGFIIYLIALITKTGNANSIDRAFIMAQGGEFAFVLFSSAASQNVISKEMQANMTAIVVLSMILTPLFIIAQKKYIIPRLKPTQPERKADHIDEQHPTILIGLGRFGQVVNRMLVMTGHHPTIIDKDANLIAGMKKLGIKCYYGDAARPELLHAAGVENAELLIVAIDNSEQTLQIVEQARKMNPQIKIIARAHDRIHVYNLYGAGANIQIRETFDSALRTSKQALLSLGMNEDIVAEIGDVYFRKDCHSVKLMAEVYDPKLSRFENKELIQIALDVDQEMMAEIQQIMKKEH

SEQ ID NO: 2812 - protein, 317 aa, Zea mays
LGPSRPAKKKKTLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCIFEGAVIEDSLLMGADYYETENDKNVLFETGGIPIGIGKNSHIRKAIIDKNARIGENVKIINFDNVQEAVRETEGYFIKSGIVTVIKNALIPSGTII

SEQ ID NO: 2813 - protein, 372 aa, Eremothecium gossypii
MAAVKRIVVLPGDHIGREVVEEAVKVLGAVEQSLSDVHFDFQYHLVGGAAIDATGSALPDEALGAAKEADAVLLGAVGGPKWQGGAVRPEQGLLKLRQELGVYANLRPCNFAADSLLELSPLRPEIARDTDIMVVRELLGGSYFGERHEDEGDGVAWDTDKYTVKEVQRIARMAGFLALQHDPPLPVWSLDKANVLASSRLWRKTVEETFQSEFPNVQLQHQLIDSAAMILVKNPRAFNGVVVTSNMFGDIISDEASVIPGSLGLLPSASLASLPDSKSAFGLYEPCHGSAPDLPAGKANPIGCILSAAMMLKLSLNMVAAGEAVEQAVQEVLDSGVRTGDLLGSSSTSEVGDAIALAVKEALRRQSAAGLS

SEQ ID NO: 2814 - protein, 330 aa, Staphylococcus aureus subsp. aureus Mu50
MIDYKSLGLSEEDLKVIYKWMDLGRKIDERLWLLNRAGKIPFVVSGQGQEATQIGMAYALEEGDITAPYYRDLAFVTYMGISAYDTFLSAFGKKDDVNSGGKQMPSHFSSRAKNILSQSSPVATQIPHAVGAALALKMDGKKKIATATVGEGSSNQGDFHEGLNFAGVHKLPFVCVIINNKYAISVPDSLQYAAEKLSDRALGYGIHGEQVDGNDPLAMYKAMKEARDRAISGQGSTLIEAVTSRMTAHSSDDDDQYRTKEEREALKKADCNEKFKKELLSAGIIDDAWLAEIEAEHKDIINKATKAAEDAPYPSVEEAYAFVYEEGSLN

SEQ ID NO: 2815 - protein, 162 aa, Daucus carota
MDLRFMGIDHPLFDTLYHILDDDEHDTTDTGNTKRNKSRHERRYVRDAKAMATTAADVKEYPNAYLFVVDMPGLKSGDIKVQVEDGNVLVVNGERKREEEEGVKYLSMGRKVGRFLKKFVVPENANLENIKAVCQDGVLSVTVEKLPPPEPKKPKTIEVQIA

SEQ ID NO: 2816 - protein, 85 aa, Glycine max
  unsure (1)..(85): unsure at all Xaa locations
MASSMISSPAVTTVNRAGAGMAAPFTGLKSMAGFPSXKTNDDSTSIATNGGXVQCIHVWPPIGNTKFETPSDLPDLDDAQVAKEI

SEQ ID NO: 2817 - protein, 181 aa, Zea mays
  unsure (1)..(181): unsure at all Xaa locations
LNHNGSYQVPSVQQPRHDGDDDERGRSCVERQRGADCGASRSHPAGGLPPDREGGALRCAHHNNHYDGAMNFMHRDEEVDYYPSRHAPLRXAAPPTPCRQPVAGRREKATIRKPNDFKQPGERYRSWDADRQDRFVRRFADSLGHPKVSQELRSIWIDLLAKCDASXXMKIATRLNMKANM

SEQ ID NO: 2818 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 2819 - protein, 390 aa, Trichodesmium erythraeum IMS101
MHLSKRLKPLSFNVFADMDRAKGRAKAAGQDLIDLSLGSSDLPAPRHALEAISQSLQDSNTHGYSLFSSTQAFREAVARWYSNKFDISLNPETEVLALIGSQEGTAHLPLAILDPGDFALLQDPGYPSHSGGVYLAGGQVYPMPLLAENKFLPVLGDIPQHVLAQAKMMILSYPHNPTTAIAPISFLQEAVAFCQKHNLVLVHDAPYLDFVFNSSSEAPSIFQADVEKSVSIEFFTMSKSYSMGGFRVGYAIGNAQLIQALRQVKACIDFNQYRGIFNGAIAALTGPQEVVRKTVDIFRQRRDIFIEALDNIGWTVPMPSATMYVWTKLPKLWSNDSVDFCVDLVENTGVAVAPGAGFGKAGEGYVRFALVHRPEVLSRAVEKISVFLQR

SEQ ID NO: 2820 - protein, 292 aa, Solanum demissum
LNSSYRVPFESFRVPFVDLQEATNNFDEKFRIGVGIFGKVYRGVSRDGTKVALKRRNRESPQGIEEFQAEIEILSFCSHPHLVSLIGYCDERNEMILVYEYMENGNLSSHLYGSDLRLPTMSWEQRLEICIGAARGLHYLHNSAVIHRDVKSTNILLDENFVAKITDFGISKTMSELDQTHLSTTVKGSIGYIDPENFIRRQLTEKSDVYSFGVVLFEVLCARPAIVQSLPRETVCLAEWAVDSHNKGQLEQIIDPNLAAKIRPESLRKFGETAVKCLALSSEDRPSMGDVL

SEQ ID NO: 2821 - protein, 125 aa, Cicer arietinum
PKCAHHNNHHEGFMNFIHRDEEVNYFPSRHDPVRHAERFPTPPAALSGKRERCIRPKENNFKQPGERYRTWAPDRQDRFARRWIEALSDPRVTHEVRSIWISYWSQADRSLGQKIASHLNMRPSI

SEQ ID NO: 2822 - protein, 453 aa, Sarcothalia circumcincta
QETDVLALFRVSPQPGVDPIEASAAIAGESSTATWTVVWTDLLTACDLYRAKAYKVDAVPNTSDQYFAYVAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERFLYSMEGVNRAIAAAGETKGHYLNVTAATMEQIYERAEFAKQLGSIIVMVDLVIGYTAIQSMAIWARKNDMILHLHRAGNSTYSRQKIHGMNFRVICKWMRMAGVDHIHAGTVVGKLEGDPLMIRGFYNTLLLPYLEINLPQGIFFEQDWASLRKVTPVASGGIHCGQMHQLLDYLGDDVVLQFGGGTIGHPDGIQAGATANRVALESIVIARNEGRDYVTEGPQILQDAAKTCGPLQTALDLWKDISFNYTSTDTADFVETPTANV

SEQ ID NO: 2823 - protein, 882 aa, Xylella fastidiosa Ann-1
MPLPIAAPLTLATALILLLATTPTTAAPSPEQHAAALVAQMTRQEKIAQTMNAAPAIPRLGIPAYDWWSEGLHGIARNGYATVFPQAIGLAASWNTDLLQHVGTVTSTEARAKFNLTGGPGKDHPRYAGLTLWSPNINIFRDPRWGRGMETYGEDPYLTGQLAVSFIRGLQGDTPDHPRTIATPKHFAVHSGPEQGRHSFDVDVSAYDLEATYTPAFRAAIVDGHAGSVMCAYNALHGTPACASDWLLNTRLRNDWGFNGFVVSDCDAIEDMTRFHFFRQDNASASAAALKSGDDLNCGNTYRDLNQAIARGDIDESTLDQALIRLFTARQRLGTLQPREHDPYAAIGIKHIDTPAHRALALQAAAQSLVLLKNSGNTLPLPPETTLAVLGPDADSLTALEANYQGTSSTPVTPLTGLRTRFGTAKVHYAQGASLAPGVPSTIPETALRNHGHPGLKGEYFDTIDFSGAPHLVRQDRIIAFNWDHIAPAPGMNPHRYAVRWTGELLPPGPGTYTFAVHVARCFDCNGHDPIRLYIDDRQIIPDNATAAQATTAPQQTDNTHLEATLHFTDTRPHHIRLDMEHRGEDQGVRLEWLAPAAPQLAEAERAVAHADAIVAFVGLSPEVEGEELHIDTPGFSGGDRTTIDLPATQETLLQHVKTTGKPLIVVLMSGSAVALNWAQHHADAILAAWYPGQSGGTAIAQALAGDVNPGGRLPVTFYRSTQDLPPYISYDMTGRTYRYFKGQPLYPFGYGLSYTQFAYEAPQLSTATLKAGNTLTVTAHVRNTGTRAGDEVVQLYLEPPYSPQAPLRSLVGFKRVTLRPGESRLLTFTLDARQLSGVQQTGQRSVEAGHYHLFVGGGQPNTGAPGGTAAFSIIGRAMLPK

SEQ ID NO: 2824 - protein, 431 aa, Buchnera aphidicola str. Bp (Baizongia pistaciae) [sequence omitted]

SEQ ID NO: 2825 - protein, 330 aa, Oryza sativa (japonica cultivar-group)
MSFGAVDVDDGGAAATAAASGGEEVRAMPAEVSWEMLDKSRFFLLGAALFSGVSAALYPAVVLKTHLQVSPPPAAAASTTAAAILRRHGPRGFYRGFGASLAGTVPARAVYMAALEATKSAVGSAAVRLGVAEPAASAAASAAGGVSAAVAAQVVWTPVDVVSQRLMVQTAAAGPPYRGGADALRRILRADGVRGLYRGFGVSVLTYAPSSAAWWASYATAQRLIWRALGPAHHDSRASVVAVQGASAAAAGGAAALVTMPLDTVKTRLQVMDGGGASLASEARALVREGGWGACYRGLGPRWASMSLSAATMVTAYEFLKRLSTKDTSL

SEQ ID NO: 2826 - protein, 294 aa, Escherichia blattae
IVFRAAQERSDIEIVAINDLLDAEYMAYMLKYDSTHGRFNGTVEVKDGHLIVNGKKIRVTAERDPANLKWNEAGVEVVAEATGLFLTDETARKHITAGAKKVVMTGPSKDSTPMFVRGANFDTYAGQDIVSNASCTTNCLAPLAKVVNDNFGIVEALMTTVHATTATQKTVDGPSHKDWRGGRGASQNIIPSSTGAAKAVGKVLPELNGKLTGMAFRVPTPNVSVVDLTVRLAKPATYEEIKKAMKAASEGAMKGVLGYTEDDVVSTDFNGETCTSVFDAKAGIALNDNFVKLV

SEQ ID NO: 2827 - protein, 362 aa, Helianthus tuberosus
MESGGDGGGTSSCLMSFGDTNNNINNSSSNNNNSNNNIGSLCLPPNPPGAYNTTTNNNNLIFSDHHPSAMMLEDNNININDGVGLAFMNPSSSVKAKIMSHPHYPRLLSAYLNCQKIGAPPEVVERLEEACRASVVAAMSSRSGGAGTSDGSGGGMNMIIGQDPALDQFMEAYCEMLIKYEQELSKPFKEAMLFLSRMESQFKAITFSNSDSGCGEGGMDRNGSSEEELDVDMNNGMVDPQAEDRELKGQLLRKYSGYLGSLKQEFMKKRKKGKLPKEARQQLLDWWTRHYKWPYPSEAQKLALAESTGLDQKQINNWFINQRKRHWKPSEDMQFVVMDAAHPHYFIDNIFGNPYPMDVSLL

SEQ ID NO: 2828 - protein, 194 aa, Cicer arietinum
EYKPEFDIVSNASCTTNCLAPLAKVINDRFGIVEGLMTTVHSITATQKTVDGPSAKDWRGGRAASFNIIPSSTGAAKAVGKVLPVLNGKLTGMAFRVPTVDVSVVDLTVKLEKAATYDEIKAAINEESEGKLKGILGYTEDDVVSTDFIGDTRSSIFDAKAGIALNDRFVKLVSWFDNELGYSTRVVDLIVHIA

SEQ ID NO: 2829 - protein, 176 aa, Triticum aestivum
MASHGSHPTLLEHMGRTGAPADLAVLVAHIQAACKRIAALVASPGNADLSRAKPAAAGAASAAGRDAPKPLDELSNEIILSSLQSSGKVAVVASEENDLPVWLCDDGPYVVVTDPLDGSRNIEVSIPTGTIFGIYDRLVELDQLPVEEKAQLNSLQSGSRLVAAGYVLYSSATIFC

SEQ ID NO: 2830 - protein, 592 aa, Saccharomyces cerevisiae
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 2831 - protein, 538 aa, Amanita muscaria
MASEELEKQSPVYDKPGPEAESLQGVANDGLSRQLKNRHIAMISIGGVIGTGLFLGTATALRNGGPVGMLLGYALMGLICFCVMISLGEMVAFLPIPGGHIKLAERFVDPAFSFTMGWNYWYNWSIVLPAELSASSVIVGFWNHNINPAVWVIICLVVVVTINMLGAGVYGEAEFWFASIKVITITGLIILGIVLDLGGGPNHDRLGFRYWKNPGPFVQFGGISGTTGQFLGFWAVLTQAAFSYIGTEIVAIAAGETKNPRRNLPRAIKRVYIRILLSYICGTLIIGLLVPSNDSGLNLGDGTAASSPFVIAIERAGINSLPHIINACLLTSAWSAASSDLYTSSRALFGLAVSGNAPKIFLTTTSSGLPYVSIAFECMLLRLLAFMATSSGAGKVFGWFANMTAIAGLMTWFGICVSYIRFYNALKVQGYDRKTLPFSSRLQPFAAYFAAGFILVACFFSGFAVFLKGKWATDTFVTNYLPFVLFPIMYGLARLYYKQGPKPYDEIDLVTGLKEIEQQTYDEPPPNNFLERVWQWVM

SEQ ID NO: 2832 - protein, 181 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 2833 - protein, 350 aa, Streptomyces avermitilis MA-4680
MIHRRCVGGRRNHGGRVAQGSSRSRLPQQGTPVTMSSTSSTPPWNVQRLPGADGRVFLVTGGNAGIGYFVAEQLSATGATVVLGSRNPAKAEAATASIRARVPGSRVRAVRLDLADLSSLETAVESLEVERLDAVVHNAGVALDDPPREETGDGHELMFGTNHLGHFALTQWLMPLLSAAPAARVVTMGSFAAKSERLDLDDLQSRKDYQPKRTYGRSKLAQMYFGVELDRRLRAAGSTVASVVVHPGGALDSLTPSRPPVHVRSTGARLSAAPAALLLQGKHAGAWPAVRAVLDPAVRGGQLWGPRVFGLRGEPRREPVWDHLADPSVAARLWDASCDLMGTDLSTISG

SEQ ID NO: 2834 - protein, 488 aa, Corynebacterium efficiens YS-314
MIAGSATARVVSLSIITKAVNTRTARMSTTGLGMTVLSGLVLVEVMVDRGSFHVTGGWDLSRLMRPGDPISVPTIPFRSQPGHKAGPTVDIPALLPVPRKTVAIRDSQAHNYRMEHSRPTGPMGSTEPTPQSTDTSSPAPEDPADPPEAPDQPTHSPSWLLALGALGVVFGDIGTSPLYALHTAFSMEHNAVTIAPDNVYGLAVTGNLLLVTVLFSLFAARVWHWAAWRISLFAVIMGSVEIWLFSASATKLFDGGWLPLLIALILMVVMTTWESGSRHVARTRRALEGPLHQFMASLPHRQIRRVPGVAVFPHASAGTTPLALVKFVTDFHILPGHVVIVRIIHENVPHIQPGDRITVDEVGSASDGIVHVGIRVGFTDDQDIPRNLALAVDTTPELTIDLEQASYVLSVLTLRPSRVSRLRDWRQRLFLSLEKNQANRTEIFHPPTHPHHCAGHRTASVIHPELWERRNPPCGPPTVHRAGLAHRV

SEQ ID NO: 2835 - protein, 162 aa, Zea mays
VGLNQPAEVLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 2836 - protein, 496 aa, Methanosarcina mazei Goe1
MSEQRSVPLREHLLALKPCRHGGLIQETSETYGIPENEILDFSANFNPLGSPFDYPENGLNFEDIIKKSCGKLLEYPDNRYVEFREAAARFVGLGVTPQSIVPGNGSTEIVRLVVESVIEKGDKVLLPWPTFGEYEMQCRITGAEPVCPSQEEVNTLPDEVLEEAKILFICNPNNPTGKLRTREELKVLAERCREHKTLLYVDEAFIELSDPSQSVADLPAENNYVFVMRSLTKDFAIPGIRMGFGIAPPAMADILNTARLSWNLGAIANNTGIALLNIEGGIDSPYLKKAREMILKEGETLKAKIDRIRGFEAGEVNVNFILVDVSKFMLNSSELTARLAARGVLVRDCVSFHGLGKNYIRVAVRTEKENDRLIAAIGDVITEWGREQAKNELQHVIEKASEEGIGGRKTCEYYPCHFEGQNCTFCFCPFYPCENEKTGGKWIQSSRGGRVWSCVDCHLVHKKEIAQKILDCLMHEGDTDELVKVAWKEVMEPIL

SEQ ID NO: 2837 - protein, 242 aa, Glycine max
MGRGRVELKRIENKINRQVTFAKRRNGLLKKAYELSVLCDAEVALIIFSNRGKLYEFCSSSSMLKTLERYQKCNYGAPEDNVATKEALVELSSQQEYLRLKARYEALQRSQRNLMGEDLGPLSSKELESLERQLDSSLKQIRSIRTQFMLDQLSDLQRKEHFLGESNRDLRQRLEEFQINPLQLNPSAEDMGYGRHPGQPQGHALFQPLECEPTLQIGYHPDPVSVVTEGPSMNNYMAGWLP

SEQ ID NO: 2838 - protein, 516 aa, Thermus thermophilus
MTVEPFRNEPIETFQTEEARRAMREALRRVREEFGRHYPLYIGGEWVDTKERMVSLNPSAPSEVVGTTAKAGKAEAEAALEAAWKAFKTWKDWPQEDRSRLLLKAAALMRRRKRELEATLVYEVGKNWVEASADVAEAIDFIEYYARAALRYRYPAVEVVPYPGEDNESFYVPLGAGVVIAPWNFPVAIFTGMIVGPVAVGNTVIAKPAEDAVVVGAKVFEIFHEAGFPPGVVNFLPGVGEEVGAYLVEHPRIRFINFTGSLEVGLKIYEAAGRLAPGQTWFKRAYVETGGKNAIIVDETADFDLAAEGVVVSAYGFQGQKCSAASRLILTQGAYEPVLERVLKRAERLSVGPAEENPDLGPVVSAEQERKVLSYIEIGKNEGQLVLGGKRLEGEGYFIAPTVFTEVPPKARIAQEEIFGPVLSVIRVKDFAEALEVANDTPYGLTGGVYSRKREHLEWARREFHVGNLYFNRKITGALVGVQPFGGFKLSGTNAKTGALDYLRLFLEMKAVAERF

SEQ ID NO: 2839 - protein, 340 aa, Ginkgo biloba
MSSTGKIKIGINGFGRIGRLVARVALLRDDIELVAVNDPFISTDYMTYMFKYDSVHGQWKKHEVKVKDSNTLLFGEKAVTVFGCRNPEEIPWGETGVEYVVESTGVFTDKEKAAAHIKGGAKKVVITAPSKDAPMFVVGVNEHEYKPDLAIVSNASCTTNCLAPLAKVINDRFGIVEGLMTTVHSITATQKTVDGPSNKDWRGGRGAGFNIIPSSTGAAKAVGKVLPALNGKLTGMAFRVPTPDVSVVDLTVRLEKPASYDEIKAAIKEESEGKLKGILGYTEDDVVSTDFIGDNRSSIFDAKAGIALSDNFVKLVSWYDNEWGYSSRVIDLIVHMASTV

SEQ ID NO: 2840 - protein, 463 aa, Streptococcus pyogenes M1 GAS
MTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 2841 - protein, 424 aa, Chlamydia muridarum
MFDVVISDIEAREILDSRGYPTLYVKVITNTGIFGEACVPSGASTGIKEALELRDQDPKRYQGKGVLQAVANVEKVLLPALQGFSVFDQITADAIMIDADGTSNKEKLGANAILGVSLALAKAAAATLERPLYRYLGGAFSHVLPCPMMNLINGGMHATNGLQFQEFMIRPISAPSLTEAVRMGAEVFHTLKKILQNRQLSTGVGDEGGFAPQLASNSEALDLLLAAIEKAGFIPGEDISLALDCAASSFYNTQDKTYDGKSAADQVAVLTELCDRYPIDSIEDGLAEEDFEGWKLLSETLGDRIQLVGDDLFVTNSALIAEGIAQGLANAVLIKPNQIGTLTETAEAIRLATTQGYATILSHRSGETEDTTIADLAVAFNTGQIKTGSLSRSERIAKYNRLIAIEEEIGPEAVFQDSNPFSKA

SEQ ID NO: 2842 - protein, 160 aa, Zea mays
  unsure (1)..(160): unsure at all Xaa locations
AGQLSCPRYLSGEAKQIEWSKIQTPTDEVVVPYDTAASAPEDLXETKKLLYKLVELKLNDGLDTTMGLTDPKSAIEERNGFTFLDLIVIXIEFLNKKCGCYGPLLLMNCCTPVLSLKRLSDSVCSKAYEKGTFYWGHPIFDVTQRSAKTVTTCRRHLLGG

SEQ ID NO: 2843 - protein, 205 aa, Azotobacter vinelandii
MNRGVTPTMLLMIDNYDSFTYNVVHYLGELGAEVRVIRNDELNIAEIEALRPERLVISPGPCTPSEAGVSLEAIRHFAGKLPILGVCLGHQSIGQAFGGDVVRARVAMHGKTSPVFHRDQGVFAGLNNPLTVTRYHSLVVKRETLPECLEITAWTQFEDGAVDEIMGLRHRTLNIEGVQFHPESILTEQGHELFANFLKQNGGVR

SEQ ID NO: 2844 - protein, 187 aa, Oryza sativa (japonica cultivar-group)
MAGSEEKKEMQDPRTQAIASTIRVVPNFPKPGIMFQDITTLLLNPPVFKDTIDLFVERYTGKGISVVAGVEARGFIFGPPIALAIGAKFIPLRKPNKLPGEVMSKEYELEYGADCLEMHVGAVQPGERALVVDDLVATGGTLCAAIVLLERAGAEVVECACVIELPELKGRERLNGKPLYVLVESHS

SEQ ID NO: 2845 - protein, 355 aa, Arabidopsis lyrata subsp. petraea
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 2846 - protein, 468 aa, Shigella flexneri 2a str. 301
MEGIMPDAKKQGRSNKAMTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 2847 - protein, 140 aa, Zea mays
MEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 2848 - protein, 98 aa, Glycine max
MALVRSLLGAKKILGRSVTAAASTSKRATSAAPKGFLAVYVGESQKKRYVVPISYLSQPSFQALLNKSEEEFGFDHPMGGLTIPCSEDIFITVTSRFQ

SEQ ID NO: 2849 - protein, 138 aa, Zea mays
  unsure (1)..(138): unsure at all Xaa locations
PRARCLPCSARKRASYRSFRVYSLFGGXRRILDENGDEAPSKAGISRKHAPSRYETVKKAQMVVQVEAARVQKELAPTEIDGYCEGELIKVTLSGNQQPIRVEITEAAMELGAEKLSELVNDAYKDAHQRSVQAMKER

SEQ ID NO: 2850 - protein, 203 aa, Glycine max
MGNTEKLMNQIMELKFTSKSLQRQSRKCEKEEKSEKLKVKKAIEKGNMDGARIYAENAIRKRTEQMNYLRLASRLDAVVARLDTQAKMTTISKSMGNIVKSLESSLATGNLQKMSETMDSFEKQFVNMEVQAEFMESAMAGSTSLSTPEGEVNSLMQQVADDYGLEVSVGLPQPAAHAVPAKEADKVDEDDLSRRLAELKARG

SEQ ID NO: 2851 - protein, 361 aa, Oryza sativa (japonica cultivar-group)
MGSSSGSDRLRDLQAFDDTKAGVKGLVDAGVTTIPAIFHHHPLLLDDAEEDADVIPVIDLQADVDRGHLVGQVRAAAQCVGFFQVVNHGIPGELLEEMLAAVRRFNEQPAEGKKAWYSRDSGRRVKFNSNFDLFQSPAANWRDTLLLELTPRPGPAAEEIPPACRGVVGEYVEAVQRLGGALLELLSEALGLPPEYLGGLGGGLATMAAHYYPPCPEPHLTLGTTRHSDPSFLTVLLQESKGLQVLMRQRQRWVDVPPVAGALVVNIGDLLQLVSNDLFRSVEHRVLATTAAAEPRLSVACFFRPDYACTRVYAPVTTTPPPPLYRSTTMPEFLSHYRAKGLDGRSALHHFRIPPPSSPPH

SEQ ID NO: 2852 - protein, 324 aa, Triticum aestivum
AEIAPQNMRGALGSVNQLSVTIGILLAYTLGMFVPWRILSVLGILPCSILIPGLFFIPESPRWLAKMGKMEDFESSLQVLRGFETDISAEVNEIKRSVASSRRRTTIRFAEIKHKRYSVPLMIGIGLLILQQLSGVNGIFFYAASIFKAAGLKNSNLATCGLGAVQVVATGITTWLTDKAGRRLLLIISATGMTISLLVVSVSFFVKDNIDEASHLHFVMSMLSLAGLVAFVLAFSLGMGAIPWIIMSEILPVNIKSLAGSTATLANWMTSWLITMTASLMLNWSNGGTFAIYAAVSMGTLLFVCLCVPETKGRTLEEIAFSFR

SEQ ID NO: 2853 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVSKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTL

SEQ ID NO: 2854 - protein, 420 aa, Zea mays
  unsure (1)..(420): unsure at all Xaa locations
MAAAFDAYTDKNAVFRRLKAKPENKMCFDCNAKNPTWASVTYGIFLCLDCSAAHRSLGVHITFVRSTNLDSWTPDQLKMMAFGGNNRAHAFFKQHGWTDGGKVEAKYTSRAAELYRQMLTKEVAKSATTDNALPSSPVASEASKPPSDDFPEFKLPDVPAPPAEDLNGKHEPKSPKAAPRSPKAATHPTFXATFCEKAQWARMKVGGKTVGGLXGVRKLTTKPNQTLYEQKPDDPIPAVPALAASTKKGGQALHSRFEYVENEPSADSRTGGSVSRVSGHVAPPKSSDFFQEYGMGNGFQKKSSNASKTQVEETDEARKKFSNAKAISSSQFFGTQNREEKEAQLSLQKFAGSSSISSADLFGRNDADNSNLDLSAADLINRISFQASQDLSSLKDIAGETGKKLTSLASNFISDLDRIL

SEQ ID NO: 2855 - protein, 513 aa, Solanum melongena
MVILPSELIGATIIYIIVYIIIQKLIATGSWRRRRLPPGPEGWPVIGALPLLGGMPHVALAKMAKKYGPIMYLKVGTCGMVVASTPNAAKAFLKTLDINFSNRPPNAGATHMAYNAQDMVFAPYGPRWKLLRKLSNLHMLGGKALENWANVRANELGHMLKSMFDASHVGERIVVADMLTFAMANMIGQVMLSKRVFVEKGKEVNEFKNMVVELMTVAGYFNIGDFIPQIAWMDLQGIEKGMKKLHKKFDDLLTKMFEEHEATSNERKGKPDFLDFIMANRDNSEGERLSITNIKALLLNLFTAGTDTSSSVIEWALTEMMKNPTIFKKAQQEMDQIIGKNRRFIESDIPNLPYLRAICKEAFRKHPSTPLNLPRVSSDACTIDGYYIPKNTRLSVNIWAIGRDPDVWENPLEFIPERFLSEKNAKIEHRGNDFELIPFGAGRRICAGTRMGIVMVEYILGTLIHSFDWKLPNDVVDINMEETFGLALQKAVPLEAIVTPRLSFDIYQSSEPF

SEQ ID NO: 2856 - protein, 355 aa, Sclerotinia sclerotiorum
MASRAPNPSSGSRKISFNVSEQYDIQDVVGEGAYGVVCSALHKPSGQKVAIKKITPFDHSMFCLRTLREMKLLRYFNHENIISILDIQKPRNYESFTEVYPIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKQLIYHEIMR

SEQ ID NO: 2857 - protein, 183 aa, Amaranthus hypochondriacus
MASSMLSNAAMATTAATAGAQASMVAPFNGLKSFATFPITKKSSNDFSSLPSNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPSAFIRIIGFDNKRQVQCVSFIAYKPAGGL

SEQ ID NO: 2858 - protein, 516 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 2859 - protein, 100 aa, Zea mays
  unsure (1)..(100): unsure at all Xaa locations
PSRHAPLRQSASSTTVSLSPVXGRRDKSTIRKPDEFKQPGERSRSWDAQRQARLVRLFPDSLGLPKVRQEVRSIWIGLLGKXDESLGIKIAXRLNMKANM

SEQ ID NO: 2860 - protein, 154 aa, Prunus persica
MALSLFGGRRSNVFDPFSLDIWDPLEGLGTLANIPPSARETTAIANTRIDWKETPEAHIFIADLPGLKKEEVKVEVDDGKVLHISGERSREQEEKNDKWHRIERSTGKFSRRFRLPDNAKIDQVKASMENGVLTVTVPKEEEKRPQVKAIDISG

SEQ ID NO: 2861 - protein, 506 aa, Oryza sativa (japonica cultivar-group)
MGKGTVVGTAVVVCAAAAAAVGVAVVVSRRRRSKREAEEERRRRAAAVIEEVEQRFSTPTALLRGIADAMVEEMERGLRADPHAPLKMLISYVDNLPTGDEHGLFYALDLGGTNFRVIRVQLGGREKRVVSQQYEEVAIPPHLMVGTSMELFDFIAAELESFVKTEGEDFHLPEGRQRELGFTFSFPVHQTSISSGTLIKWTKGFSINGTVGEDVVAELSRAMERQGLDMKVTALVNDTVGTLAGGRYVDNDVAAAVILGTGTNAAYVEHANAIPKWTGLLPRSGNMVINMEWGNFKSERLPRSDYDNALDFESLNPGEQIYEKMISGMYLGEIVRRILLKLAHDASLFGDVVPTKLEQRFILRTPDMSAMHHDTSHDLKHLGAKLKDILGVADTSLEARYITLHVCDLVAERGARLAAAGIYGILKKLGRDRVPSDGSQKQRTVIALDGGLYEHYKKFRTCLEATLADLLGEEAASSVVVKLANDGSGIGAALLAASHSQYASVE

SEQ ID NO: 2862 - protein, 473 aa, Zea mays
MAATAVSVDEKLDKLRAEVAKLNQISENEKSGFISLVSRYLSGEAEQIEWSKIQTPTDEVVVPYDILASPTEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFIANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRTNPANPSIELGPEFKKVANFLARFKSIPSIVELDSLKVSGDVWFGSGITLKGKVTITAKSGVKLEIPDGAVFENKDVNGPEDL

SEQ ID NO: 2863 - protein, 158 aa, Escherichia coli K12
MKLISNDLRDGDKLPHRHVFNGMGYDGDNISPHLAWDDVPAGTKSFVVTCYDPDAPTGSGWWHWVVVNLPADTRVLPQGFGSGLVAMPDGVLQTRTDFGKTGYDGAAPPKGETHRYIFTVHALDIERIDVDEGASGAMVGFNVHFHSLASASITAMFS

SEQ ID NO: 2864 - protein, 403 aa, Pseudomonas syringae pv. syringae B728a
MSHEPKTLLPVEDAIARLLKMAEATPITERQRVSLADAEGRVLAVDLVSTLDLPPWPNSAMDGYALRAADWRGEPLSVSQRIFAGQAPEPLAPGTCARIFTGAPMPEGADCVEMQENAEVQADQRVRFNEPLGAGQNIRPQGQETRVGDTVLAAGTRLGPIELGLAASLGLAELEVIRRVRVAVLSTGDELIEPGQPLGPGQIYNSNRVLLCSWLKRLECEVVDAGILPDDLDKTRAALANLQGVDLILSTGGVSVGEADFLGHALREEGELTLWKLAIKPGKPLTFGHFRGVPVIGLPGNPASTLVTFALLARAYLLRRQGVIDVAPLQFPVPAGFVWTRPGNRREYLRGRLEQGRAVAYRNQSSGVLRSAAWADGLIEVREGSTVAEGDWVNFIPLSEVLG

SEQ ID NO: 2865 - protein, 488 aa, Rhodococcus erythropolis
MSLSDHATGKNAGAAGAHHDGADFHAEDNSYLEKRTLRKGTAGWVLLAGLGVSYVISGDYAGWNNGLAEGGFGGLLIAAVVIAGMYLAMVLGMAEMSSALPAAGGGYTFARRAMGPWGGFATGTAILIEYSIAPAAIATFIGAYVESLNLFGITDGWWVYLAVYAIFIGIHLTGAGEALKAMFIITAIALVGLVVFAVSAVGLFDSSNLTDIAVDTSAVGSSSFLPFGLLGIWAAVPFAIWFFLAVEGVPLAAEEAREPEKNVPRGIIISMLILIVTGATVLFLATGALGADALSTSGNPLVEALGDSGAAKAVNYIGLAGLVASFFSIMYAYSRQTFALSRAGYLPKNLSVTNKRKAPTLALVVPGIIGFALSLTGEGAMLLNMAVFGAAVSYVLMMVSHIVLRKREPNMPRPYRTPGGIATTSFALVIAAVSVVATFLVDPVAALLTLVAFGVLMAYFGLYSRHHLVANSPDEEFAVLAQAEEELG

SEQ ID NO: 2866 - protein, 237 aa, Peperomia caperata
  unsure (1)..(237): unsure at all Xaa locations
VQLKRMENKINRQVTFSKRRTGLLKKAHEISVLCDAEVALIVFSTKGKLYEYATNSSSMPGILDRYERHSFTDKEFFIKEGEPPEGAWTLEYAKLKARYELLQKNYRHYLGEDLGSLSGKELQQLEGQLDASLKNVRSRRTQALFHTISDLQKKEKSLLEQNSVMIKKLQDLEKAEKAQQSQLEMQNHERTQNQPPLILLPPPALSXGSFRQENGPSVEGEAAPRVAQKNSLLPPWM

SEQ ID NO: 2867 - protein, 426 aa, GIBBERELLA ZEAE PH-1
MAEALRELLASEQTNDPAALEYLTYLAEQQSSFLQTSEPQVLSQTSHSLLLAIQALSKRSHKPIVDSAASHASLRDSLPTLAQRASDLVQAVPRLDAQAEHFSSAFGKASDSKLLARRKQALLLLRNSERLVDVMEMPLLLSSAVSTAPVNHSTTLELYAHVRRLASLYPDSPLVTSVMEEADAAIRQMAADLIGILRAPNLKLAAAVRTMGWLKRIVPDLVTDASIEDALPAVFLVCRLSTLLSTLEALEPLRDLADEERLRKDKATTTWSGGQQTERYLKRFIEIFREQSFSIVSVFKSINSSFSSQVTRSEDPLGALPSPMANFPLHMVEMLVETLRTYLPTVKDQTSRESILTQVLYCAGSLGRLGADFGLLLASIGGVEWVELVKRHRLLAGRLESVIGDYHRGSQAGTGTGIGGVGAGAN

SEQ ID NO: 2868 - protein, 479 aa, Trematocarpus dichotomus
RTKNERYESGVIPYAKMGYWDPDYVVKDTDILALFRVSPQPGVDPVEASAAVAGESSTATWTVVWTDLLTACDLYRAKAYKVDSVPNTSDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERYLYSMEGVNRSIAASGETKGHYLNVTAATMEEMYERAEFAKEIGSIIIMIDLVIGYTAIQTMAIWARKNDMILHLHRAGNSTYSRQKIHGMNFRVICKWMRLSGVDHIHAGTVVGKLEGDPLMIRGFYNTLLNTHLAVDLPQGIFFEQDWASLRKVTPVASGGIHCGQMHQLLDYLGIDVVLQFGGGTIGHPDGIQAGATANRVALESMVIARNEGRDYVTEGPQILQDAAKTCGPLQTALDLWKDITFNYTSTDTADFVETPTTSA

SEQ ID NO: 2869 - protein, 526 aa, Arabidopsis thaliana; identical to SEQ ID NO: 488

SEQ ID NO: 2870 - protein, 574 aa, Burkholderia fungorum
MERAALDRAPGGVERERSGRLASTARHELHARATGCAGRAQAGEGTGSRKAHRDSRWIAKGDEAGAAMQSYGRDRKVNVSTGSLLSDFCTGRTRQCRSGRHRPFATRCQPPEKLHAPCPVFKPAAIRPNPSARTHPPEPIRPNPSARTHPPEHYGCRIMNSPAGDLPQGQLCCSKPNSYDSFKRRGGRLLHNAMRADHSARVRRGPLRFGRRGVVAPLAIYRPSVPPTCPSASPVRPYRRCGVRRPASGSSAGAQHLERHGRVERMSLQTPSRFPRGFPLRLPQSRNGQLVLALAVVYLVWGSTYLAVHVALGSFPPLLLSGLRNLFAGVGLFVFAARRNPVWPGAAEIRNAGLVGTMLVGLSSGMLAYGMRTVGTGTAAVMVATVPLFATVIAAVAGRKIGRGEWFAVGLGLAGIAILSHGDSAPGSAGGSLAILCGALFWAGGAHLAGRLKLPSDLFLSTSLQIGLGGAMSTLVAWVSGERMLELHWLPLLAFIYLMLIGTMAAYVAYGFLIRHTSPIIASSCMYVNPVVAVALGALLLGEPVTRSTVVATIVILASVGLSFWFDYRKKGLA

SEQ ID NO: 2871 - protein, 326 aa, Paenibacillus sp. A-234
  unsure (1)..(326): unsure at all Xaa locations
CIGCHTCSVTCKTTWTNRKGAEYMWVNNVETKPGIGYPKRWEDQELYKGGWTLRKGKLELKSGNKLSKIALGKIFYNPDMPEMKDYYEPWTYNYEYLTNAGEQKHSPVARAHSAVTGEQMDLEWGPNWXXDLAGEHVTGPHDPNIQKIEEEIKFNFEKSFMIYLPRLCEHCLNPSCVXSCPSGAMYKRDEDGIVLVDQEACRGWRYCMTGCPYKKVYFNWQTNKSEKCIFCFPRIEAGMPTVCAETCVGRIRYLGVLLYDADRIHEVASTVNEQDLYAKQLEIFLDPFDPKVIEQALNDGVPMSVIEAAQKSPVYKMAVDWKLLCR

SEQ ID NO: 2872 - protein, 516 aa, Vicia faba
MPAAGIPIGAGNKEYPGNLTPFVTITCVVAAMGGLIFGYDIGISGGVTSMNPFLEKFFPAVYRKKNAQHSKNQYCQYDSETLTLFTSSLYLAALLSSVVASTITRRFGRKLSMLFGGLLFLVGALINGLAQNVAMLIVGRILLGFGIGFANQSVPLYLSEMAPYKYRGALNIGFQLSITIGILVANILNYFFAKIKGGWGWRLSLGGAMVPALIITIGSLILPDTPNSMIERGDRDGAKAQLKRIRGVEDVDEEFNDLVAASETSMQVENPWRNLLQRKYRPQLTMAVLIPFFQQFTGINVIMFYAPVLFNSIGFKDDASLMSAVITGVVNVVATCVSIYGVDKWGRRALFLEGGVQMLICQVAVAVSIAAKFGTSGEPGDLPKWYAIVVVLFICIYVAGFAWSWGPLGWLVPSEIFPLEIRSAAQSVNVSVNMLFTFLVAQIFLTMLCHMKFGLFLFFAFFVVVMTIYIYTMLPETKGIPIEEMDRVWKSHPYWSRFVEHDDNGVEMAKGGVKNV

SEQ ID NO: 2873 - protein, 110 aa, Zea mays
MAATAVSVDEKLDKLRAEVAKLSQISENEKAGFISLVSRYLSGEAKHIERSKLHTPTEEAAAASRSTRSRGGERRATTSIESISQPGGSPRRGGRGHRAHESPLPTRDHH

SEQ ID NO: 2874 - protein, 148 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 2875 - protein, 990 aa, ASPERGILLUS NIDULANS FGSC A4
MLVKGFLWLNPNLPPPPLTKLGANDVANSFASSVSSRSLTLKQAMLIAACMELAGSISVGSRVAETVRERIIDPHLYDAEPAVLMLAMMCAIIGSSLFLTVATRAGLPVSTTHSIIGGLVGAGTASVGIKNIHWGWNGVAQVFAAWGVAPGIAGALGAIMFLITRHLVLSSKYAVHRALLSIPIYTFVTIAGLTMLVVWKGIQLDVELSAMQVSVAVVTVATGCTLLEILFLLPYLWRRVMIEDWQLKWHDAWRGPFLLSRPLPSPPPPGRSSLNIKDYYRGHLTQEELKCLRASESLLQSIQSADGYNDPERLEGTTTSRVEGVPPRPAGPWTSWPVIWWYVQRVLYRGLEQDVIQAQKRQTVLTWDIQDMHARAARYDNRAEYMYSSLQILTAATASFVHGANDVANAIAPFATTYLVWQNGNIADEVPVPTWVLAFGGGAIVLGLLTYGYHLMRNLGNRLTLMSPSRGFCMELSSAMTILMATRLRLPVSTGTLIPLSSQNYYIYLTHPRFTIMSTVTGNCFCGKTRYRTTGPLYGLSYCYCRTCQLVHGAPFAPFTNVKREHFQWTRADDLIELRLSTFATRTVCGSCHSPVSMVYDGKPDEVGLVAVTVQDQDAVPEVEGHIFGTSILAVILHQLHYQFGALPILAKIVWIYAIVLLGLFLGIYVARIILHPQHVVREIRHNVVEASCLASVPIAFTSIIQMISLQYNGGAEMAAYVLWWISTFLSLCSVIGVPYSQLKMQPSGIEHMPPTFLLPVISILTSAAGGGVICESSSLSARLRVPAIIVSYMELGAGLGLATCIDACIVYHHFDRKYPRYGEAYQDMVLCGPFGQASFALQILGTAVQHSFGAYNRGSLLTETSAAPIAAVSQFAGLMAWGFGTFWWILAILSIVYTLNVQSGGLRNAAFSLSAWSLIFPWGVYTNGAVQLGKLMNSPAFDVWSTALLLMLVILWAVMNLFTIKGIVTGKLLGLEKGWRVPKSEHQTV

SEQ ID NO: 2876 - protein, 306 aa, Streptococcus pneumoniae
MKKVKKAVIPAAGLGTRFLPATKALAKEMLPIVDRPTIHFVIEEALRSGIEDILVVTGKSKRSIEDYFDSTFELEYSLRKQGKMELLKSVNESTDIKVHFVRQSSPRGLGDAVLQAKSFVGDDPFVVMLGDDLMDITDSTAVPLTRQLMDDYNATQASTIAVMPVRYEDVSSYGVISPRLESSNGLYSVDAFVEKPKPEEAPSHLAIIGRYLLTPEIFSILETQKPGAGNEIQLTDAIDTLNKTQSVFAREFVGKRYDVGDKFNFMKTSIDYALQHPQIKESLKNYVIALGKQLEKLDDCSSSGHL

SEQ ID NO: 2877 - protein, 419 aa, Pseudomonas fluorescens PfO-1
MRMNRFGAFYQPCGLPPHGKSAKRCGHAGSQFQHVFILIGAVMVLAMHAGFAFLEVGTVRQKNQVNALSKILSDFAVSTLAYFFIGYWLSYGVTFLHPAAVLSADHGYGLVKFFFLLTFAAAIPAIISGGIAERARFVPQLCATALIVAFIYPFFEGMIWNGNYGLQAWLTAQFGAPFHDFAGSVVVHAMGGWLALAAVLLLGPRTGRYRDGKLVAFAPSSIPFLALGSWILIVGWFGFNVMSAQTLQGVSGLVAVNSLMAMVGGTVAALIVGRNDPGFLHNGPLAGLVAVCAGSDLMHPVGALVNGAIAGALFVWCFTAAQVKWRIDDVLGVWPLHGLCGVWGGIACGIFGSTTLGGLGGVSLISQLIGTALGVAVALIGGFAVYGSIKALHGLRLSQEQEYYGADLSLHKIGAVSQD

SEQ ID NO: 2878 - protein, 331 aa, Paracoccus denitrificans
MTGQKIRLALNGFGRIGRSILRIWAQGGYEDLDLVLINDIEALENCAYLFEYDSVFGPWRGQVGTAEKALVVDGRAIPFHSAPDLRQLDLSGVDIVLECTGMTGSRAVVERGLEAGAGAVLISGPSDEADITVVIGANEEQLDGQRIVSNASCTTNALAPLLRVLDEAFGVVSGQMTTVHCYTGSQPTVDKPRGDPARSRAAALSMVPTTTSAGRLIGTVLPHLAGRVAARAIRVPTASVSCIDLTFASARPTDVAGVNAALRAAAEGSPVFGWTERPLVSSDLRARPESIVVSGRETSVAGGLTRVFGWYDNEWGFSNRMLDVARLMGHR

SEQ ID NO: 2879 - protein, 440 aa, Marchantia polymorpha
  unsure (1)..(440): unsure at all Xaa locations
MASITVGASAVSSKLTLQAQATSAARSSNVAAQAASFKRSSLGEFSGLKASSAVTFGKSSSENGFFDAVASQVAVKAGASGAIKGETSAKLRVAINGFGRIGRNFLRCWHGRGDESPLEVVAVNDSGGVKNAAHLLKYDSMLGIFKADVKVGDDTTLLVDGKPITVVSNRDPLKLPWAELGIDIVIEGTGVFVDGPGAGKHIQAGAKKVIITAPAKGADIPTYVMGVNEGDYSHEVANIISNASCTTNCLAPFVKVLDEKFGIVKGTMTTTHSYTGDQRLLDASHRDLRRARRAALNIVPTSTGAAKAVSLVLPQLKGKLNGIALRVPTPNVSVVDLVINTEKKGLTAEDVNNAFRXAANGPLKGILAVCDIPLVSIDFRCSDVSSTVDSSLTMVMGDDMVKVVAWYDNEWGYSQRVVDLAHLVAAQWPGVAKPSGDPLE

SEQ ID NO: 2880 - protein, 318 aa, Synechocystis sp. PCC 6803
MKPTVIITGASSGVGLYGRKALIDKGWHVIMACRNLDKTQKVADELGFPKDSYTIIKLDLGYLDSVRRFVAQFRELGRPLKALVCNAAVYFPLLDEPLWSADDYELSVATNHLGHFLLCNLLLEDLKACPDADKRLIILGTVTANSKELGGKIPIPAPPDLGNFEGFEAGFKKPIAMINNKKFKSGKAYKDSKLCNMLTTRELHRRFHQETGIVFNSLYPGCVADTPLFRNHYSLFRTIFPWFQKNVTKGYVSQELAGERVAMVVADDKFKDSGVHWSWGNRQQAGREAFVQELSEQGSDAQKAQRMWDLSEKLVGLV

SEQ ID NO: 2881 - protein, 448 aa, Gelidium crinale
  unsure (1)..(448): unsure at all Xaa locations
LALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKACGPXQTAXDLWXDIPFIYASTDXXXFVETPPANV

SEQ ID NO: 2882 - protein, 458 aa, Glycine max
MSITHSLTTPLSSSSSAFLAPSSFNCRGQVSLPVKSVSICKCVATPEAETAYKTGVNRNPNMGKLQAGYLFPEIARRRSAHLLKYPDAKVISLGIGDTTEPIPEVITDAMSKRSHALSTIEGYSGYGAEQGEKPLRRALASTFYSDLGIEEDDIFVSDGAKCDISRLQIVFGSNVKMAVQDPSYPAYVDSSVIMGQTGLFQKNVEKFANIEYMRCNPENGFFPDLSSISRPDIIFFCSPNNPTGAAATREQLTQLVQFAKDNGSIVIHDSAYAMYISGDNPRSIFEIPGAKEVAIETSSFSKYAGFTGVRLGWTVVPKQLLFSDGFPVAKDFNRIVCTCFNGASNISQAGGLACLSPEGLKAMRDVIGFYKENTNIIMETFDSLGFKVYGGKDAPYVWVHFPGRSSWDVFAEILEKTHVVTTPGSGFGPGGEGFIRVSAFGHRENVLEACRRFKQLYK

SEQ ID NO: 2883 - protein, 309 aa, Glycine max
  unsure (1)..(309): unsure at all Xaa locations
MGSEVSKQVERRKAIHTEGKTLSDLRNSGEDYPGSDYHPSDRKKWMSELNPEKVVIKQIVWPGTHDSATNKIGIPCITRPFAQCQSLSIYQQLVLGTRVIDIRVQEDRKVCHGVLVTYSIDVVIKDLKKFLSETQSEIIILEVRTXEFGHXEEQLGDYLVPQDDKVFEKTIAEVLPKRVICVWKPRKSPQPKAGSPLWSAGYLRDKWINTDLPSTKFESNMKHLSEQQPVTSRKYFYRVENTVTPVADNPVLCVKPVTERIHGFARLFISQCFSKGYADRLQIFSTDFIDQDFVDACVGLTRARVEGRA

SEQ ID NO: 2884 - protein, 200 aa, Cichorium intybus x Cichorium endivia
MATIGHNNLNAKFVLLGDMGAGKSSLVLRFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 2885 - protein, 313 aa, Bacillus anthracis str. A2012
  unsure (1)..(313): unsure at all Xaa locations
MRNVXCIGELLIDFVCRNTNVSLVNGSNFEKKAGGAPANVAAAITKLGGHATFMGQVGNDPFGEFLEQTLQHAHVDTSMLIKDKQTTLAFVSIDQNGERDFTFMRGADGEYHFNSIDLSKIKTNDLIHFGSATALLSSPLKDTYFQLLQHARESGQFISFDPNYRNALITNTEQFIQDCLTFIKHAHFVKVSQEEAIMLSKESDLQQSALKLLNHGAKAVAITLGKDGTLLATKDKQTIVPSISIQQVDTTGAGDAFVGAMLYQIAKSEQMFLHNFEGLTTFISFANKVGALTCTNYGAISSLPSLTDVKAYE

SEQ ID NO: 2886 - protein, 392 aa, Corynebacterium melassecola
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKDALAEKTNPRGISGGINEAFTGADLFIGVSGGNIGEDALKLMAPQPILFTLANPTPEIDPELSQKYGAIVATGRSDLPNQINNVLAFPGIFAGALAAKAKKITPEMKLAAAEAIADIAAEDLEVGRIVPTALDPRVAPAVKAAVQAVAEAQNA

SEQ ID NO: 2887 - protein, 224 aa, Pseudomonas syringae pv. syringae B728a
MQPFVIAPSILSADFARLGEEVDNVLSSGADFVHFDVMDNHYVPNLTIGPMVCSALRKYGVTAPIDVHLMVSPVDRIIGDFIEAGATYITFHPEATQHIDRSLQLIREGGCKAGLVFNPATPLNLLEYVMDKVDMILLMSVNPGFGGQKFIPGTLNKLREARALIDASGRDIRLEIDGGVNVNNIREIAAAGADTFVAGSAIFNAPDYREVIEKMRTELASSRA

SEQ ID NO: 2888 - protein, 252 aa, ASPERGILLUS NIDULANS FGSC A4
MSPPAIIAPSILSADFATLGSECSTKISEGADWLHVDIMDGHFVPNITFGAPVVTKIRSHVHRPSQPQGKGTFDCHMMIAEPQKWVKDFKDAGCDLYCFHYEAAVSSVAAKEPADKETTRKTSPKELIRFIHEEGMQAGIAIKPDTPVDVLWDILAADDEKERPDMVLVMTVHPGFGGQKFMASELPKVKALREKYPDLNIEVDGGLGLGTIDQAAEAGANVIVAGSAVFGAENPGDVIQKLRDAVNKHRKA

SEQ ID NO: 2889 - protein, 325 aa, Zea mays
AAACGPAVFPVYPRAEKLHAEWAAAKLSCKKRLAKHVLDVTGVTIDPTSLFDIQIKRIHEYKRQLLNILGAVYRYKKLKGMSAEEKQKVTPRTVMIGGKAFATYTNAKRIVKLVNDVGAVVNNDPEVNKYLKVVFIPNYNVSVAEVLIPGSELSQHISTAGMEASGTSNMKFSLNGCVIIGTLDGANVEIREEVGEDNFFLFGAKADEVAGLRKDRENGLFKPDPRFEEAKQFIRSGAFGSYDYEPLLDSLEGNSGFGRGDYFLVGYDFPSYIDAQDRVDAAYKDKKKWTKMSILNTAGSGKFSSDRTIAQYAKEIWDIKASPVV

SEQ ID NO: 2890 - protein, 266 aa, Escherichia coli
MLAGLRFMLVAFPAIFFVARPKVPLNLLLGYGLTISFAQFAFLFCAINFGMPAGLASLVLQAQAFFTIMLGAFTFGERLHGKQLAGIALAIFGVLVLIEDSLNGQHVAMLGFMLTLAAAFSWACGNIFNKKIMSHSTRPAVMSLVIWSALIPIIPFFVASLILDGSATMIHSLVTIDMTTILSLMYLAFVATIVGYGIWGTLLGRYETWRVAPLSLLVPVVGLASAALLLDERLTGLQFLGAVLIMTGLYINVFGLRWRKAVKVGS

SEQ ID NO: 2891 - protein, 161 aa, Pseudomonas aeruginosa PAO1
MGPIVSPALHAVQASRFEDVRQARSATGTRTDEGLRRSAGGRYAGASSRGTYQSGAGRVTNPLRRSKVSESLSIHHDVGGHQFETTVDGHRAYLAYMDLGKQTLDIYRTFVPDSLRGRGIAAALTEHALQYADRMGYSVIPSCSYVERYIERRQRQADPAA

SEQ ID NO: 2892 - protein, 502 aa, Zea mays
MSTHAASRRSSSSSAVAKRPAIAEGATKAAGPGPTAAQAKKRTALVNITNVAAPGARVAAVGKVAPPVTGAKLNPATSGAPLKKPSLANARTIRGSAAKSASIKPAPPVSRHDSSSEQKHNVPVPTTVHVPSRAPALVPYSSFVSPGRSGDSVSTDETMSTCDSMKSPDFEYIDNGGCSMLASLQRRADEHLRTSEDRDVEENKWKKNGPAPMEIDSICEVDSNFEDPQLCAALASDIYMHLREAEMKKRPSTDFMETIQKDVNPSMRAILIDWLVEVAEEYRLAPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLANYIAELSLLEYSLLSYPPSLIAASAIFLARFVLQPTKYPWNSTLAHYTQYKPSELSECVKALHRLSSVGPGSNLPAIREKYSQHKYKFVAKKQSPPQIPAEFFRDAAC

SEQ ID NO: 2893 - protein, 424 aa, Wolbachia endosymbiont of Drosophila melanogaster
MNKVINNVFAREILDSRGYPTIEVEIELCDGAIGRASVPSGASTGKLEVLELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYVIESAGYSAQSDFALGLDVASSTFYEDGIYKFEHRDLTSEELTEYYCNLVERYPIISIEDAMSEDDYEGWKLLTAKLGSKIQLVGDDLFVTNCELICKGIEEKMANAVLIKPNQIGTLTETFAAIEMAKSNGYKAVVSHRSGETEDTTISHIAVASNCGQIKTGSLSRSDRLAKYNELIRIESALGKDAKYYRGLAWVL

SEQ ID NO: 2894 - protein, 94 aa, Glycine max
  unsure (1)..(94): unsure at all Xaa locations
MVGDLTFTYNGHGTQVGAMVLTGSSSGPGAVQRGMSDKKDESAMPKDAKNVKSLLKSMGLEDYXPRVIHKYLELXYRYNGYVLTDAQVYTQHAV

SEQ ID NO: 2895 - protein, 338 aa, Ranunculus acris
MTGKIKIGINGFGRIGRLVARVALARDDVELVAVNDPFITTDYMTYMFKYDTVHGQWKHHELKVKDEKTLLFGEKPVTVFGCRNPEEIPWGETGAEFVVESTGVFTTKEKASAHLKGGAKKVVISAPSADAPMFVVGVNHTEYKSDIDIVSNASCTTNCLAPLAKVINDRFGIVEGLMTTVHAMTATQKTVDGPSSKDWRGGRAASFNIIPSSTGAAKAVGKVLPALNGKLTGMAFRVPTVDVSVVGLTVRLEKKATYADIKAAIKEESEGKLKGILGYTEDDVVSTDFIGDNRSSIFDAKAGIALNDNCVKLVSWYDNEWGYSSRVVDLIVHMSKTQ

SEQ ID NO: 2896 - protein, 404 aa, Eremothecium gossypii
MSPVGETRRVSDENEAAGARRRGELAKKRGNTVLGVPRKALGAVGVNTRKQERDGAATGSGAGGARGAGTKRMVYHDSEGEETQEPEEKRVSKKAKAERQCPSPAAQTESPEAARGALVREPHPHRDLDALEADDLTMCVDYTNEIFAHLLQREQETTCVVNYVQERQCAFYIRPSMRAILVDWLIEVHLKFQLLPEALYLAINIMDRYLSTNKVSLSKLQLVAITSLLIAAKFEEVNLPKLSNYVYITDNAYTVEEVKQSECNILNALEFNIGWPNPMNFLRRISKADNYNHNTRNYAKVFLEYAMCCPKFVAITPSVLAAMSMRCAMMLNYGAEGFEWDDTMEWYSSMATTSAKFDFQKLCDDLIKDIQEPSTQLNALIYKYKKLGLWVAVKTWCDEQKIVR

SEQ ID NO: 2897 - protein, 427 aa, Batrachospermum helminthosum
  unsure (1)..(427): unsure at all Xaa locations
VEAAAAVAGESSTATWTVVWTDLLTACDLYRAKAYKVDTVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERXLFSIEGVNRAQAATGEIKGHYLNVTAATMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGCDFVNEGPQILRDAAKTCGPLQTALDLWKDISFNYTSTDTADFV

SEQ ID NO: 2898 - protein, 362 aa, Prochlorococcus marinus subsp. marinus str. CCMP1375
MASHKITLLTGDGIGPEISIVAKKILAALSEKHSITFTIEEKPFGGQAIELTGKPLPEDTLNSCKASDAVLLAAIGDPKYDDLPRDLRPETGLLNLRAGLNLFANIRPIKIRQALISSSSLKSEIIKDVDLVVVRELTGGIYFGQPKGRISTEEAGERAFNTMTYSDYEIDRIAKIAFDLSETRRKKICSIDKANVLEVSQLWRERVIKAQEQYPNIELTHQYVDNAAMQLVREPAQFDVILTSNLFGDIISDEAAMLTGSIGMLPSASLGEDGPGVFEPVHGSAPDIAHKNLANPIAMILSTAMMLRTGLMEYKAATDLENAIDKVLGKGFRTIDLNRDQSNTKLGCREMGDQIIKAINGI

SEQ ID NO: 2899 - protein, 332 aa, Buchnera aphidicola (Acyrthosiphon pisum)
MTIKVGINGFGRIGRVLFRLAQKRSDIEIIAINDLLAPEYIAYMLKYDSTHGVFKKHITFDKDNIIINGKNIRVTSIKDPEKLMWHDLSIDVVIESTGLFLKREQAYKHILAGSKKVVVTGPSKDDIPMFVRGANFHKYQGESIVSNASCTTNCLAPLSKVIDDNFGIIEGLMTTVHASTATQKIVDGASDKDWRGGRGALQNIIPSSTGAAIAVGKVLPNLNGKLTGMAFRVPVSNVSVVDLTVRYKKSATYSEICQKIQQASQKEMKGIMGYTEDEVVSTDFNGEELTSIFDAKAGLSLNKNFVKLIAWYDNETGYSSKVLDLVSLVSKK

SEQ ID NO: 2900 - protein, 248 aa, Halobacterium sp. NRC-1
MTAVGVQPAKRCIQHASPPFAVSMTIPSFAIGIAGGTGAGKTTVAREITDNVGESATLIPLDNYYEDLSDRPFEERANANYDHPSAFEWELLRTHIDALLSGQSIEMPQYDFERHVRKADRVVVEPTDVIVLEGILALSDETVNDMLDLHIYVETDADVRILRRIERDVVERGRELEGVMDQYLSTVKPMHEQFIEPTKRHADIIIPEGANSVAVNLLEEKVQAETSEMTAWAARDDTAFEDATYNPQ

SEQ ID NO: 2901 - protein, 477 aa, Abroteia orbicularis
KNERYESGVIPYAKMGYWDPEYVIKETDVLALFRVSPQPGVDPVEASAAVAGESSTATWTVVWTDLLTACDLYRAKAYKVEAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIIMIDLVIGYTAIQSMGIWARKNDMILHLHRAGNSTYSRQKIHGMNFRVICKWMRMAGVDHIHAGTVVGKLEGDPPMIRGFYNTLLLPYLDVNLPQGIYFQQDWAALRKVTPVASGGIHCGQMHQLLDYLGNDVVLQFGGGTIGHPDGIQAGATANRVALESMVIARNEQRDYVTEGPQILRDAAKTCGPLQTALDLWKDITFNYTSTDTPDYVETPTANV

SEQ ID NO: 2902 - protein, 251 aa, Neisseria meningitidis Z2491
MWDQKWVIGNWKMNGRLQNNNSLMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 2903 - protein, 600 aa, Vibrio vulnificus CMCP6
MALTSDFLQTSVVFLSAAVVAVPLAQRSGLGSVLGYLLAGVAIGPWGLGLISDVDAILHFAELGVVLLLFLIGLELNPKKLWQMRGPILGLGGAQVVITTLLIASIIQWFSVSWNTALVIGMGLALSSTAIALKVLEEQGLARTETGQSGFAVLLFQDIAVIPMLALLPLLAGSGMSGDWLSSLLTFSAVVGLLVGGHFLLRPLFRYVVLTGVRELFTVTALLVVLGIAMLMQQLGLSMALGTFLAGVLLAESEYRHELEIAIEPFKGLLLGLFFIAVGMAVNLGLLVVHPIEVISAVLGLVALKGAVLYLLGRVSRMRAKARSRMAAILSQGGEFAFVIFTAASKEGLLNPSEVSFLLVVVSLSMVTTPLLLNIQKWWYARTLNQESDVLAPDVVDTEPRVIIAGFGRFGQIVGRLLYANKIKVTVLESDASQIQLLRKYGYKVFYGDATQLDLLRAAGAAKAEALVICTDSPDQVMSIVELCQQHFPNLKVLARARSRVEAYQLLSHGVSTYSRETFLGALDLGRQTLVEIGMHPYQAKRAEAHFRKLDNAMLKELLPQHNQDKKLAQRAKEARKELEEIFAHEMENDHQSRNFWDER

SEQ ID NO: 2904 - protein, 464 aa, Lophocladia trichoclados
  unsure (1)..(464): unsure at all Xaa locations
KMGYWDPNYAVKETDVLALFRVTPQPGVDPIEASAAVAGESSTATWTVVWTDLLTACDLYRAKAYKVDAVPNSTEQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEGVNRSIAGTGXVKGHYINVTAATMXHMYERAEFAKQLGTVIIMIDLVIGYTAIQTMGIWARQNDMILHLHRAGNSTYSRQKIHGMNFRVICKWMRMAGVDHIHAGTVVGKLEGDPLMIRGFYNTLLEPYLAIDLPKGIFFEQDWASLRKVTPVASGGIHCGQMHQLVDYLGNDVVLQFGGGQIGHPDGIQAGATANRVALEAMVXXXXXXXXXXXEGPQILXNAAKTCGPLQTALDLWKDITFNYTSTDTADLVETPTANV

SEQ ID NO: 2905 - protein, 373 aa, Ferroplasma acidarmanus
MLMTRSSTMTETKIDHVSLLIRKAIEEESSGNKNEAARTYKAAYKEVLEIASRSTGKIKQKRLEQAANLKKIYESIGGEAVEEDRISEGKKILGTLNIEPPEIPKVTFQDVAGLENVKTEIMSKIIYPMRYKELSQEYNIEFSGGMLLYGPPGTGKTFIVKAIANEVKANFINVNPSTLYSQWFGQFEKNISLLFRAAYLLSPSILFFDEIDTLVPKRSGSESDAARRGVSQLLTEVGGLTSQKDRNVFIIAATNNPWGIDEAIMRPGRFDVKIYIPPPDYESRKKIFQLKLSEVKHIDHIDYDELANKTERYSGADIEFICKKAVQNVFMEVIKTGNKIDVSTDDLLEVISQIRPSIDAGLLRKYQDYILNL

SEQ ID NO: 2906 - protein, 125 aa, Castanea sativa
AHVLVPGISLMGGYDSLKPVLLTGDLADSFFASFALGWLITNGAGLASYPIDTVRRRMMMTSGEAVKYKSSLDAFSQILKKEGPKSLFKGAGANILRAVAGAGVLAGYDKLQLIVFGKKYGSGGA

SEQ ID NO: 2907 - protein, 336 aa, Pseudomonas aeruginosa PAO1
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPNEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 2908 - protein, 80 aa, Triticum aestivum
MAPTVMGSKDTYDAPFQGLKSTDGLPVRRRSNGASLGSVSNGGRIRCMQVWPMEGIKKFETLSYLTPLSTEALLKQVEYL

SEQ ID NO: 2909 - protein, 575 aa, Xanthomonas campestris pv. campestris str. ATCC 33913
MAKKKTVARFMAETLESAGVERIWGVTGDSLNGLTDALREMHSIEWMHVRHEEVAAFAAGAEAAVTGKLAVCAGSCGPGNLHLINGLFDCHRSRQPVLAIAAHIPSSEIGLSYFQETHPQELFRECSHFVELVTNPAQLPEVLHRAMRTAILQQGVAVVVIPGDIALMEVDKHLSAAWPVLRAPRLLPAAEDVQQLAEILQQSKAVTLLCGSGCAGAHDAVVALADTLGAPIVHALRGKEHVEWSNPFDVGMTGLIGFSSGYHAMLNCDTLIMLGTDFPYRQFYPKDATIVQVDRDPAALGRRTPLQLGIAADVGETIAALLPQLERREERGFLDKSLAHYRKAREGLDELAVPADEGEPLHPQFVTRLISQIADEDAVFTCDVGTPTVWAARYLRMNGQRRLLGSFNHGSMANAMPQALGVQAACPGRQVISLSGDGGFAMLMGDFISLAQLNLPVKVVVFNNASLGFVAMEMKAAGYLDTGTELRNPDFAAMSNAMGILGLRVETSSQLERALRQAFAHSGPALVDVRIATQELVVPPAIKLEQAKGMGLYLLKAVMSGRGDEVLALAKTNLR

SEQ ID NO: 2910 - protein, 480 aa, Gracilariopsis panamensis
RQVKNERYESGVIPYAKMGYWDPDYVIKDTDVLALFRVTPQPGVDPVEASAAVAGESSTATWTVVWTDLLTACDLYRAKAYKVEAVPNTTDQYFAFIAYDLDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTHLEINLPQGIFFEQDWASLRKVTPVASGGIHCGQMHQLLDYLGNDVVLQFGGGTIGHPDGIQAGATANRVALEAMVMARNEGRDYVAEGPEILRVAAKTCGPLQTALDLWKDITFNYTSTDTADFVETPTANV

SEQ ID NO: 2911 - protein, 333 aa, Pseudomonas syringae pv. syringae B728a
MTLRIAINGFGRIGRNVLRALYTQGYRQDLQVVAINDLGDSEMNAHLLRFDTVHGPFSGTVECDKDSLTVNGDRISVSAIRNPAELPWKAQDIDVVFECTGLFTSRDKAAAHLTAGARKVIISAPASGADATIVYGVNHDTLRQSHQIISSASCTTNCLAPVAQILHRELGIENGLMTTIHAYTNDQNLIDVYHTDPYRARSATQSMIPSKTGAAEAVGLVLPELAGKLTGMAVRVPVINVSLVDLTVTLKRETTADEVNALMKEASQHSKVLGYNSLPLVSHDFNHNPLSSIFDANHTKVSGKLLKVLSWYDNEWAFSNRMLDNCLALHNAQ

SEQ ID NO: 2912 - protein, 482 aa, Pseudomonas aeruginosa PAO1
MNGHARHWIDGAWLDSAQRGQSFDPASGQPIGTYADGGRAEADAAIAAAVRAFEDGPWKDDHALRAKALEEIAAAFERHADALIDLLALENGKIKPEAAFEVGMVPGKLRYYAGLARSERGASGTPRPDVVSLVLREPMGVAGIIVPWNSPVVLMIRSLAPALAAGTTTVVKMPGQTAQTNAMVARIIAEAPSLPAGAVNIFSESGSEGARRLIDAAEVPVISFTGSSATGRAISAAGARHLKRFGLELGGKTPHLVFDDADLDAALPVLEKSLTVFAGQFCMTGSRLLVQRGVAERLRERLAQRLENLRVGPAADPRSDMGPLIDKANVERVERAVRQAIAAGARVVVRGGPVTEGELAAGAFYRPTLLEVDDPDLDIVQQETFGPVLTLQVFEHEEEGVALANRSEYGLAAGVWTRDVARAFRVARKIRAGTVWINDWAKVYDEFEEGGYRQSGLGRLNGVAALDDFVEYKHISLTTGAA

SEQ ID NO: 2913 - protein, 243 aa, Zea mays subsp. mexicana
SIRNNPVQNKVMNGEDPINNNHAQTAGGLGVRLATSSSSRDPSPSDEDMDGEVEILGFKMPTEERMRKRKESNRESARRSRYRKAAHLKELEDQVAQLKAENSCLLRRIASLNQKYNDANVDNRVLRADMETLRAKVKMGEDSLKRVIEMSSSVPSSMPISAPTPSSDAPVPVPPPIRDSIVGYFSAPAADDDASVGNGFLRLQAQEPASMVVGATLSATEMNRVAAATHCAGAMELIQTAMG

SEQ ID NO: 2914 - protein, 47 aa, Oryza sativa
MKVIEKIQEAVEDGQTEFSFEYFPPKTEEGPHNLFERMDRMGGHGPN

SEQ ID NO: 2915 - protein, 411 aa, Glycine max
  unsure (1)..(411): unsure at all Xaa locations
LLLSLSVAIFTSACQYGGRFLAKCTPCDPSLSDVCPTNGRSGNFKQFNCPKGYYNDLATLLLTTNDDAVRNIFWLETPQEYQPLSLVIFFLLYCILGLITFGIAVPSGLFLPIILMGSGYGRLLGIYMGPHTNIDQGLFCSMXCSPLCGSMRMTVSLCVIFLELTNNLLLLPITMIVLLIAKTVGDSFNPSIYEIILHLKGLPFMDANPEPWMRNLTVGELVDVKPSVVTLHGVEKVAKIVDVLKNTTHNAFPAMNDAYXPVVGQANGGTELHGLILRAHLIQALKKKWFLKERRRTEEWEVREKFTWVELAEREGSIEEVAVTSEEMEMFVDLHPLTNTTPFTVLESMSVAKAMILFRQVGLRHLLVVPKYQASGVSPVIGILTRQDLLAQNILTVFPHLAISKGREKRN

SEQ ID NO: 2916 - protein, 409 aa, Petunia x hybrida
MASGIMPSAGGKHRTDAMLVDKLPEEINEMKIRDDKAEKEMEAAVVDGNGTEKGHIIVTTIGGKNGEPKQTISYMAERVVGQGSFGIVFQAKCLETGETVAIKKVLQDKRYKNRELQTIRLLDHPNVVALRHCFFSTTEKDELYLNLVLEYVPETVYRVLRHYSKANQQMPMIYVKLYTYQIFRALAYIHGIGVCHRDIKPQNLLVNPHTHQLKLCDFGSAKVLVKGEPNISYICSRYYRAPELIFGATEYTFAIDIWSVGCVLAELLLGQPLFPGESGVDQLVEIIKVLGTPTREEIKSMNPNYTEFKFPQIKAHPWHKIFHKRMPPEAVDLVSRLLQYSPNLRSTALEACTHTFFDELRDPKTRLPNGRPLPPLFNFRPQELKGASADLLNKLIPEHAKKQCTFLGV

SEQ ID NO: 2917 - protein, 336 aa, GIBBERELLA ZEAE PH-1
MSRYTAAHANLQGPGDARPTALQIVKDEDLVGKLTDKVILVTGGNSGLGLETAKTLHATGATVYITARTSEKLEEAIKDIKAWPEAESSAPVYGIELQLDSLASVRAAAKKFLEKSEKLNILILNAGVMATPEGRTEDGFETQFGTNHLGHFLFFELLKPALIASSTPSFHSRVVSLSSKGHRYGGVRFDDFNFEKEPYIPWIAYAQSKTANIYFASELERRYGSQGLHGLSVHPGFIFTNLARHIDVSQIDVKGDTKNYVKNIEQGSATTVYAALSKDWEGRGGRYLADCDEEPPLKPGIDPASSAPGYASWIYNEEAEGRLWAESLRLVGLKKD

SEQ ID NO: 2918 - protein, 787 aa, Clostridium perfringens str. 13
MNKEQIKRGIERYLKVKYGKSSIKDAKDFEIFNALSLTLLEGIVDDWNHTEELYEKEKNAYYFSAEYLMGRALGNNLISLGLYNEVKEVLDELGFDLNRIEEIEEDAGLGNGGLGRLAACFMDSGASLEVPLKGYGIRYNNGLFSQYFEDGFQKEDVDSWLKYGEPWSIRKEDEFVTVDFEDMTVKAIPYDTPIIGYASKNINTLRLWKCEPVKEFDFKLFNEQKYDEALELKNRAEDISRVLYPNDSNREGKLLRLRQQYFLVSASLKDIIRKHKEVFGNVTEDFAKMHAVQLNDTHPVLAIPELIRLLVDEEGFTFEEAYNIASKTFAYTNHTILAEALEKWDVDLIEELFPRILEIIEKIDAEFIVSLEEKGYSEEEIEEFRIVNDGKVRMANLAIHVGFAVNGVAKLHTDILKNIELKNWYELYPEKFQNKTNGITPRRWLRLCNQELSALITELLGSEDWVKNLDLLKGLEKYKDDEEVLKRFMDIKHTKKEQLAAYIKEHEGVQLDPDSIFDIQIKRLHEYKRQLLNTLYILDLYYRLKENPDMDIPKVTFIYGAKAFPGYKRAKSIVKLTNEVAKLINNDESIKGKIKVVFVENYRVSYAEKLFPAADVSKQISTAGKEASGTGNMKFMLNGAPTFGTNDGANVEIVRESGVDNNFIFGLEVEEIEELKGKYNPVDYYESDADLKRVLDSLVDGTFDDGGNGDFEDLYNSLLEEGDQYFLLADFKAFKDTEDKVFEAYKDKLGWAKKAFENTCNAGMFSSDRTIQEYCDDIWGIKKCTNK

SEQ ID NO: 2919 - protein, 439 aa, Thermoproteus tenax
MSDYLEKIKAQIPNIQPFAGKYAEPVEGSYITYTGPGQLKVPDKVVIGYIEGDGTGPEVAYAAIKVANAAVERAYGKSRRVLWYEVLVGSKAEKILGSRLPDQSVEVLKKIRVFLKAPLETPVGGGFRSLNVTLRQIFDLYANIRPVKYFPGLPSPLKRPESVDLVIFRENTEDVYMGIEWPWNSPEAAKVREFLRRELKVDIRDDAGIGIKPISKFGTQRIARLALKFAVENKRRVVTIMHKGNIQKYTEGAFRDWAYEVAKNEFRDHVVLEEELAQYGGKVPPGKILVNDRIADNMLQQLLTRTGEYDVILAPNLNGDYVSDEAAGLVGGLGVAPGIDVGDWGMMAEPVHGTAPKYTGKNYVNPTATILALELLFRFIGWREAADLITRGVSKAYSEGYFTGDLARQMTDEERKVVKEVLGTQEFAEKVAEIIKTEL

SEQ ID NO: 2920 - protein, 397 aa, Mesembryanthemum crystallinum
MAVSAYTVPTTSHLGFNQKKQLFFCNKSAYKRVSFSSRPCVITCLAGDSQTIVIGLAADSGCGKSTFMRRLTSVFGGAAEPPRGGNPDSNTLISDTTTVICLDDYHSLDRTGRKEKGVTALDPRANDFDLMYEQVKALKEGKAVEKPIYNHVTGLLDAPELIKPPKILVIEGLHPMFDSRVRDLLDFSIYLDISNEVKFAWKIQRDMAERGHSLESIKASIEARKPDFDAYIDPQKQYADAVIEVLPTQLIPGDNEGKVLRVRLIQKEGVQYFSPVYLFDEGSSITWIPCGRKLTCSYPGIKFFYGPDTYFGNEVTVLEMDGQFDRLDELIYVESHLSNLSTKFYGEVTQQMLKHQDFPGSNNGTGLFQTIVGLKIRDLFEQLIASKTAAPAAATKA

SEQ ID NO: 2921 - protein, 535 aa, Triticum aestivum
MAREQLEVLTALDAAKTQWYHFTAIVIAGMGFFTDAYDLFCISLVTKLLGRIYYYREGADAPGSLPPNLAAAVNGVAFCGTLSGQLFFGWLGDRMGRKRVYGMTLMCMVLCSIASGLSFGSTPGSVMATLCFFRFWLGFGIGGDYPLSATIMSEYANKKTRGGFIAAVFAMQGFGILTGGVVTLIVSAAFRAAFPTQAYQDAPLASTPAQADFVWRFILMFGAVPALMTYYWRMKMPETARYTALVAKNAKQAAADMSKVLQVDIGAEEEDPKANDGGAGAADDRNSFGLFSGEFLRRHGLHLLGTATCWFLLDIAFYSQNLFQKDIFTAINWIPKAKTMSALEEVHRIARAQTLIALCGTVPGYWFTVALIDRIGRFWIQLGGFFFMAVFMLGLAFPYHHWTTPGNHIGFVVLYGLTFFFANFGPNSTTFIVPAEIFPARLRSTCHGISAAAGKLGAIVGSFGFLYLAQNQDPAKVDHGYKAGIGVRNSLFILAACNFLGMGFTFCAPESNGLSLEELSRENEEEAPDARTVPV

SEQ ID NO: 2922 - protein, 392 aa, Escherichia coli
KITLQNGKLNVPENPIIPYIEGDGFGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGSPSPVKHPELTDMVIFRENSEDIYAGIEWKADSADAEKVINFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLK

SEQ ID NO: 2923 - protein, 507 aa, Pisum sativum
MSSIVTSSVINVPRSSSSSKNLSFSSSQLSGDKILTVSGKGAPRGRCTRKHVIVTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEYLILAGDHLYRMDYEKFIQAHRESDADITVAALPMDEKRATAFGLMKIDEEGRIIEFAEKPKGEQLKAMKVDTTILGLDDERAKEMPFIASMGIYVISKNVMLDLLRDKFPGANDFGSEVIPGATSVGMRVQAYLYDGYWEDIGTIEAFYNANLGITKKPVPDFSFYDRSSPIYTQPRYLPPSKMLDADITDSVIGEGCVIKNCKIFHSVVGLRSCISEGAIIEDTLLMGADYYETEADKRFLAAKGSVPIGIGKNSHIKRAIVDKNARIGENVKIINSDNVQEAARETEGYFIKSGIVTIIKDALIPSGTVI

SEQ ID NO: 2924 - protein, 214 aa, Bacillus licheniformis
MQTGGSFFDPFNSYNSGLWQKANGYSNGDMFNCTWRANNVSMTSSGEMRLALTSPSYNKFDCGENRSVQTYGYGLYEVRMKPAKNTGIVSSFFTYTGPTDGTPWDEIDIEFLGKDTTKVQFNYYTNGAGNHEKVADLGFDAANAYHTYAFDWQPNSIKWYVDGQLKHTATSQIPTTPGKIMMNLWNGIGVDDWLGSYNGVNPLYAHYDWVRFQK

SEQ ID NO: 2925 - protein, 396 aa, Triticum aestivum
MALSISAPTSSPFLPAPRQVGRWSSSPSSAKPAVFSLRRPVVVARAAAGNAPSSPAGAVVTELDVVSSFSEIVPDTVVFDDFEKFAPTAATVSSSLLLGIAGLPDTKFKSAIDTALVDGECNTMEKPGDRMSCYLTKALGNVGAELAHQVPGRVSTEIDARLAYDTQGIVQRVHELLQIYNEHDIPSERLLFKIPATWQGIEASRLLESEGTQTHLTFVYSFAQAAAAAQAGASVVQIFVGRIRDWAKNHSGDPEIDEALKKGEDAGLALVKKAYVYIHKNGYKTKLMAAAVRNKQDVFSLLGIDYIIAPLKILQSLDESVTDSDEKYGYVQRLTPSLDKMYNFSQEELVKWDQLSLAAAMGPAAEELLASGLEGYANQARRVEELFAKIWPPPNV

SEQ ID NO: 2926 - protein, 251 aa, Salmonella enterica
AGIKEIVLVTHASKNAVENHFDTSYELESLLEQRVKRQLLAEVQSICPPGVTIMNVRQAQPLGLGHSILCARPVVGDNPFIVVLPDIIIDDATADPLRYNLAAMVARFNETGRSQVLAKRMKGDLSEYSVIQTKEPLDNEGKVSRIVEFIEKPDQPQTLDSDLMAVGRYVLSADIWAELERTEPGAWGRIQLTDAIAELAKKQSVDAMLMTGDSYDCGKKMGYMQAFVKYGLRNLKEGAKFRKSIEQLLHE

SEQ ID NO: 2927 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVINFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 2928 - protein, 152 aa, Musa acuminata
MAAIASVKARRIFDSRGNPTVEVDVCLTDGTCARAAVPSGASTGVYEALELRDGGSDYLGKGVLKAVANVNTIIGPALIGKDPTEQVEIDNFMVQHLDGTSNEWGWCKQKLGANAILAVSLAVCKAGASVKKIPLYQHIANIAGNKNLVLPV

SEQ ID NO: 2929 - protein, 365 aa, Aspergillus fumigatus
MAEFVRAQIFGTTFEITSRYNLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVKSLPKRERQPLANKFKNADPEAVDLLERMLVFDPKKRIRAGEALAHEYLSPYHDPTDEPEAEEKFDWSFNDADLPVDTWKIMMYSEILDFHNIDQGNDAGQVLMEGGVAQAQQNYA

SEQ ID NO: 2930 - protein, 338 aa, Mucor racemosus
MVTQVGINGFGRIGRIVLRASLSNPEVQVVAINDPFIPLEYMVYMFKYDSVHGRFQGTVEAKDGKLVVNGKEISVFSERDPAQIPWGSVEAAYVVESTGVFTSIDAASAHLQGGAKKVIISAPSGDAPMFVCGVNLEKYTSDLKVISNASCTTNCLAPLAKVINDNFGIVEGLMTTVHATTATQKTVDGPSNKDWRGGRGAGANIIPSSTGAAKAVGKVIPELNGKLTGMAFRVPTPDVSVVDLTVRLEKGATYEEIKAVIKKASENELKGILGYTNDQVVSTDFVGDAQSSIFDAAAGIALNDKFVKLVSWYDNEFGYSNRVIDLLAYAAKVDAAAQ

SEQ ID NO: 2931 - protein, 354 aa, Thermobifida fusca
MFRHHSRPIRGVNTMPIATPEVYAEMLGRAKSEGFAYPAINVTSSQTLHAALRGFAEAESDGIVQISTGGAEFLSGTTIKDMVTGAVAFAEYARVVAEKYPVNIALHTDHCPKEKLDTFVRPLLAISKERVAKGQEPLFQSHMWDGSAVELEENLQIAEELLKESKEARTILEIEVGVVGGEEDGIVGEINEKLYTTPEDGLRTAEVLGLGEKGYYIAALTFGNVHGVYKPGHVKLRPSVLKEIQDVVGAKYGKEKPFDLVFHGGSGSSLEEIHEAISYGVVKMNIDTDTQYAFTRPIVDHIMKNYDGVLKVDGDVGNKKAYDPRSYGKAAEAGMAARVVEAAQQLKSAGKKLK

SEQ ID NO: 2932 - protein, 80 aa, Glycine max
  unsure (1)..(80): unsure at all Xaa locations
NTTSSNRNASFTSLKSIAGYPTIKTNKHITFIASNGGRMQCMHVWPQFGKKKXENIYYLPDLEDAHXANEVXYLLTKGWI

SEQ ID NO: 2933 - protein, 629 aa, Magnetospirillum magnetotacticum
MTAHGGDGKSRNVAGLMLAAIGVVFGDIGTSPLYAMKETFSGPHAVVMDKGNILGVLSLIFWAITIIVSFKYVVIIMRADNRGEGGSLALLALVSSAAESNRRLSLMVSALGIFAAALFYGDSIITPAISVLSAVEGLQVAAPHLEQWVVPLTLCILFVLFAIQSHGTDLVGKMFGPVMLAWFLTLAILGIRNLSHAPSVLAALSPHYAISFLFREGWHGFLALGSVVLAVTGAEALYTDMGHFGRLPIRLAWYILVLPALILNYFGQGALLLHDPAAITNPFFNLAPASLALPLVILATMATVIASQAVISGAFSVTRQAIQLGFLPRMEIIHTSEEEMGQIYLPFVNWLLMCMVMTLVVGFKTSSNLAAAYGVAVTGTMVIDALLVGTVMLLIWKWNPRKVKLMIGGFLVVDLAFFLANSVKIPDGGWFPLVVGGLLFTILTTWKDGRKRLLARLKADALPVEDFLASLSDRVPRVPGTAVFLTGTSEGVPIALLHNMKHNKIVHERVVLLTVIVEEVPFVPEERRLENRLLAPNFHRVFLRYGFMESPNIPKALAHARTDQLGFFYEPMSVSYFVSRETLLPTEKPGIKGLRDTLFATLARMATSAMDFFHLPSNRVVELGSQIEI

SEQ ID NO: 2934 - protein, 371 aa, Thermosynechococcus elongatus BP-1
MATFLRPELSNFRAYSTPTSDSLPLELDYLDTNEFPWDLPTALKEVLAQQYVSTLASHRYPDSHHWPLRQAIARYVSEQSPTEISPHQIAVGNGSDELIRSILLATAIGGYGSILVAEPTFSIYGILAQTLGIPVHRATRDPDTFAVEIAAANTLIAQAAPPVRVLFMLQPNSPTGNPLTAAEVDWLRQLPEDILVVIDEAYFEFSGKTLVGDLAAHPNWLILRTFSKAFRLAAHRVGYAIGNAEVIAVLEKVRLPYNLPTFSQVAAQVVLDHRQALLAEIPTVLAQRDRLYKWLQSCPQLHVWPSVANFLFFRLREPQHTPSLWDALRDQGTLVRAIAGGIRVTIGTPAQMERFWQRLQASLNQQKSTDN

SEQ ID NO: 2935 - protein, 303 aa, Chlamydophila pneumoniae CWL029
MSLFLVFLTAFIWSSSFALSKLVMNASAPIFATGARMVIAGAILALAAWFRGGFVGISKKIFLYIVLLALTGFYLTNIFEFIGLQSLSSSKTCFIYGLSPLMSALFSYIQLKEKVTLKKVLGLSLGLVSYICYLTFGGGGDDSQPWTWQIGLPELLILGAASLASFGWTLLRQIEKQSTLSVTAINAYAMLIAGMLSIMHSAVVEPWRPLPVQDISQFLYATLALVVISNLICYNLYAKLLRKYSSTFLSFCNLVMPLYSGFYGWILLGEKGVSLGLVLAVAFMVAGCRLIYHEEFRQGYIVS

SEQ ID NO: 2936 - protein, 111 aa, Zea mays
  unsure (1)..(111): unsure at all Xaa locations
TDAFCPAFCSWSDYSDDKLLQTRVFSYADPQRHRLGPNYLMLPVNAPXCARHPSHPDGFMNFMLGADQVNCFPSRFVPARPAGRRPLPPRGSPGRRVARLLPPAFVSSQAG

SEQ ID NO: 2937 - protein, 772 aa, Neurospora crassa
MSTPITATATLPRAYSDRYHSQFAYQHHHQPYPVQANASSFYSQNTSNLPSILSPTGTRQPFPDPPSAQYSLVDHQSPVNAPPPLIASSVVLKPITRTLPPPHQCPSQQLPPQRLTLQPGIDHTAMATGLNPEGSEPASQQTRKRRRGETNWAEFYQNGLPKEVIVIDDTPEPEGTATRSVASQTLSNAHIVTNPSAPTQPTAKRRRPNGHYDPVHHDNYVPAQNQTQRSLPSASHSLNSPASTSNSANSAQHTTTATSLGSLSSHSYNDDYAQPGTKRRKLTRQQANEAKRRETAHADTFAVYKPPPYPPKKAGEVHVKVIQDTSPNQNARVDDDDGHMIVIPGNDLTERCTFGKVVQAKDKKRNKLVAIKIIRSVQKYRDASKIELRVLATLKANDEENRNRCIHLRDCFDFRGHICIVMDLLGQSVFDFLKDNNFVPFPNSQILAFARQLFTSVAFLHDLNLIHTDLKPENILLCNQEYQTFTYSRTIPSSSTLTNRRAVHRKVLLDTEIRLIDFGSATFQDEYHSSVVSTRHYRAPEIILGLGWSFPCDIWSIGCILVEFYTGDALFQTHDNLEHLAMMEAVVNHKIDPSLVQQVNRMTRNGGNPAAKFFKRSKLDYPAPDTTRASKRFVKGMKPLDVSKPLSTNGSESTSRQTTVPKPPESGSKRKQKDNAGRWKREELCYRPCTQHDAGVLLDLSTRGKREFLREFQNSKPEAALERKYFGIREVGGDTEQSGGRCISPGLSLPKSDTGSKRHVQCHLNSKREESG

SEQ ID NO: 2938 - protein, 218 aa, Pseudomonas aeruginosa UCBPP-PA14
MVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 2939 - protein, 411 aa, Corynebacterium efficiens YS-314
MAPPDFYAPSLAIIPLPETTPPVNPPALRDHLLKLVGSRCNLNSMTSIEFTVTRTENPTSPDRLKEILTAPKFGKFFTDHMVTIDWTEDGGWHNAQVVPYAPIPMDPATTVFHYGQAIFEGIKAYRHADGTIKTFRPEENALRMQRSAARMAMPELPVETFIKSLELLVDIDQDWVPAAGGEASLYLRPFMISTEVSLGVSPANAYKFIVIASPVAAYFSGGIKPVSVWLSEDYVRAAPGGTGAAKFAGNYAASLLAQAQAQEKGCDQVVWLDAIEHRYIEEMGGMNLGFIYRNGDNVKLVTPELSGSLLPGITRDSLLQVARDLGYEVEERRISTTEWEEDATSGAMAEAFACGTAAVITPVGTVKSNHGEFVVNNNEAGEITMKLRETLTGIQQGKVDDTHDWLYTLVK

SEQ ID NO: 2940 - protein, 714 aa, Burkholderia fungorum
MARKKWRSPPAPRNLSARANRHAANSAASSATSTAANATPHPSNATCHSARCAQPECRPEEACLAARQDPDQLTPRLQRQGTALARRCFDHPHAPCTKESLMSQTVGDFIIERLHAWGVRRIYGYPGDGINGVFGALNRAQTEAARHRKKGSDDSAHAIEFVQVRHEEMAAFMAAAHAKFTGELGVCIATSGPGASHLLTGLYDARMDHMPVLAIAGQQARAALGGHYQQELDLVSMFKDVAGAFVEQATVPAQVRHLVDRAVRTALSERKVTALILPNDLQDLPYEAPGRKHGTLHSGVGYRAPRLVPYPDDLQQAADILNAGKKVAILVGAGGLHATDELIAVAEKLGAGVAKALLGKAALPDDLPWVTGSIGLLGTKPSYDLMAECDTLLMIGSGFPYAEFLPKEGAARGVQIDIKADMLSLRYPMEVNLVGDSAETLRALLPLLEEKKDRAWRKRVEGWSADWWKTLDKRAHEPGKDAVNPQLTVWELSKRIASNAIVTSDSGSVANWYARDLKVQRGMMCSLSGGLASMGAAVPYAIAAKFAYPERPVIALVGDGAMQMNNMAELITVSKYWRGWSDPRWICMVLNNQDLNQVTWEQRAMEGDPKFEASQDIPCVPYHKFAELIGLKGIYVDDAQQMGAAWDDALAADRPVVIEVKADPNIAPLPPHITLAQAKAFASTLMKGDPNEGNVIVETAKQVLDAVLPGHHSK

SEQ ID NO: 2941 - protein, 901 aa, Oryza sativa
MDIVPVVALCCCLVLLPSWAYGLGSMASIAVSYGEDGPVFCGLNSDGSHLVTCFGADASVVYGAPSRIPFVGVTAGDGFACGLLLDTNQPYCWGSNSYVKIGVPQPMVEGAMYSELSAGDNHLCALRTSVKGFHSVNGDTSVIDCWGYNMTATHTVTGAVSAISAGSVFNCGLFARNRTVFCWGDESVSGVIGLAPRNVRFQSIGAGGYHVCGVLENAQVFCWGRSLEMQQMSTPSSTDDGDVNIVPMDAMVSVVGGRFHACGIRSLDHQVACWGFTLQNSTLAPKGLRVYAIVAGDYFTCGVPAETSLKPMCWGHSGPLALPMAVSPGICVSDSCSHGYYEYANHGEVGSGSKTCKPANSRLCLPCSVGCPDDSYESSPCNATADRVCQFDCSKCASDECVSFCLSQKRTKNRKFMAFQLRIFVAEIAFAVILVFSVTAIACLYVRYKLRHCQCSKNELRLAKNTTYSFRKDNMKIQPDVEDLKIRRAQEFSYEELEQATGGFSEDSQVGKGSFSCVFKGILRDGTVVAVKRAIKASDVKKSSKEFHTELDLLSRLNHAHLLNLLGYCEDGSERLLVYEFMAHGSLYQHLHGKDPNLKKRLNWARRVTIAVQAARGIEYLHGYACPPVIHRDIKSSNILIDEDHNARVADFGLSILGPADSGTPLSELPAGTLGYLDPEYYRLHYLTTKSDVYSFGVVLLEILSGRKAIDMQFEEGNIVEWAVPLIKAGDISALLDPVLSPPSDLEALKKIAAVACKCVRMRAKDRPSMDKVTTALERALALLMGSPCIEQPILPTEVVLGSSRMHKKVSQRSSNHSCSENDLVDGDDQRIEYRAPSWITFPSVTSSQRRKSSASEADMDGRTTTDGRNVGSSIGDGLRSLEEEISPASPQENLYLQHNF

SEQ ID NO: 2942 - protein, 331 aa, Escherichia coli O157:H7 EDL933
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 2943 - protein, 241 aa, Glycine max
MGRGRVELKRIENKINRQVTFAKRRNGLLKKAYELSVLCDAEVALIIFSNRGKQYEFCSGSSMLKTLERYQKCNYGAPEDNVATKEALELSSQQEYLRLKARYEALQRSQRNLMGEDLGPLSSKELESLERQLDSSLKQIRSIRTQFMLDQLSDLQRKEHFLGESNRDLRQRLEEFQINPLQLNPSAEDMGYGRHPGQPQGHALFQPLECEPTLQIGYHPDPVSVVTEGPSMNNYMAGWLP

SEQ ID NO: 2944 - protein, 333 aa, Phytophthora infestans
MANQVDHSNPITLSRFILAEKEIQGNADLSVLFTSIELACKVIASSVRRAGLTGLYGLDGSENSTGDQVKKLDVLANDIFINSLKFSTKIEVMVSEEEEKPIVVQNDSSGTKYCIAFDPLDGSSNIDCNVSTGTIFAIYQRDASSEGGYKDILQPGSKLVSAGYCMYGSSTQLVLTWGKGVHCFTLDPTIGAFMLSHQDIRIPDEPKAIYSCNEGNYAQWDSATKAFVDECKTGSKAYAARYVGSMVSDIHRTILYGGIYLYPGSTKAKDGKLRLLYECNPMSFIVEQAGGMATTGTERILDLVPTDIHQRSPIFLGCKRDVERVIALYKEHN

SEQ ID NO: 2945 - protein, 250 aa, Zea mays
MYFRPPPKGPEWYASDAETGQAARPLYPMMLEDPRLRWAFIRKVYSILSIQMLLTVAVAAVVVFVRPVALFFVSTPGGFGLYIFLLILPFIVLCPLYYYYQHHPVNLLLLGLFTVAISFAVGLTCAFTKGEVILESAVLTAAVVLSLTAYTFWAAKRGHDFSFLGPFLFAAVMILMLFALIQLFFPLGRISLMIYGGLAALVFCGYIIYDTDNLIKRYSYDEYVWAAVALYLDVINLFLSLLTLFRAADS

SEQ ID NO: 2946 - protein, 647 aa, Arabidopsis thaliana
MHGRPRNASKPEEEAASAAKAVQLRSLQSQFMTNHHDKIYTNEAIELSTKLLEINPEAYTAWNYRKLAVEDRLARIEPDPNLVSAILDEELRVVESALRQNFKSYGAWHHRKWVLSKGHSSVGNELRLLEKFQKLDSRNFHAWNYRRFVVELTNRSEQDELQYTDDMINNNFSNYSAWHNRSVLLSSLLAQNADGFMPNIKIPEEYDFVHSAIFTEPDDQSGWFYHLWLLDQTLNVETPLLTSSWPSHGSSIILSGAGCLSGSSSMFTTFCSESGSFPLILYFDQAVGGVSSSTVTIDSELKGNEGLVWEPIPNKNSQVSCVWVARLKYVSSDPCEYKVKIRVGNSPGIVSSRGYNFNAPYEFVFTAHVHDTVEDSQEGIVSWTDGFDIWDAKSKDLNSLVTLDRLNAEMDFKWRQEAIDSEVECFGILPDSKIGKLTLARLLMAREAMVSDDAVKGVHYEEILQLYNDLMALDSSHYQYYKDEHSKAFLHKRMFMQVTSSSESLSRHLLRYRDMNNLVCLRLNNLSLSRIASVEKLLFVQMLDLSHNELHSTEGLEAMQLLSCLNLSHNRIRSFSALDSLRHVKQLKVLDVSHNHIGKHSVDTTRYLCSSPLSNSELGQDDVGKQNPGLVTKYWDAYCVLTDLNLK

SEQ ID NO: 2947 - protein, 233 aa, Zea mays
ALVRYGGAGEQQDRRQRQRQRHGGGRSGRGRGREQGEEPRRRADPRLQAISDAIRVVPHFPKPGIMFNDITELLLRPGVFRDAVDMFVERYRGMGIAAVAGIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKVPKSKFVQKSYQMYISFFSRCTNMLLTCTSVS

SEQ ID NO: 2948 - protein, 740 aa, Zea mays
  unsure (1)..(740): unsure at all Xaa locations
PGKRSFSGKLRHYQDEETVFGVLSLIFWTFTLIPLLKYVIIVLSADDNGEGGPFALYSLLCRHAKLSLLPNQQAADEELSSYYRNGFAPRNGSSPWSRRFLEKHKKMRTLFLLIVLCGASMVIGDGVLTPAISVLSSMSGLHVRATGLNHSSVVLLSCIVLVGLFALQHRGTQKVAFMFAPIVIIWLLSIGGIGLYNILHWNPNVYQALSPYYMVKFFRKTGKDGWIALGGILLSMTGSEAMFADLGHFTSASVRVAFITVIYPCLMLQYMGHAAFLSKNTFHMPTGFYDTIPEPVFWPVFVVATLAAVVGSQAVISATFSIVKQCHALGCFPRVKVVHTSRWIYGQIYIPEINWILMVLCVAVTIAFRDTTLIGNAYGIACMTVMLVTTFLMALIVIFVWQRNIIFSLVFLVFFGSIEAVYLSSSLMKVPQGGWVPLVLAFIFMSVMYIWHYGSRRKYQFDLQNKVXMRSILSLFCCLTIAXITKIKLIYTELVTGVPSIFSHFVTNLPAFHEVLVFLCVKSVPVPYVSPDERYLVGRIGPKEYRMYRCIVRYGYKDVQRDDDNFENMLVMNIAKFIMMEAEDASSSASYDVSNEGRMAVITTTDASGSPLAMRDFDGLADSMTMRSSKSETLRSLQSSYEQESPSVSRRRRVRFEVPEEDGMGRQVKEELMALVEAKHAGVAYIMGHSYIKARRSSSFLKKFAIDVGYSFLRKNCRGPSVTLHIPHISLIEVGMIYYV

SEQ ID NO: 2949 - protein, 364 aa, Oceanobacillus iheyensis HTE831
MQGKEILKQLSPYKQGKQIKDIQKDYQLDYIVKLASNENPYGYSKQVNEALSTENFDFHIYPDGYTSDLRTDLTQKLNIDESEIIFGSGSEEIIQLLCRSYIIPGSNVVMATPTFPQYKHYSLIENAEIKEIPTDKEGYHQLDKMLGSIDDHTAIVWLCTPNNPTGAAFSKEELITFLDNCPKEVLVVLDEAYYEYLHSDKDLDALQLRFTYSNVIVLRTFSKAYGLAGLRIGYGIANSTIIETLDKVRGPFNTNSVAQKAASYALKDQEFIQHTNQENYKNLTEFQHFLQRLGWGYYDSEANFLLVKTPISGMDVYEYLLRFGFIVRPGELLGIPKTVRVTIGKEQDMKELQKVLEQFDHELG

SEQ ID NO: 2950 - protein, 323 aa, GIBBERELLA ZEAE PH-1
MGNTYSLMFPPKPQFTEENLQPQDGRVFLVTGGYSGIGFELSRMLYEAGGSVYIAGRSQEKGEQAIAQLKGHCPDSSGSLSFLKISLDDLKSVKSAAEEFIAKESRLDVLFNNAGVSMPPPGSVSAQGYELSIATNAIGPWYFTQLLVPVLTQTAKNQPPASVRVVWTASIVTDVALPKGGVDMKEVINPSKDPQVNYTNSKTGNWYLASVLANQIGSQGVLSVCHNPGNLQTSLLRHMPWAVRYAVSIILYHAKFGAYTNLWAGLSPDLQIEDGGRFIWPWGRFHPSPRPDLLENLKSKEQGGTGTAAEFAEYCDKIIAEHR

SEQ ID NO: 2951 - protein, 341 aa, Oceanobacillus iheyensis HTE831
MNTKRIAITGFGRIGRMIFRQAIQNDQFEVVAINASYPAETLAHMVKYDSVHGIFDGDVKALEGYLEIDGKKVEIVNNRQPELLPWKKLDIDIVIEATGKFNSKEAAGLHIKAGAKKVIITAPGKQVDKTIVMGVNEAAYIPESDDVISNASCTTNCLAPVVKVIDDHFTIKNGLMTTVHAFTNDQKNLDNPHKDLRRARGCTQSIIPTTTGAAKALGEVLPHLNGKLHGMALRVPTPNVSLVDLVIDVEENVTVEQLNQLFKDASKGYMKGVLEYSDEPLVSIDYTTSDFSAIIDGLSTIVMEGKKIKVIAWYDNEWGYSKRVLDLALYVGDRLKKEMKV

SEQ ID NO: 2952 - protein, 505 aa, Helianthus tuberosus
MEIPYLLTTTLLLLFTTLYLLLRRRSSTLPPTIFPSLPIIGHLYLLKPPLYRTLAKLSAKHGQILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 2953 - protein, 67 aa, Lactobacillus delbrueckii subsp. lactis
EMCTTIRETVKDLYNEETAENVRIQYGGSVKPANIKELMAKPNIDGGLVGGASLVPDSYLALVNYQD

SEQ ID NO: 2954 - protein, 337 aa, Zea mays
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 2955 - protein, 498 aa, Gluconobacter oxydans
MNVVSKTVSLPLKPREFGFFIDGEWRAGKDFFDRSSPAHDVPVTRIPRCTREDLDEAVAAARRAFENGSWAGLAAADRAAVLLKAAGLLRERRDDIAYWEVLENGKPISQAKGEIDHCIACFEMAAGAARMLHGDTFNNLGEGLFGMVLREPIGVVGLITPWNFPFMILCERAPFILASGCTLVVKPAEVTSATTLLLAEILADAGLPKGVFNVVTGTGRTVGQAMTEHQDIDMLSFTGSTGVGKSCIHAAADSNLKKLGLELGGKNPIVVFADSNLEDAADAVAFGISFNTGQCCVSSSRLIVERSVAEKFERLVVPKMEKIRVGDPFDPETQIGAITTEAQNKTILDYIAKGKAEGAKLLCGGGIVDFGKGQYIQPTLFTDVKPSMGIARDEIFGPVLASFHFDTVDEAIAIANDTVYGLAASVWSKDIDKALAVTRRVRAGRFWVNTIMSGGPETPLGGFKQSGWGREAGLYGVEEYTQIKSVHIETGKRSHWIS

SEQ ID NO: 2956 - protein, 453 aa, Streptomyces avermitilis MA-4680
MDKQQEFVLRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALAKTSDLGFTFYTHPEIEFFLLKDKPLDGSRPTPADNSGYFDHTPQNVGMDFRRQAITMLESMGISVEFSHHEGAPGQQEIDLRYADALSTADNIMTFRLVMKQVALEQGVQATFMPKPFSEYPGSGMHTHLSLFEGDRNAFYESGSEYQLSKVGRSFIAGLLKHAAEISAVTNQWVNSYKRIWGGSERTAGAGGEAPSYICWGHNNRSALVRVPMYKPGKTGSARVEVRSLDSGANPYLAYALLLAAGLKGIEEGYELPPGADDDVWALSDAERRAMGIEPLPQNLGEALALMQRSELAAETLGEHVFDFFLRNKKQEWEEYRSEVTAFELRKNLPVL

SEQ ID NO: 2957 - protein, 306 aa, Streptococcus pneumoniae
MKKVKKAVIPAAGLGTRFLPATKALAKEMLPIVDRPTIHFVIEEALRSGIEDILVVTGKSKRSIEDYFDSTFELEYSLRKQGKMELLKSVNESTDIKVHFVRQSSPRGLGDAVLQAKSFVGDDPFVVMLGDDLMDITDSTAVPLTRQLMDDYNATQASTIAVMPVRYEDVSSYGVISPRLESSNGLYSVDAFVEKPKPEEAPSNLAIIGRYLLTPEIFSILETQKPGAGNEIQLTDAIDTLNKTQSVFAREFVGKRYDVGDKFNFMKTSIDYALQHPQIKESLKNYVIALGKQLEKLDDCSSSGHL

SEQ ID NO: 2958 - protein, 353 aa, Sporothrix schenckii
MGCGMSVEEKEGKARNEEIENQLKRDRMQQRNEIKMLLLGAGESGKSTILKQMKLIHEGGYSRDERESFKEIIYSNTVQSMRVILEAMESLELPLEDQRMEYHVQTIFMQPAQIEGEVLPPEVGNAIEALWKDAVVQECFKRSREYQLNDSARYYFDNIARIAAPDYMPDDQDVLRSRVKTTGITEKTFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDYEGGDDYAAACDYILNRFVNLNQHESKQIYTHFTCATDTTQIRFVMAAVNDIIIQENLRLCGLI

SEQ ID NO: 2959 - protein, 426 aa, Thermosynechococcus elongatus BP-1 [sequence omitted]

SEQ ID NO: 2960 - protein, 474 aa, Campylobacter jejuni subsp. jejuni NCTC 11168
MKKLTNDFGNIIADNQNSLSAGAKGPLLMQDYLLLEKLAHQNRERIPERTVHAKGSGAYGEIKITADLSAYTKAKIFQKGEVTPLFLRFSTVAGEAGAADAERDVRGFAIKFYTKEGNWDLVGNNTPTFFIRDAYKFPDFIHTQKRDPRTHLRSNNAAWDFWSLCPESLHQVTILMSDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSFVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYAPLDNDFYTQPRALFNLMNDDQKTQLFHNIAASMEGVDEKIITRALKHFEKISPDYAKGIKKALEK

SEQ ID NO: 2961 - protein, 259 aa, Bacillus subtilis subsp. subtilis str. 168
MKHIAGKRIWITGASGGLGERIAYLCAAEGAHVLLSARREDRLIEIKRKITEEWSGQCEIFPLDVGRLEDIARVRDQIGSIDVLINNAGFGIFETVLDSTLDDMKAMFDVNVFGLIACTKAVLPQMLEQKKGHIINIASQAGKIATPKSSLYSATKHAVLGYSNALRMELSGTGIYVTTVNPGPIQTDFFSIADKGGDYAKNVGRWMLDPDDVAAQITAAIFTKKREINLPRLMNAGTKLYQLFPALVEKLAGRALMKK

SEQ ID NO: 2962 - protein, 744 aa, Ferroplasma acidarmanus
MKPNDGILLRIAEANATDPGMARVRLDEISRLDLDVEIGDVVAIEKVRSTVGRVFRSRPEDENKGIVRIDSVMRNNCGASIGDKVKVKKVEVEEAKKVVLAPIIRKDQKLRFGEGIDDFVQKALIRRPLIEQDSISVPGLTLAGHTGLLFKVIKTIPSKIPVEVSEETRVEIREDPASEVLEEVTKVSYEDIGGLSDQLGKIREIIELPLKHPELFERLGITPPKGVLLNGPPGTGKTLIAKAVANESGANFFAINGPEIMSKYYGQSEQKLREIFQKADESEPSIIFIDEIDSIAPKREDVQGEVERRVVAQLLTLMDGLKDRGHVIVIGATNRLDAVDPALRRPGRFDREIVIGVPDKKGRMEILTIHTRGMPLGMDDEKESEFFSRIADITYGFVGADLAALTRESAMNALRRYLPEIDLDKPIPTEVLEKMIVTEDDFMEALKTIEPSSLREVTVEVPNIKWNDIGGLEALKSELREAVELPLLNPDVFSRLGIRAPKGFLLYGPPGTGKTLLAKAVANESNANFISVKGPEVLSKWVGDSEKAVREIFKKAKQVSPAIIFMDEIDSIAPRRGTSMDSGVTERIVNQLLTSMDGIEVLKGVVVIAATNRPDIIDPALLRAGRFDKIIYIPPPEEEGRLKILEVHTRKMPLAKDVDLKDIARKTDGYVGADLENLCREAGMMAYRNNPEATEVNQDAFIKAMKTIRPSIDKNVTKFYSDLAATMGRDISEKKKTEDLGLYQ

SEQ ID NO: 2963 - protein, 468 aa, Akkesiphycus lubricum
IPYAKMGYWDADYNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPFAYLKTFQGPATGVVVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTAIVMIDLVIGYTAIQTMAIWARKAEMILHLHRAGNSTYARQKNHGINFRVICKWMRMCGVDHIHAGTVVGKLEGDPLMVKGSYNSLLLTQLKINLAEGLFFDMDWASLRKCVPVASGGIHCGQMHQLLYYLGDDVVLQFGGGTIGHPDGIQSGATANRVALESMVMARNEGRDYVGEGPEILRNAASTCGPLKAALDLWKDITFDYTSTDTPDFVEVATEAK

SEQ ID NO: 2964 - protein, 419 aa, Prionitis divaricata
DTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGLDYVAEGPQILQDAAKTC

SEQ ID NO: 2965 - protein, 678 aa, Oryza sativa
MAASSAQLIFLLLLAVLAAASSRNDEEARALMALKESLDPAGRVLGSWARSGEPCGGSFVGVTCDSGGRVTAISLQGRGLSGTLPPAIAGLRRLTGLYLHYNGIKGAIPREIGSLSELTDLYLDVNHLTGPLPVEIAAMENLQVLQLGYNQLTGSIPPQLGKLNKLAVLALQSNQLTGAIPATLGDLTQLARLDLSFNSLFGSIPSKIAEVPLLEVFDVRNNSLSGSVPAGLRRLNGGFQYVNNKGLCGVGFSLLDLCLSSEDGLKPSKPEPFGPDGTVKTRQVPQSANTDNHCEGSGCSKSSNASVGVLVVGVVAVVIGAAFCGIFAFSYYRRQKQKIGSSLEVSDSRLSTDHYQQKEVCRRSASPLISVEYSNGWDPLSGGGVGSSGEVGDSFRFNLEEVECATQYFSEVNLLGKSGFAATYKGILRDGSVVAVKSLNKTSCKQEESDFLRGLKMLTVLRHENLVGLRGFCCSRGRGECFLVYDYMVNGCLSQYLDVKEGSGANVLDWPTRVSIIRGIAKGVEYMHSKKANKPSVVHQNISAEKILLDHHLTPRLSVPGLHKLLADDVVFSTLKASAAMGYLAPEYATTGRFTEKSDVFAFGIVVLQVITGRRAVSQLKVSTVANDLDSLIDENLNGVFSRTEAAKLAAIAALCTSETASQRPTMEAVVQQLSNCH

SEQ ID NO: 2966 - protein, 356 aa, Eucalyptus globulus
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 2967 - protein, 497 aa, Burkholderia fungorum
MDKKSLAFWQDKAATLSIEGRAFIDGEYRDAEGGRTFDCLSPIDGKLLAKVADSGAADVDAAVSAARRAFDSGVWSGLNPRQRKAILLRWAASIREHMDELALLETLDAGKPIADTTSVDVPGAAYCVEWFAEAIDKVGGEVAPADHHLVGLVTREPIGVVAAVVPWNFPILMASWKFGPALAAGNSVVLKPSEKSPLTAIRLAQLALDAGIPAGVFNVVPGAGEPGKLLALHQDVDCLAFTGSTNVGKLIMQYAGQSNLKRVWLELGGKSPNIVMPDCPDMDRAANAAAGAIFYNMGEMCTAGSRLLVHRDIKDVFLDKLIAAARSYTPGNPLDPNTSMGAIVDKVQLERVLGYIEAGRAEAKLLLGGARVKEETGGFYIEPTIFEIPASGAKVAREEIFGPVLSVITFDTVEEAIRIANDSEYGLAAAVWTSNLTIAHEVSRKLRAGTVWVNCYDEGGDMNFPFGGYKQSGNGRDKSLHALEKYTELKSTLVRLR

SEQ ID NO: 2968 - protein, 431 aa, Yersinia pestis CO92
MSKIVKVIGREIIDSRGNPTVEAEVHLEGGFVGLAAAPSGASTGSREALELRDGDKSRFLGKGVLKAVAAVNGPIAQAVIGKDAKDQANIDKIMIDLDGTENKSQFGANAILAVSLAAAKAAAASKGMPLYEHIAELNGTPGKFSMPLPMMNIINGGEHADNNVDIQEFMIQPVGAKTLKEAVRIGSEVFHHLAKVLKAKGLNTAVGDEGGYAPNLGSNAEALAVIAEAVKAAGYELGKDITLAMDCAASEFYKDGKYVLAGEGNKAFTSEEFTHFLEDLTKQYPIVSIEDGLDESDWAGFKYQTEVLGDKIQLVGDDLFVTNTKILKEGIEKGVANSILIKFNQIGSLTETLAAIKMAKDAGYTAVISHRSGETEDATIADLAVGTAAGQIKTGSMSRSDRVAKYNQLIRIEEALGDRAPFNGLKEVKGQ

SEQ ID NO: 2969 - protein, 268 aa, Glycine max
GKPLKAKHPSFFLLNFVSFINRLKVLSALDTARTQYYHFKAIIIAGMGLFTDAYDLFSITLIIKIIGRVYYGHREGENRYETPPEVVSALVAVALLGTAVGQLVFGRLGDLKGRRRVYGFALLLMVFSSLASGFSICIRKTCVLLTLGFFRFFLGLGIGGDYPLSSTIMSEFANKKTRGSFIAAVFSMQGFGILASSTVTMAVCSIFGAASKNSEADVAWRLILMLGSVPAAMTYYWRMMMPETARYLLPFTFSLYNFIFSFNLFIIQ

SEQ ID NO: 2970 - protein, 403 aa, Nostoc punctiforme
MTNMQFAKRLQPLQSNVFADMDRAKAIALAAGQEVIDLSLGSSDLPVEAHVIEAIAQSLHDRSTHGYLLFNGTLGFREAAANWYEQKFGIKVDPQTEVLPLIGSQEGTAHLPLALLNPGDFALLLDPGYPSHAGGVHLASGQIYPMPLRAENAFLPVFADIPAPVLAQSRMMVLSYPHNPTSAIAPLSFFQEAVAFCQQHNLILVHDFPYVDLVFQETGEWADSSPNPKSLVPSILQADPEKSVSIEFFTLSKSYNMGGFRIGYAIGNAELINALRQVKAAVDFNQYRGILNGAIAALTGPQAGVKSAVAIFQQRRDAFITALHSIGWNVPTPKATMYIWAKLPSAWSQNSIEFCTQLVKQTGVAASPGAGFGKSGEGYVRFALVHEPPLLETAVERIAQFLY

SEQ ID NO: 2971 - protein, 469 aa, Pseudomonas aeruginosa UCBPP-PA14
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIIGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVVFILGIMLMIPGINISVYAIPFWLLLMWLCYRVKLSLAERRGLGQQA

SEQ ID NO: 2972 - protein, 292 aa, Pseudomonas aeruginosa UCBPP-PA14
MRTPAWLGSGMPLLFVLLWSTGFLGAKFGLPYAEPFTFLAIRLLLAAALLAAFALLSGAPWPGSARLAGHVAVAGLLVHGLYLGGVFLAIEHGMSAGLTSLLVGLQPLATAALAGIWLGEQVSRRQWLGLALGLAGVALVVLGRIHGGADGLAWAAVLVALAAITCGTLYQKRFCGGMDLRTGGVVQYLASGALLGLAALLFESREVQWSTPFVLTLGWLVLGLSFGAVGLLYTLIRHGAASKVASLFYLVPPVTALASWLLFDEPLAPAAIGGMLLVMLGVALVNWPGRRA

SEQ ID NO: 2973 - protein, 494 aa, Bacillus anthracis str. A2012
MSQLAVNLHEKVEKFLQGTKKLYVNGSFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDFFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASESLKRVTLELGGKSPNIILPDADLSRAIPGALSGVMFNQGQVCSAGSRLFVPKKMYDNVMADLVLYSKKLNQGVGLDPETTIGPLVSEEQQKRVMGYIEKGIEEGAEVLCGGNNPFDQGYFISPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 2974 - protein, 80 aa, Triticum aestivum
  unsure (1)..(80): unsure at all Xaa locations
QLAFCPGLIVPGIYYSDDKLLQTRIFSYSDTQRHRLGXIYLLLPANAPKCAHHNNHYDGFMNLMHRDEEVDYFPSSTTLP

SEQ ID NO: 2975 - protein, 136 aa, Glycine max
  unsure (1)..(136): unsure at all Xaa locations
TSCSCYAPFFFPGGNLITVKNRFDCQVALLWTLEIFSWSFLGAVSVINSSSERLGGARVVATAVVPXHXSKIQDILRRWSDIDQMDLIITLGGTGFTSRDLMSEATKPXIEKETTGILYVMMQESLKIINMPGNCC

SEQ ID NO: 2976 - protein, 243 aa, Zea mays
  unsure (1)..(243): unsure at all Xaa locations
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGXPFVDYYLNGPXLLNYPFSGGATFFILLSLAPLAGVLHM

SEQ ID NO: 2977 - protein, 249 aa, Agrobacterium tumefaciens str. C58 (U. Washington)
MFTQMVSMRLNEMLGVSVEVCRSFEELQACYEHSPEPVTLAISNINLPGAEKGEALEYLIDLSIPTIVFTSTFHEATRETLIAKDVVDYILKDNIFAVDMLTESVCRFLTNHRHHVLIVDDSPTARALLSSRLKRYNFRVSLADSGAKALEILRANPDIGLVVTDYNMPDIDGFELTRRIRTVRGSHELRIIGVSSSTNRLLSARFLKAGGNDFMLRPFIDEEFYCRVNQNLDTLVQIQLAKAGIRPAA

SEQ ID NO: 2978 - protein, 180 aa, Lycopersicon esculentum
MASSVISSAAVATRSNVTQASMVAPFTGLKSSATFPVTKKQNLDITSIASNGGRVSCMQVWPPINMKKYETLSYLPDLSDEQLLSEIEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 2979 - protein, 317 aa, Capsicum annuum
INGFGRIGRNFLRCWHGRKDSPLDVVVVNDSGGVKNASHLLKYDSMLGTFKADVKVVDNETISVDGKPIKVVSNRDPLKLPWAELGIDIVIEGTGVFVDGPGAGKHIQAGAKKVIITAPAKGADIPTYVVGVNEQEYTHEVANIVSNASCTTNCLAPFAKILDEEFGIVKGTMTTTHSYTGDQRLLDASHRDLRRARAAALNIVPTSTGAAKAVSLVLPQLKGKLNGIALRVPTPNVSVVDLVINVEKKGITAEDVNAAFRKSADGPLNGILAVCDVPLVSVDFRCSDVSTTIDSSLTMVMGDDMVKIVAWYDNEWN

SEQ ID NO: 2980 - protein, 509 aa, Yersinia pestis KIM
MMSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 2981 - protein, 192 aa, Triticum aestivum
  unsure (1)..(192): unsure at all Xaa locations
MAATIQSVKARQIFDSRGNPTVEVDVCCSDGTFARAAVPSGASTGVXEALGTEGMVDSDYLGKGCIQSCLDNVNSXIAPVWIGKXDPNSSNWSSDNYMVQXQLDGTKNEWXLCKQELXANATWLCQQLFCKAGSXVQEDPPXQHXQPGWNNGLPVLHQTMVQAGNNCIRISTRPSGGRNGLCQTSYRLSQGK

SEQ ID NO: 2982 - protein, 275 aa, Triticum aestivum
  unsure (1)..(275): unsure at all Xaa locations
MSTALAPGMARGHGFRGAGKGKQRPDSEEPETNRGGGPNGFYVEEEEGEEVGTEELRELEEALSDASSIGAASSDSSSIGEXSRPRTSCSEVVAEVPAATPPADAVLAMGLGTVGCLEDALPSKRGLSNFYAGKSKSFTSLAEAAAKAAAKEIAKPENPFNKRRRVLAAWSRRRASCSSLVTTYLPPLLSLDHTVVEGDEEEEEERSDDGDDEDNGSGNGRREKAPASPRFPPRSLHSASQKASVMSRNMINPNTSSFRSPRSFSLSDLQNAGYN

SEQ ID NO: 2983 - protein, 524 aa, ASPERGILLUS NIDULANS FGSC A4
MPSHTYPQRLYTTGYTVPPLKDKSLFIQKAFVNGEWVDAESGKTFEVHAHIDANGWYLDVLTDPATGKLIGTCPEFSASDTEKAIQAASAAFPKFRATLARERARMLRRWYQLMVDNAEDLATLITWENGKPLADAKGEVNYAASFFEWFSEEAPRTYGDTIPASVPGNRVITVKQPVGVCGLITPWNFPAAMITRKIGPALAAGCTVVTKSPGETPFTANALAELANRAGIPKGVVNIVTAMKNTPEVGEMITTHPDIRKVSFTGSTNVGRLLMKQSSSTIKKVSWELGGNAPFIVFDDVEDLDAAVTGAIASKFRSSGQTCVCANRIYVQKGIYDEFVQKFVEKVRNFKVGAGFEDGVTHGPVIHDRAVDKVDQHVQDAISKGAKLIAGGQRRSDLGPNFYDLTVLANMTKDMKIASEETFGPVAGLFPFETEKEVVELANKAEVGLAGYFFSGNIKRIFRVAEALEVGMVGVNTGLISDVASPFGGVKQSGFGREGSKYGIEEFMTIKSVTFGGMGEPLQS

SEQ ID NO: 2984 - protein, 164 aa, Bromus catharticus
VMASSATSVAPFQGLKSTAGLPVSRRSTGLGSVSSGGRIRCMQVWPIEGIKKFETLSYLPPLSTEALLKQIDYLIRSKWVPCLEFSKVGFVFREHNASPGYYDGRYWTMWKLPMFGCTDASQVIKELEEVKKEYPDAYVRIIGFDNLRQVQCVSFIAFKPPGCE

SEQ ID NO: 2985 - protein, 147 aa, Funaria hygrometrica
MDFPLFQILSFPDELEKSLNPQSQKYVRDTKAMVSTAVDVKELPDAYIFVADMPGLKSADVKVQLENDNVLVIGGTRKREEPDPKVKYIRMERNSGSFMRKFTLPQNSNLDKIAASCVNGILTVTVPKIPPPEPAKPRTIEVTMGNQ

SEQ ID NO: 2986 - protein, 521 aa, Lactococcus lactis
MKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 2987 - protein, 299 aa, Ferroplasma acidarmanus
MWNMGKQGDILLFAIMVISWSINYPVIKIALNYTGPFTLLFYRILFSFIFIYIIFRPKLHLRITKDEIVPLFILSLLNVLIWMELWFLAETTISSSLTSIIIYTYPIISTLMAIIFLKEQYNKYVFLGIGIGFAGLLVIFSNSLLSGFKPGIIIALLGAIVWSVGTIYFMKYHVKKDRETTNFFQFGFALLPSLLIAGIATPSISIFEPSLLLILLVLIISIPGTAVAYFAFLHLNRKYGVSTISSFLFLVPALSVVFGVIILDEIPSSYEIIGLALVGIGIYFSARGTKIKASAKPVS

SEQ ID NO: 2988 - protein, 300 aa, Desulfovibrio vulgaris subsp. vulgaris (strain Hildenborough)
MTSHTLTQGGRTTATIALLLAMLLWSSSFIAMKIALTGFDPMVMIFGRMAIASVIFIAVWRRNFSGVRYRAGDWKLLGFMTMCEPCLYFVFEAYALEYTSASQAGMIVAMMPLSVAVAARFVLKEHMARSAWAGFCLAIAGVVWLSLGGQVTENAPNPMLGNALEVCAMLTATGYVISAKRLSSTYPPLFITAVQSLAGFVFFLPVLALPGVTLPTSLPLTPTLAVLYLGVCITLGAYGLYNYGVSRLPAGQAASYINLIPVLTLIMGRVVLGDELSPSQYLASLLVLAGVVLSQRRAAA

SEQ ID NO: 2989 - protein, 389 aa, Euphorbia esula
MEDASATTTAPSDSLNNHQLPPTAGIENIPATLSHGGRFIQYNIFGNIFEVTAKYRPPIMPIGKGAYGIVCSALNSETGEHVAIKKIANAFDNKIDAKRTLREIKLLRHMDHENVVAIRDIMPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEEELGFLNENAKRYIRQMSVFRRQSFTEKFPTVHPAAIDLVEKMLTFDPRQRITVEDALAHPYLTSLHDISDEPVCMTPFSFDFEQHALTEEQMKELIYREALAFNPEYQQQ

SEQ ID NO: 2990 - protein, 378 aa, Rhodospirillum rubrum
MVRRRWSGGARLPGSGRPRTGGAPVGGRPSAGGHPRSPLRVRPVRLFVPRRFRSREFPIVTVTASPLIARPRAPRALSVSFEFFPPKTDRMRDQLWDCLRQLEPLEPSFVSVTYGAGGSTRERTHETVARIAADTTMKPAAHLTCVEATRAEVNAVAQAYWQAGVRHVVALRGDPPTLGGAYVPHPGGYAYALDLVKGLRDVADFEISVAAYPEVHPQARSAAEDLDNLKRKIDAGATRAISQYFFDVDSYRRFMDRVLAAGISVPVVPGILPVGNFQTVLKFSNACGTRVPKWMHELFAGLENDPETHRMVAATLAAEQCLSLFEDGVDCFHFYTLNRADLVRAVCHMLGLRPAAIPTASRLAPDQGAGTIALGASV

SEQ ID NO: 2991 - protein, 302 aa, Leptospira interrogans serovar Icterohaemorrhagiae
RIGRLVFRAGIKDPNLEFVAINDLVTPDNLAYLLKYDSTHGRFQGTVEHTEKELIVDGKKILCVSERDPEKLPWKDLKVDYVIESTGLFTDRVGAEKHIKAGAKKVVISAPAKDKDIPTFVMGVNNEKYNPSNDHIVSNASCTTNCLAPIVKVVLDNWGIEEGLMTTIHATTATQPTVDGPSKKDFRGGRGAMQNIIPASTGAAKAVGLCIPEVNGKLTGMSFRVPTPDVSVVDLTVRTTKETSLKEISAKMKAASEGAMKGILGYTEDMVVSNDFVSSTLSSIFDMDACIELNSRFFKLVS

SEQ ID NO: 2992 - protein, 217 aa, Desulfovibrio desulfuricans G20
MILSPSLLSSDYGRLADELAALEDAGLSWVHWDVMDGMFVPNITLGAPIIKKLRKASGLFFDVHLMVQAPERYIADFADAGADMLVVHAEATNHLERTLSEIRRMGVQCGVALNPHTPLCVLEYVLDQLDMVLIMSVNPGFGGQKFIPFTMRKIEELSAMITARGLKTLIQVDGGVDPENTPELVRRGADVLVSGSAFFGHPPYRQRHDAFQAAAAR

SEQ ID NO: 2993 - protein, 512 aa, Bradyrhizobium japonicum USDA 110
MDKPTPKADVFQANRDRVAPLLKTLRADGIGHMIDGKIVPSISGETFETKSPVDGAVLASVARGNAEDIDRAATAAALAFKSWREMGPAMRKKLLHRVADAIEDNADDIAVLECIDTGQAYRFMAKAAIRAAENFRFFADKCAEARDGQNTPSDEHWNVSTRVPIGPVGVITPWNTPFMLSTWKIAPALAAGCTVVHKPAEWSPATAAILARLVKEAGVPDGVLNTVHGFGEEAGKALTEHPAIKAIGFVGESATGSAIMVQGAPTLKRVHFELGGKNPVIVFDDADLDRALDAVVFMIYSLNGERCTSSSRLLIQQSIAEKFVEKLTARVKALKVGHPLDPSTEIGPLIHERHLAKVCSYFDVARKDGATIAVGGKAYDGPGGGHYVEPTLVTGAHGKMRVAQEEVFGPFLTVLPFKDEADAIEVANDIRYGLTGYVWTNDVGRALRVADALEAGMIWLNSENVRHLPTPFGGMKASGIGRDGGDYSFDFYMETKHVSLARGTHKIQKLGI

SEQ ID NO: 2994 - protein, 464 aa, Mazzaella californica
  unsure (1)..(464): unsure at all Xaa locations
KMGYWDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGSRAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEQIYERAEFAKELGSIIVMIDLVIGYTAIQSMAIWARKNDMILHLHRXGNSTYSRQKIHGMNFRVICKWMRXXGVDHIHAGTVVGKLEGDPLMIRGFYNTLLLPYLEVNLPQGIFFEQDWASLRKVTPVASGGIHCGQMHQLLDYLGVDVVLQFGGGTIGHPDGIQAGATANRVALESMVIARNEGRDYVAEGPQILLDAAKTCGPLQTALDLWKDISFNYTSTDTADFVETPTANV

SEQ ID NO: 2995 - protein, 110 aa, Zea mays
DLLQQALAMSMEGGASGSAAVTDSAMAEAGAVDPDLALALQMSVQDANMSSDTDMSKVFEDRTFVSSILNSLPGVDPNDPSVKDLLASLHSQGEQEKKEDTSDKTEDEKN

SEQ ID NO: 2996 - protein, 486 aa, Streptomyces avermitilis MA-4680
MSEQSLKGEAQGAIRTGTQPSRHVDAGDAGYAKSLKSRHVNMIAIGGAIGTGLFLGAGGRLADAGPSLFVAYAVCGIFAFLVVRALGELVLYRPSSGAFVSYAREFLGEKGAYTAGWMYFLNWATTGIADITAVAVYTHYWGMFSDIPQWVIALIALAVVLTVNLISVRMFGELEFWFAIIKVSALVVFMLIGIFLLVTQHPVDGHHPGPSLITDHGGIFPHGLLPMLLIIQGVVFAYASVELVGVAAGETENPEKIMPKAINSIMWRVGLFYVGSVVLLSMLLPWNKYTAGQSPFVTVLSNIGVPAAGGVMNLVVLTAAMSSLNSGLYSTGRILRSMAMSGSAPKFTGVMSRSQVPYGGILLTSGICILGVGLNFVVPADAFEIVLNFAAIGILATWGMIMLCHLMFWRKTRTGELSRPSYRLPGSPWTEIVTIGFLVSVLVLMYADGGAGRTTVLCLPLIAAALVAGWYGVRGRVARKASGADA

SEQ ID NO: 2997 - protein, 144 aa, Triticum aestivum
AGAAHEAIELELSSWPSSPSAGKSRRVTELVMALLARLCSCAEGRAAVVAHPAGIALVAKRALRVSAATDTSAVRVLAAVCGRAASPEVVREMARVGAVGKLCCVLQADCDRDVKETAKAVLRMHSGVWCGSPCVSAYLLSRYL

SEQ ID NO: 2998 - protein, 323 aa, Zea mays
MAAGRELVVSFGEMLIDFVPTVAGVSLAEAPAFLKAAGGAPANVAIAVSRLGGGAAFVGKLGDDEFGRMLAAILRDNGVDGGGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLQLIEKA

SEQ ID NO: 2999 - protein, 585 aa, Oryza sativa (japonica cultivar-group)
MERVAAAKKFIENHYRSQMKNIQERKERRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEMDNAPTRTGSGPSRKMMLNSKDLSFVGYTYKNFDAVKGLKHSDCFMKKEHRRTNKGATNSTAGRDVRKNAKCEDARIARCGCENVRWLPNDSRHVHARLDLATEAIARVLDSAFIQKATLKKKLVYSYLYYIKNSELRRWLADNKFDWRMAIDDVLVPLRMDHICNSQSHRK

SEQ ID NO: 3000 - protein, 618 aa, Glycine max
EEYKKEILRYMYYHQNEDGGWGLHIEGHSNMFCTALNYICMRVLGEGPNGGHDNACARARKWIHDHGGVTHIPSWGKTWLSILGVYDWYGSKPVPPEFWVLPSFLPMHPSKIWCYCRLTYLPMSYLYGKRFVGPITPLILQLREELFTQPYEKVNWKKARNQCAKEDRYHPHSLIQDLVWDSLYIFIEPLLTRWPFNKLVREKALQVTMKHILYEDENSRYITIGCVEKALYMLACWVEDPNGDAFKKHLARVPDYLWVSEDGMAMQSFGSQGWDASLVIQALLATNLMEEIGPTLAKAHDFIKKTQVKDDPLGDFKSMYRHISKGSWTFSDQDQGWQVSDCTAETLNCCLLLSILPSEIVGEKMEPQRLYDSVNILLSLQSRKGGLAAWEPSGTQEWLEILNPTEFLGNIVVEHDYAECTGSAIQALVLFKKLYPRHREKEIKNSIANAVQFLEDTQTANGSWYGSWGVCYIYGTWFALRGLAAAGKTYTNCAAIRKGVKFLLSTQKEDGGWGESYLSCPKQIYVPLEGSRSTVVHTAWALLGLILAGQAERDTTSLHRAAKLLINSQLKEGDWPQQELTGVFNRTCMLHYPMYRNIYPMWALAEYRRLVPLPSTEV

SEQ ID NO: 3001 - protein, 296 aa, Xylella fastidiosa 9a5c
MQDLKKKVILVTGASDGIGKFTAATLAKQGHKLIIHGRNRQKTEAALAEIKRQSGNPDVAMFLADFLPLAGVKAFADAIKEKYDHIDVLINNAGAQFTEQREVTSEGHEKTMAINVFAPMLLTKLLMPLLVKSESARVVTVASDAHRMAGKPDLDDIELKQGYHMAKAYSLSKLYVIWVMHHFIGETKKAGIHNVTFNLVHPASTRTNLGREAVKSWKWKIIFFLWQIMLVSMDKAASSTLYAATAPELEGVSGRYFGPKGEEQPSAKYHSPENEQKVWDYALNAIRPYLPAGAQS

SEQ ID NO: 3002 - protein, 774 aa, Schizosaccharomyces pombe
MKLSLKDLALSIILVLGVAPPVQALSAEEWKKQSVYNVMTDRFATSKVVPHCDVKAEKYCGGNWQGIVDHLDYIRDLGFTAISISPVVEQLEGPEYHGEAYHGHRPKNYYRLNPHFGNEEDLKELSDALHGKGMYLMVDVAINHTISEYFEDDYFKNTYFDKTHIDHKCKEHCSCHHDKFPRPVPHNGTKPDHKPWKHEEHCHHGKFPRPVPHNGTKPDHKPWKHEEHCSCHHDKFPRPVPHNGTKPDHKPWKHEEHCSCHHDKFPRPVPHNGTKPDHKPWKHEEHCHHGKFPRPIPHNGTKPDHKPWKHEEHCHHGRFPRPVPHNGTKPDHKPWKHEEHCSCHHDKFSRPVPHNGTKPDHKPWKHEEHCHHGKFLRPVPHNVTKPDHKPWKHEEHCHHGKFPRPVPHNGTKPDHKPWKHEEHCSCHEDHSVHERPSAKGALEDYIQTFVETFQIDGIRFDAMGDKYRKYWPDFCKAAGVFCMGDLKSSDSLKVCDWQNDLEGLSNFPVRESAVKAFLMNNPEGIVDLADKMTDMRGLCVNPLLLGNFVENKDLPRMASISSDPATLKNAIAFVLMGDGIPMMYNGQELAMRGEEVPYNRPAIWEKGFPKRNPYYKFTSTINRFRKAMIESKDGEAFLNMQSDISIVDKRILLLRRGKVITVLNNLGSYYIHFHYTVSAEEHKWMDVLSCKSVPVQDNRQVFMVRNGEPMILYPEESAYEMGLCPSPIQLTEDYNSEGSLSINVEEAQTSKAPEQNRGFTNVLAALLLSLLMIL

SEQ ID NO: 3003 - protein, 821 aa, Agrobacterium tumefaciens
MINNLTAADLPRPAPRSSNPEIMAAEIIERLTYRIGKDVKVAKPHDWLTATILVVRDPRIIDKWMASTRKAYADNSKRVYYLSLEFLIGRLMRDAISNIGLMHEIRDALSSLGVDLDVIAGLEPDAALGNGGLGRLAACFMESMATVDIPAYGYGIRYVHGLFRQQMADGWQVELPETWLAHGNPWEFERRESSYEIGFGGSVETIGGYEDPQRFVWKPAERVIAMAYDTPVVGWRGTRVNTLRLWSAQPIDPILLAAFNAGDHIGALRESNKAESLTRVLYPADATPAGQELRLRQEFFFSSASLQDILRRHLQQYPDFTSLPDKVSIQLNDTHPAISICEMIRLLCDVHGLEFDEAWRITQGTFSYTNHTLLPEALESWPVPLLERLLPRHMQIVYAINANTLLFARKEKKMADQQIRSISLIDEGGERRVRMGNLAFIGSHSINGVSALHTELMKETVFADLHSLYPERINNKTNGITPRRWLMQCNPGLTGLIREAIGDDFLDDAEKLIALDRFADDAGFREKFAEVKRLNKVRLANTVAQRMGLRVDPSAMFDIQIKRIHEYKRQLLNLIETVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGADNIVIFGMTAEEVSRARAEGHNPRAIIEGSAELSQALSSIASGVFSPDDRSRFSALMDGIYNSDWFMVAADFDAYADAQRKVDAIWSDQDSWNTKAVRNTARMGWFSSDRTIRQYATEIWRA

SEQ ID NO: 3004 - protein, 370 aa, Azotobacter vinelandii
MTCDFLALAVPGVQKLFPYVPGKPVDELARELDLDPAGIVKLASNENPLGPSPRVLEALRGELAELTRYPDGSGYLLKARLAERCGVATAQITLGNGSNDILDLVARAWLAPGFNAVFSEHAFAVYPISTQAVGAEGRAVPAKDYGHDLEAMLAAIDTDTRVVFLANPNNPTGTWFGPDALERFLARVPAQVLVVLDEAYIEYASGDDLPDGLRYLARYPNLLVSRTFSKAYGLAALRVGYAVSAPEVAAVLNRVRQPFNVNSLALAAACAALEDAAYLAEGRRINDAGMAQLEAGLSGLDLSWIPSKGNFIAVDFGRDAAPINAALLREGVIVRPVAGYGMPTFLRVSIGLPEENARFLAALQKVLASV

SEQ ID NO: 3005 - protein, 314 aa, Oryza sativa
MAMAIPKVDLRGLEPGTPGWEAARATVTASMVSHGCVVVAHGELGADLREALFGRAVREAFALPAEAKRRNVSTVGPYRGYIANIPGMDWESLRVHDADDAARVREFAGLLWPEGNPEFCETIVSFATKMRDLERTVERMTLEGLGVGEDHIASHLAAQDYGVRLSHYGPPPDASTAISLQAHRDDSMTTIIVQHEVEGLEVQAGDGSWHAIPPEPDTIAIVAGELFRVVTNGRVPASVHRVRTPSGRERYCVLVGSRSKDGAVLSAMDELVDGEHPLAYRPCKAEEFIQFRYSEEGRKFSDPLKAFCGVNATE

SEQ ID NO: 3006 - protein, 92 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPDPA

SEQ ID NO: 3007 - protein, 536 aa, Vibrio parahaemolyticus RIMD 2210633
MRNVLRNHRLYRSLLALSVIGALSACNSSGGDSNSSTPLPDTSYACQANVMTQSNQLRTYQIMVESFVDGDTSIGHGTGYGTSHHNGDLQGVIDSLDYIQDLGMNAIWLTPVFESEAIAGQDHWADRLDATGYFATDYFKIDPKFGDLATAKTLVEEAHKRGLYVFFDGVFGHHKNGLIKPSPSGLLPSGSSNPVDYPASLDFYKEVATYWIKELKIDGWRLDQAYQVPTDAWTQLRKAVDEASQSVTYTNSKGDQVNPLGYMVAEIWKGESEIANEAYGSNSDPALCSAFDFPMRYRIVETLAVNESGVGGRGVDWLDNGYSTHNQYPTHAQPNLMIGNHDLVRFGDLLQRGNLADVNDAEYWLRHKAAFAFQAAYTGPITLYYGDEIGDQVDGFAAKEDNNTCAIQGLCDDHVARSSAKIEGVTATLDANQADLKAYVTSLMTMRDTHPALYQGSRTNLVASNGSYVDLKQSGSDKVLFALNTLESARTVILAQESVGTGELVDLLTNEKIAPSNGQYQLPMSPLQGRFFAVTP

SEQ ID NO: 3008 - protein, 310 aa, Staphylococcus lentus
GFGRIGRLAFRRLQEVENIEVVAINDLADDAMLAHLLKYDSTQGRFKDEVEVIEGGFRVNGKEIKTFENPNPKELPWGDLDIDVVLECTGFFADKEKAHAHIAAGAKKVLISAPASGDLKTIVYNVNHDELDGSEEIVSGASCTTNCLAPMAKVLNDEFGIVEGLMMTIHAYTGDQNTLDAPHAKGGFRRARAAAENIVPNSTGAAKAIGLVIPELKGKLDGSAQRVPVATGSVTELTAVLDKEVSIEEINEAMKNATNDSFGYTEDEIVSSDVIGITYGSLFDATQTRVMTVGDRQLVKTAAWYDNEMS

SEQ ID NO: 3009 - protein, 475 aa, Bacillus cereus ATCC 14579
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSNGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 3010 - protein, 379 aa, Zea mays
  unsure (1)..(379): unsure at all Xaa locations
MRRWFCCTRFNASYREHENERPITPEEKEGNGFSVKSDPIKAPPSIEVPELSFEELKEKTDNFGSKALIGEGSYGRVYYAILDSGKHVAVKKLDASTDPELDNEFLTQVSIASKLKHDNFVEMLGYCVEGNQRLVVYEFATMGSLHDILHGRKGVPGAQPGPALDWMQRVKIAIDAAKGLEYLHEKVQPSIVHRDIRSSNILLFEDYRAKIADFNLSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKXGFNPSIPCVRALPWLAAVAALCVQYESEFRPSMSIVVKALSPLLQHKPQPPAATTDATAPSDA

SEQ ID NO: 3011 - protein, 569 aa, Methanosarcina barkeri
SFIIKNKGLDDMDNLHEALERQNIAYFSMEIGLRSDIATYAGGLGGLAGDAIRSAADLNIPFVAVTLVSNKGYFRQTLDPAGNQIEHKDEWNPAHFMTLCKEEVKVKIQDRDVKLRAWIYTYKSHIGGCVPIIFLDTNVEGNESEDRKITDFLYGGDQRYRLKQEIVLGIGGVRMLNALGFKVRKYHMNEGHSSLLALELLKQNSVDPTKIKELCIFTTHTPVEAGHDKFNYGLVKDLIQDKSDVEILRKFGGTDYFDTSIFAMNLSNYINGVTKRHSQISSALYPGYKIHAITNGVHSYTWTSPYFKKLYDRYLPDWENEPELLIRVGEIPDTEIWEAHWSAKRDLIDEVNKKTGVGMDYDTLTIGFARRMTSYKRPTLIFSDLEMLRSINKRGKIQLIFAGKAHPNDEAGKQIIRDIFKIIETLRDDIKIVFLENYNMDLAAKMVSGVDVWLNTPNCPYEASGTSGMKAAHNGVVNFSVLDGWWIEGWIEDVTGWSIGPKPDEKISIEEIRTAELRDLYYKLYYIIVPMYYEQKDEWLKLINNSIGMIASYFNSHRMMRYYVTQAYL

SEQ ID NO: 3012 - protein, 324 aa, Streptomyces avermitilis MA-4680
MTITSPHLGSTSDWTDARLLYALEEVVENELNRHLKVAKDWMPHDYVPWSDARNFPGLFEDGEAWDKEQSKVTEIGRIALVVNLLTEDNLPSYHHEIASLFGRDGAWGTWVHRWTAEEGRHGIVMRDYLLASRAVDPDKLEAFRMSHMSEGFESDNRHSMLHSVAYVAFQELATRVSHRNTGHQSGDPVCDRMLARIATDENLHMVFYRNLLKAAFELAPDLTMQAVRDVVVNFRMPGHGIPGFERAAAQMAIGEVYNMRIHHDDVLQPVLRHLKVLEIDGLSPEGLHAQEELGLFMGGLDTEARKFDEKLAARKARMAARAGA

SEQ ID NO: 3013 - protein, 308 aa, Salmonella typhimurium LT2
MDTQRQASPFARKNVVYVCAAFCCLLWGSAYPAIKSGYDLFQIATDDIPSKIVFAGYRFLFAGGLLLLFALLQRKPIGRFRPRQFAQLTLLGLTQTSLQYLFFYIGLAFTSGVKGSIMNATGTFFSVLLAHFIYQNDRLSYNKTLGCILGFAGVMVVNVSNGLDFSFNLPGEGSVVLAAFILSAATLYGKRLSQTVDPMVMTGYQLGIGGLVLVIGGYVFGGTLTIHGFSSVAILVYLTLLSSVAFALWSILLKYNRVGMIAPFNFLIPVSGAALSAIFLGENILEWKYMIALVLVCSGIWWVNKVKR

SEQ ID NO: 3014 - protein, 414 aa, SYNECHOCOCCUS SP. WH 8102
MTAAPLPSTGAVTGLGETLAFFRDPSFSQRRFSELGDVFETKLLAQSIVFIRGERAIGDLLKQEDCLQGWWPDSVRQLLGSKSLANRSGADHKARRRVVGQLFSSAALSRYTPAIEALVNDLANELQQAEGPIPLAARMRRFAFSVIATTVLGLEAENRDALFADFEIWTRALFSIPLALPGTPFARALAARQRLLARLKTVLQTNNNRQQGGLDLLSGGLDEAGLPLDDDDLVEQLLLLLFAGYETTASSLSCLFRALLLNPEVEQWLMQDLNNHERPSRLDATVLEVMRMTPPVGGFFRQNTQSIELADVAIPQGRVIQVVLSSSSTTNQIDLETFRPQRHLDGSFQQTLLPFGGGERVCLGKALAELEIRLMAMGLLQRVQLHLEPDQDLNLQLIPSPTPRDGLLVRATAR

SEQ ID NO: 3015 - protein, 135 aa, Zea mays
MASRKCLGGEGSAPAPHVLAVDDSSVDRAVIAGILRSSQFRVTAVDSGKRALELLGTEPNVSMIITDYWMPEMTGYELLKKIKESSRLKEIPVVIMSSENVPTRINRCLEEGAEDFLLKPVRPSDVSRLCSRVLR

SEQ ID NO: 3016 - protein, 199 aa, Oryza sativa
MAAGAACCYRPAAAGRASLDAFATSSPSLRPSSSGVFFISSSSSRWWMRRRRGEGKVKISSSSRARAKPMSRPALFSPVAMEWQECSTEIEVDVPCSVAYQCYSERETIPQWMPFISSVKILEDKPDQSRWTLKYEILGRDVEFSWLARNMTLTVAYEVPEILAPVASALKPFLEGLLMQGLERFATFAKERYSKIPQP

SEQ ID NO: 3017 - protein, 322 aa, Xanthomonas campestris pv. phaseoli
MTASPSKLAQLRELSVVVADTGDYDAIKRLQPVDCTTNPTLVKKALDLPVYADLIERELAWGREHGGDDRTATVNEVADRLTIGVGVKLAGLVPGRVSTEVDADLAHDTQATIAKARKFIAMYAERGVSKDKILIKIAATWEGIEAARQLQKEGIDCNLTLIFNRSQALACAEAGVFLISPFVGRILDYYVGKGQTPASIDEDPGVVFVRTVYNEFKQRGYSTVVMGASFRSTAQIEALASCDRLTISPDLLEKLDAEHGELPRKLSPAKADNAQFTPIDSDSFASGLAADPMATEKLAGGIDTFAKDLHALRKTIADKLAG

SEQ ID NO: 3018 - protein, 112 aa, Listeria monocytogenes
MTDRKNLTTNQGVPVGDNQNSMTAGRKGPTLIEDYVLIEKLAHFDRERVPERVVHARGAGAHGKFVTKKSMKKYTMAKFLQEEGTETEVFARFSTVIHGQHSPETLRDPRGF

SEQ ID NO: 3019 - protein, 298 aa, Methanothermobacter thermautotrophicus str. Delta H
MRFDAVGLGALNMDQLHMVERIAGPDEETFVRGLVESCGGSAANTMIGLSRLGLRTAHIGKVADDREGGLLRSNLSSEGVTDFTVVADTGRSGRVMGFVDPDGNRALYVDPGVNDTLRVDEVADEALNTELLHLTSFAGDGINVQVEVIEALDESVTVSLDPGHIYASRGVSELSDILERTDILLTNQRELELMTGSADPEEAASLLGIGVVVVKMGARGVRAWDGESVMVDALSTECVDTTGAGDAFNAGFIYAWLEGFGLEVSCRFGNYIASRCIGGYGATESLPGTGPGCPQEVR

SEQ ID NO: 3020 - protein, 541 aa, Glycine max
  unsure (1)..(541): unsure at all Xaa locations
MAALNLCRMALRSSKLLSRPYHLLSVQLQMQMQPSSPPLTRKMSMDAQSVSFQLNSSGLLRTQGLIAGKWSDAYDGKTIKVYNPATGESIVDVACMGGRETNDAISAAYDAYGSWSKTTAAERSKFLRKWYDLRMVHYXELAQLITLEQGKPLKESVGEIVYGAGVIEFAAEGAKRIYRDIVPAPFSDLRLFVLKQHVWVVCASRPWNFPVSLISRNVHTVLACGCKVVISPSEHXSLSVFASVDMYIPAGMSHSVMNVVMENALNIRDAFLSSPFQRKITFTGSTAVGKKLMAGSAETVKKVSLELGGNAPCIXVFDDADLDVAVKGTLAAKFRNSGQTCVCANRIIVQEGIYEKFANALRDAVQNMKVGDGFSEALSLRPLINEAAVNXLRSLYIHDSLFITGGKVNSWGVKRHSLGLTFYEPTVISDVNSDMHISREEAFGPVAPLLRFKTEEEAIRIANDTNAGLGSYVFTNSIQRSWRVAEALEYGLVGVNEGVISTEVAPFGGFKQSGLGREGSKYGMDEYLEIKYVCFGNMNKE

SEQ ID NO: 3021 - protein, 431 aa, Escherichia coli
SKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 3022 - protein, 580 aa, Schizosaccharomyces pombe
MNNYGVSSIGTSLTPSPTGSIDEYTSKEVKHPEDVKVDASYEKEEVGYGELEVVPERGNLFQRWYRSFLPPEDGKPQKLKRTLTARHIQMIGIGGAIGTGVWVGSKNTLREGGAASVLICYSLVGSMVLMTVYSLGELAVAFPINGSFHTYGTRFIHPSWGFTLGWNYLASFLATYPLELITASICLQFWININSGIWITVFIALLCFVNMFGVRGYGEVEFFVSSLKVMAMVGFIICGIVIDCGGVRTDHRGYIGATIFRKNAFIHGFHGFCSVFSTAAFSYAGTEYIGIAASETKNPAKAFPKAVKQVFIRVSLFYILALFVVSLLISGRDERLTTLSATAASPFILALMDAKIRGLPHVLNAVILISVLTAANGITYTGSRTLHSMAEQGHAPKWFKYVDREGRPLLAMAFVLCFGALGYICESAQSDTVFDWLLSISNLATLFVWLSINVSYIIYRLAFKKQGKSYDEVGYHSPFGIYGACYGAFIIILVFITEFYVSIFPIGASPDAGAFFQSYLCFPVVVIVFIAHALITRQKFRKLSEIDLDTGFSKYDRLEESDKGPMTAKSLAKSVLSFCV

SEQ ID NO: 3023 - protein, 166 aa, Zea mays
  unsure (1)..(166): unsure at all Xaa locations
MAAPGSSNGGGGSRSQQQQPQQDKQSIWAGCFSGLSCFGAQKGGKRIVPAARIPDGNASTNRGNAQSGGNPNQNGAMNLPLLAPPSSPASFSNSALPSTAQSPNCFLSISANSPGGPTSNMFAVGPYANEPQLVSPPADFSTYTTEXSTAPLTPPPELAQATLHPL

SEQ ID NO: 3024 - protein, 335 aa, Zea mays
  unsure (1)..(335): unsure at all Xaa locations
MAMAAIASPSSRTLIPPRHHGAAPSPSTSGDSSLRLLRAHPRHGRRGRAVSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNXWGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKR

SEQ ID NO: 3025 - protein, 438 aa, Pseudo-nitzschia pungens
QNFALNMASHGFKVCVGNRSLAKVDSTVARAKEEGGLPLIGATSAEEFIARLRKPRKVVILVQAGKPVDETIKKLSTYMEPGDILVDGGNEWYPNSVRRSGELLHKGIQFIGMGISGGEDGARNGPALMPGGPKQAYDFVAPIFEKCAAQVERTGPCVGYLGPVGSGNYVKMVHNGIEYGDMQLIAEVYDVMKNVLYMPNDEIADVFADWNKTELDSYLIEITEICLRKQDDKTDGYLVDKILDKTGMKGTGLWTAKESAERAVAAPTIVAALDSRVLSSRKEERVAASKIFGPPKIEAVDKDQVIADLRAALYASKICSYAQGLSLIKAASDEFSWNVNLAECARLWMGGCIIRAKLLDSIQMAFSKNPALPNLMIDPGFAEQIIGAQSSWRRTVALCATSGIACPSLCGSLMYFDTYRRERLPACLTQAQRDFFGG

SEQ ID NO: 3026 - protein, 461 aa, Lactobacillus plantarum WCFS1
MTKENSQPATEQLSRGLKSRHVQLIAIGGTIGTGLFLGAGQSIHLAGPAILIAYLVTGLVCFLLMRALGELLLSDLHTHSYIDFIKQYLGDKTGFVAGWTYWVCWITIAMAEITAAGEYMQFWWPRLPQWLPGLIILILLLGLNSINVSAFGETEFWFAIIKIAAILALIAVGIGMVLLSVKTPVGHASLTNLVSYGGFMPHGIKGLVLSFQMVLFSFIGIEMVGMTASETADPKTVIPKAINDIPVRIILFYVGSLFFLMCMYPWQYFSAAHSPFVQVFTNLGIRSAAAIINFVVLTAAASSCNSALFSTGRMLFSLTYDGKSKFAKRMGILSTRQVPRNALWFSTLVIGLSVILNLLMPGKVFSLIASVSTTCFIFIWGAIVVAHIKYRRQAGSQAKVKFRMPLFPLSDYFILVFLAFIAVVLCLKFETLIALLVSAVWVVGLYIVKIVSDRIRQRTHD

SEQ ID NO: 3027 - protein, 909 aa, Emericella nidulans
MPRSIPSYFTSAPPAEEHHDPENVSPGPRLNPRTAPPSPSVMRRTYSHLSESHTAYQSLEPPLEAGETTSLLGKAKEGGSGRMEPQRSYTTFSASSGPESGFRYTLLGSSLRRSRHHSRANSVHQRFSRRASMDEVPVESTAASIKDAMTSSFMDDRLWYDQFTSTDWVHDSVADGVRLRELRRRKDIRGRLLALFDGAQGWILVALIGCIVAAIAYFVDITEEYVFGLKNGICTTGWLRSRETCCADEEECPAWRSWSEMMNHHGGGSVSVDFGIYVLWSVILAAISCLLTLLTKTVVPSSVSLTTLDENLGANGSRQATEADGSPASVSGLSPYPPLPLRPDMVYYSAAGSGVAEVKVINSGFVLHGYLGFKTLVIKTLALIFSVASGLSLGKEGPYVHIATCVGNIACRLFSKYNLNDGKRREVLSASAASGVAVAFGAPIGGVLFSLEEVSYYFPPKTLFRTFFCCIAAALSLKFFNPYGTGKIVLFEVRYLGDWEIFELAIFMFLGVLGGAAGALFIKASSIWAKSFRRIPVIKRWPLFEVGLVALVTGLISFWNPYTKLPVTELLFQLASPCEHSTSDGLCPHPEGIGEVIRALTIAFVIKSFLTIVTFGIKVPAGIYVPSMVVGGLMGRIVGHVTQYLALQYPNFFLFGSSCAAGTGMESCVTPGVYAMVAAGATMCGVTRLSVTLAVILFELTGSLDHVLPFSLAVLCAKWTADAIEPHSIYDFLTEMNSYPFLDNKLQTVSDAVLGDIVRPIRRSRLIDITETPLVPARELRSKLQHLLMAGELDSGLPILRDGVLIGLIPAPDLEYALDNLEDEDRTSCLMATDTSSVVSDTDDEDTLQVDFTKYIDPAPLALDIHSPIDLVYQCFVKLGLRYLCVLHDGQYAGLVHKKAFVKFMKEQH

SEQ ID NO: 3028 - protein, 343 aa, Cercospora nicotianae
MASNGTSVSPFRSQKNAAMAVNDTPANGHAEPSTITAASKTNTTKITSQNDPQSSFAVKVGLAQMLKGGVIMDVVNAEQARIAEEAGACAVMALERVPADIRKDGGVARMSDPQMIKDIMNAVTIPVMAKSRIGHFVECQILQAIGVDYIDESEVLTPADPVNHIDKSVYNVPFVCGCKNLGEALRRISEGAAMIRTKGEAGTGDVVEAVRHMQTVNAEIAKASSASDADLRMMARELQCDYNLLKQTAQLKRLPVVNFAAGGIATPADAALMMQMGCDGVFVGSGIFKSGDAAKRAKAIVQATTHYNDPKVLAEVSSGLGEAMVGINCDKLPETQKLATRGW

SEQ ID NO: 3029 - protein, 154 aa, Narcissus pseudonarcissus
KVMKKASFIGVSTTTTFYLLCGCLGYAAFGNKAPGNILTGFGFYEPFWLVDIANLCIIIHLVGAYQVFSQPIFSAVETWITNRHPNINFLNHDRVLVIGKCFRYKINLFRLIWRTLFVIACTFIAILMPFFNDILGFLGAVGFWPLTVYFPTEM

SEQ ID NO: 3030 - protein, 329 aa, Agrobacterium tumefaciens str. C58 (Cereon)
MDGSTPICDHVNIHTPWETKMAIQKQMDAREWAMLIALSLLWGGSFFFIGVAVKELPPVTIVTLRVSLAAVALLVVCRIMGLRLPREWAVWRAFFGMGLLNNIIPFCLIVWGQTQIASGLASILNATTPLFTVIVAHFLTADEKMTGNKLAGVLIGFVGVATMIGPAAFGGSSGLWGQIAILGAAISYSFAGIFGRRFKAMGVPPLMTATGQISSSTLMLIPAALLIDKPWTLAMPGLGTWGALIGIALLSTALAYLIFFRILASAGATNLALVTFLIPVSAILLGSLILGEQLEIKHFAGMAMIAAGLAAIDGRLPVKLRSLLRNAPA

SEQ ID NO: 3031 - protein, 572 aa, Pseudomonas syringae pv. tomato str. DC3000
MSKTIADHLAQTLAAAGVSHIWGVSGDSLNGLTDSLERIDSINWMHTRHEEVAAFAAGAQAASSGKLAVCAGSCGPGNLHLINGLYDCHRNRVPVLAIAAHIPSSEIGLDYFQETHPQELFKECSHFVELVSNPEQFPRVLERAMRAAISQKGVAVIVLPGDVALSESPDVPAKWVEATPPVVVPADTDLQSMANMLNDSKAVTLLCGAGCAGAHEQILALADTLGAPIVHALRGKQHVEYDNPFDVGMTGLIGFSSGYHAMLSCDTLVILGSSFPYRNFYPEKANIIQIDLDPTQLGRRTPVALGLVGGVRETLDALQPKLKPHTDRRFLDKALKHYAKAREDLDELATPTPNGTPIHPQYLTRLVDEQADADAIFTVDVGTPTLWAARYLHMNGKRSLLGSFNHGSMANALPQALGAKAEHPDRQVVALCGDGGLSMLLGDLLSIRQLNLPIKMVVFNNSSLGFVDMEMKASGYVPHGTDLHETNFAGIALGAGILGLRVENAEELPAALRKAFDHPGPVLIDVVTAKQELGIPPKIKLAQAKGFSLYMMRAIMSGRGSEVLELAKTNLR

SEQ ID NO: 3032 - protein, 475 aa, Streptococcus agalactiae 2603V/R
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGKRIGKLAGMRPIMLELGGKDAGVVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 3033 - protein, 796 aa, Burkholderia fungorum
MSVAEYFSSMEYGPAPEDDQPARAWLAQHEERFGHFIGGAWHAPAAGERFASHAPATGERLADIAQGDAADIDAAVAAARAAQPGWFALGGAGRARHLYALARMVQRHSRLFAVLEALDNGKPIRETRDIDVPLVARHFLHHAGWAQLQESEFADYAPLGVVGQIVPWNFPLLMLAWKIAPAIATGNCVVLKPAEYTPLTALLFAELAHRAGLPAGVLNVVTGDGRTGAALVEHPQVDKIAFTGSTEVGRLIRSATAGSGKSLTLELGGKSPFIVFDDADLDGAVEGVVDAIWFNQGQVCCAGSRLLVQEGVEARFIAKLKRRMATLRVGTSLDKSIDLGAIVDPVQLERIQSLVETGRREGCSVWQSPETTMPSGGCFYPPTLVTGVAPASTLAQEEIFGPVLVTMSFRTPDEAIALANNSRYGLAASVWSETIGRALDVAPRLACGVVWINATNLFDAAVGFGGYRESGYGREGGREGIYEYLKPRAWLNLAERRTARSAGGSAATVDALSNVTSIDRTAKLFIGGKQARPDSGYSLPVHAPDGTPVGEVAAGNRKDIRNAVEAARAAQKWSQASTHNRAQVLFYLAENLAVRGDEFVRQLMVRNGAAQAAARAEVDASVQRLFTYAAWADKFDGAVHTPPLRGVALAMHEPLGVIGIACPDEAPLLGFISLAAPALAMGNRVVVLPSEASPLTVTDFYQVAETSDVPGGVLNIVTGERGALLPALAKHDDVDAVWCFGGAADWTLVERESVGNLKRTFVDHGRQFDWFDRSSEGRPFLRQAVQVKNIWIPYGD

SEQ ID NO: 3034 - protein, 205 aa, Glycine max
  unsure (1)..(205): unsure at all Xaa locations
MKSNKNLVDKASEAESSKNSNKRGKFECTTCNKIFHSYQALGGHRASHKKIKGCFASTNESSENSIETDPSPDPIATENKLMKNSDSEYLVEHQHGASLHNEGETVNESKKSKGHHECPICFKVFPSGQALGGHKRSHMVGGSESRNFQTIVPQEPVAEIRDFLDLNLPASTEEESYSHADSNSNRPWWIVEDNHKQEALVGLXS

SEQ ID NO: 3035 - protein, 1203 aa, Zea mays
  unsure (1)..(1203): unsure at all Xaa locations
MVETRRSSAAAAGKRTSPSPSSSSVPPPKRPKAESSGSPTASAPGRAEEDSVAGAAPARSAGSVDDAAAIAQKDQGVDKPSSAVAESSKRRKEQEQQQPAVPWAKLLSECSQTPHYPISVDQISVGQSKNCNLWLKDQPVSKVLCKLRRLEQGGPCELEVIGKKGMVQLNGRSVSPGTKVPLTGGDEVIFSSCGKHTYIFLYPLNDKVPKLXLSSAVSLLEAPVASVKRIRTDKRTGDTSAVAGTEMMTSTSNQKDVAAVPPASAGENSQRVVRPMASSASDKSKGRAVSPEKEFANGENANEVNSNIEDSPMVVAAAPISPDAAANDTCQQNGFVSDSHLGAEIALEDQRDHIIRELNASTNVPPSRCQAFKDGMKQGIINPSDIDVTFENFPYYLSENTKNVLLSSAFIHLKKKEFIKQFVEISSINQRILLSGPAGSEIYQETLVKALAKHFSARLLVVDSLLLPGAPSKDPEFQKDVGKADKSGDKAAAEKFAIYQKHRSSLADTVHFRRPAAPTSSVNADIVGTSTLHSASLPKQESSTATSKSYTFREGDRVRYVGPAQPCSLSQRGPSYGYRGRVMLXLKIMDPQKLESGLTSRSLMVMILVVCARKIMXFFCSAELLRPDFSAGEEVERLAMTELIEVISEENKSGPLIVLLKDVEKSFTGVTESLSSLRSKLESLPPGVLIIGSHTQMDSRKEKAHPGGFLFTKFASSSQTLFDLFPDSFGSRLHERSKESPKTMKHLNKLFPNKILIQLPQDEALLTDWKQQLDRDVETLKAKSNIGSIRMFLSRNGIECNDLEELFIKDQSLSNENVDKIVGYAVSYHLNQNKIETSKDAKLVLTTESLKHGLNMLQSMQNDNKSSKKSLKDVVTENEFEKRLLADVIPPNDIGVTFDDIGALENVKDTLKELVMLPLQRPELFXKGQLTKPCKGILLFGPPGTGKTMLGQSSSQLKQAANFINISMSSITSKWFGEGEKYVKAVFSLASKIAPSVIFIDEVDSMLGRRENPGEHEAMRKMKNEFMVNWDGLRTKDKERVLVLGATNRPFDLDEAVIRXRFPRRLMVNLPDASNREKILKVILAKEELGSDVDMDSLANMTDGYSGSDLKNLCVTAAHYPIREILEKEKKEKNLAKTEGKPEPALYGSEDIRPLSIDDFKSAHEQVCASVSSDSANMNELLQWNDLYGEGGSRKKKALSYFM

SEQ ID NO: 3036 - protein, 546 aa, Eremothecium gossypii
MSAAIAQPDNRSVMSTHSSTASNKPSKEENKESGLVEIPVKPASAYITVSLLCILVAFGGFIFGWDTGTISGFVNQSDYKNRFGELNESGDYYLSDNRTGLIVAIFNIGCAVGGIFLSKFADMYGRRIGLMIVTLVYVIGIVVQISSTDKWYQYCIGRVISGLGVGGIAVLSPMLISETSPKHLRGMLVSCYQLMITAGIFVGYCANYGTKAKYEDSKQWRIPLGLSFAWAILMIGGMVLVPESPRYLVEVNKYEDAKRSLARSNKVPVDDPSIQAEFDNIHAGIELERMAGSASWGELFSTKSKILQRVIMGVMIQSLQQLTGNNYFFYYGTTIFKSVGLEDSFQTSIILGAVNFGSTFVAVWAVGKFGRRRLMLAGAAAMTVCMVIFASIGVTKLWPNGEDQPSSKPAGNVMIVFTCIYIFCFATTWAPIPFVIVSETFPLRVKAKGMAIATAANWIWGFLIAFFTPKITNAIKFNYGYVFMGCLIFAFFYMFFFVPETKGLTLEEVEEMWQEGVVPWKSESWTPSYKRNAYETEEVKPEKTWA

SEQ ID NO: 3037 - protein, 475 aa, Arabidopsis thaliana
MLEKKLAAAEVSEEEQNNLLKDLEMKETEYMRRQRHKMGADDFEPLTMIGKGAFGEVRICREKGTGNVYAMKKLKKSEMLRRGQVEHVKAERNLLAEVDSNCIVKLYCSFQDEEYLYLIMEYLPGGDMMTLLMRKDTLTEDEARFYIGETVLAIESIHKHNYIHRDIKPDNLLLDKDGHMKLSDFGLCKPLDCSNLQEKDFTVARNVSGALQSDGRPVATRRTQQEQLLNWQRNRRMLAYSTVGTPDYIAPEVLLKKGYGMECDWWSLGAIMYEMLVGFPPFYSDDPMTTCRKIVNWRNYLKFPDEVRLSPEAKDLICRLLCNVEQRLGTKGADEIKGHPWFRGTEWGKLYQMKAAFIPQVNDELDTQNFEKFEETDKQVPKSAKSGPWRKMLSSKDINFVGYTYKNVEIVNDDQIPGIAELKKKSNKPKRPSIKSLFEDETSGGTTTHQGSFLNLLPTQIEDPEKEGSKSSSSG

SEQ ID NO: 3038 - protein, 368 aa, Streptomyces tendae
MPAREGADSPFLRESAGRFRNRRVRVPDEINLKNCGLLDSRAAAVHRATLAEFDPNDVLTYPILQPVYGMLADRFGVDTDSLVLTAGSDPGLNLLTRAFPEVSRIVLHQPNFDGWAKFAAISGCVLDPVAPDPETGLFDLRDLARRLRAGAPAFVVVTTPHSFTGQVHGREELAELADAVAEHGSLLVVDTAYLAFTEGGEELVRGLAGLRHVVRVNTFSKSYGLSGARIAVTVAHPATARHLFDLDPEGSVSAPAVALLRRSLEEQAVFTAIWADVRRLRERFAAEVERAVPGWHARPSGGNFVTWDVPGPADAGAASRHLLGRGIVVRDLSGAPGLPAAVRIAVAKHAVVRQVVAALGDRYREGVA

SEQ ID NO: 3039 - protein, 470 aa, Zea mays
MSCWAAGRRSSASAMAENAGARGAKEAVVTSGKRVALGNISNVFRGSWGSGAANSASDAKLSSTKPDDVKKGSYACLRNVNTERGSSRRLASEQFDQAVSLLQKNTSLPSVPDVVSTGCSSPGLSQDCSVSMEDAMSTCNSTESSDVEYLNNNDDPSMTSSSHWWASDRPHFSDSMDVAEFNWRKHSPNHYTYKDPRLSTTLACEIYESLREAETRKMPPTNFLETTQTDMSKTMRAILIDWLVEVTEEYRLVPETLYLTVNYIDRYLSVKEISRHRLQLVGVACLLIAAKYEEICPPLVEELCYITDYSYTKEEVLQMEASVLNNLKFEMTVPTAKCFLRRFVRVAQVPDKGSSLHLEFLVNYICELSLLEYSLLCYLPSMVAASSVFLAKFILMPIKNPWNSSLSYYTRYTPSELRGCVRVLHRLFRLGPGSNLPAIREKYSQHKYKFVAKKYCPQSIPTKFFQDLTS

SEQ ID NO: 3040 - protein, 402 aa, Physcomitrella patens subsp. patens
MSTCAVAALSSPPTSFTSERVTSGITASVQPSAFLGTKISVCKGASVLSRAVSASISRQPLVAPIRAQGVAAPADTKAPTTTKKTDTKSTVIITGASSGLGLATAKVLADSGEWHVIMACRDFLKAERAARAVGMPKDSYTVIHCDLSSLNSVKQFVDNVRQSGRPLDVLVCNAAVYLPTAKEPRYTADGFELSVGTNHLGHFLLANMLMEDIQHKENDTNRRVIIVGSITGNTNTIAGNVPPKANLGDLRGLAGGLDGVRSSVMIVGGEFDGAKAYKDSKVCNMLTMQEMHRRFHEKTGVTFASLYPGCIATTGLFREHYQLFRTLFPPFQKYITKGYVSEEEAGKRLAQVVSDPTLNKSGVYWSWNNQSNSFENELSQEASDAEKAKKLWEISEKLVNLS

SEQ ID NO: 3041 - protein, 385 aa, Oryza sativa (indica cultivar-group)
MAKIKIGINGFGRIGRLVARVALQSDDVELVAVNDPFITTDYMICEFGIWISVCRPVDQIVIDMSSDAFAHAKSQIVPVALKFRTAICFAVTYMFKYDTVHGQWKHHEVKVKDSKTLLFGEKEVTVFGCRNPEEIPWGETGAEFVVESTGVFTDKDKAAAHLKGGAKKVVISAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 3042 - protein, 572 aa, Arabidopsis thaliana
MADKSETTPPSIDGNVLVAKSLSHLGVTHMFGVVGIPVTSLASRAMALGIRFIAFHNEQSAGYAASAYGYLTGKPGILLTVSGPGCVHGLAGLSNAWVNTWPMVMISGSCDQRDVGRGDFQELDQIEAVKAFSKLSEKAKDVREIPDCVSRVLDRAVSGRPGGCYLDIPTDVLRQKISESEADKLVDEVERSRKEEPIRGSLRSEIESAVSLLRKAERPLIVFGKGAAYSRAEDELKKLVEITGIPFLPTPMGKGLLPDTHEFSATAARSLAIGKCDVALVVGARLNWLLHFGESPKWDKDVKFILVDVSEEEIELRKPHLGIVGDAKTVIGLLNREIKDDPFCLGKSNSWVESISKKAKENGEKMEIQLAKDVVPFNFLTPMRIIRDAILAVEGPSPVVVSEGANTMDVGRSVLVQKEPRTRLDAGTWGTMGVGLGYCIAAAVASPDRLVVAVEGDSGFGFSAMEVETLVRYNLAVVIIVFNNGGVYGGDRRGPEEISGPHKEDPAPTSFVPNAGYHKLIEAFGGKGYIVETPDELKSALAESFAARKPAVVNVIIDPFAGAESGRLQHKN

SEQ ID NO: 3043 - protein, 435 aa, Lactobacillus gasseri
MLNDFLAVSTLVSIWFSLLASLVTLYGATRFWLKHSKKVISITPLKHYPAITIVVPAHNEEVVIANTTKGILNLNYPASKVELLLYADNCQDKTAAEMRKTVDLPQYKYRNVQIIERRGSGGKAGVLNDALKIAQGEYICVYDADALPEKNALYFLVKKVLENPQRYMATFGRNKTRNAKQNFLTKCINQEVIVSQRLQHVGVWNLFKIGRIPGTNFIINTEYVKKIGGWQSGALTEDTEISFRIMEDGYLIALAYNSEAFEQEPEHLRDYYYQRLRWAKGNYQVVMNNFKHLFDTSNWRVKLETFYLACTFFWFNLAVVLSDIIFFVDLGCIITRFFNPEIPIIFAMNSNILLMQLLLINWLLMILLYVIQINLALATQYGQATSDQIWLALVSYFTYSQLFIAISLQAVCSVIGDKVFKRDGTKWVKTKRFAD

SEQ ID NO: 3044 - protein, 630 aa, Oryza sativa
FPLISSAFWIDGDAALSISRESPLLRFFLLGYYYSSSAQPSRPLTPTRAAFSPERAAAKRRRSSPHSSARGGGGAVSRRFLLRGSRRRNGLLRDQVQLVKRKDTNRYEIVRFPDPLSFEKGFFVMIRACQLLVQHNEGMIFVGVAGPSGAGKTVFTEKVLNFMPGVAVISMDNYNDASRIVDGNFDDPRLTDYDTLLENIHGLKEGRSVQVPIYDFKMSCRTGYRTVDVPSSRIVIIEGIYALSEKLRSVLDLRVSVTGGVHFDLMNDGIFQVYPMYKAFIEPDLQTAHIKIINKFNPFSGFQNPMYILKSPRTITPTDIKVALGEDHTESIEETYDIYLLPPGEDPESCQSYLRMRNREGKYNLMFEEWVTDNPFIISPRITFEVSVRLLGGLMALGYTIAAILKRKSRVFSDGKATVKIDWLEQLNRNYIQVQGRDRNHVKFVAEKLGLDGSYIPRTYIEQIQLEKLINDVMGAITQLSEQISTLNERMDEFTSRVEELNCKFAIKKSSTSQQNLALPNETCNGSAPTNLFVSHLGNGTLIPHSSSSNQLLKESPIVDEINAISRGQRQVIHQLDNLTSLLHEHLALTRQGNAVRRNGILEMDMSICPLIALTIGGFGYLVFKSLNRS

SEQ ID NO: 3045 - protein, 162 aa, Capsella rubella
AAPVYLSEVAPPRWRGAFNSGFQFFIGVGVVAANLINYGTDSHRNGWRISLGLAAVPAAIMTVGCLFISDTPSSLLARGKHENAHASLLKLRGVENIADVETELAALARSSQLAIEARAEPFAKTILERRYRPHLVVAVAIPCFQQLTGITVNAFYAPVLFR

SEQ ID NO: 3046 - protein, 429 aa, Magnetospirillum magnetotacticum
MFDPTERGTAIDIEVNERLRRTLALILAGGRGARLMDLTDWHAKPAIPFAGKFRIVDFTLSNCINSGIRRIGVLTQYKAHSLLQHIQRGWGFLRGEFNEFIELLPAQQRTQGEDWYKGTADAVFQNLDIIRAHRPEHVLILAGDHVYKMHYGKMLAHHLAAGADVTVGCIEVPLETAKGFGVMAADEDDRVIRFDEKPANPQPMPGHPDQALASMGIYIFNYQLLHDLLIKDSTSAETSHDFGKDIIPALVKSHRVIAHHFQDSCVMHEGAREHYWRDVGTIDAYWEANIDLTTVTPALNLYDESWPIWTDQPQSPPAKFVFDSEHRRGMAVDSLVAGGCIVSGAVVRRSMLFSNVRVNSFCVVEDAVILPNVDIGRHARLKRCIVDQGAVVPPGLVVGEDAALDASRFHRTEKGITLVTAERLKLLGA

SEQ ID NO: 3047 - protein, 235 aa, Zea mays
MPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPPISSSDSINNRKRKGAGTEEILPQLANRSRHS

SEQ ID NO: 3048 - protein, 445 aa, Lactobacillus delbrueckii subsp. bulgaricus
MSKVITEEEIRKDVEEKNVRFLRLAFTDINGTLKNLEVPVSQLDDVLGNQTRFDGSSIDGFVRLEESDMVLYPDLATWLVLAWTTVEEGTIGRLVCSVHNVDGTPFEGDPRNNLKKVIAEMEEMGFSDFEIGFEAEFFLFKEGKNGEETTKVSDHSSYFDMASEDEGAKCRREIVETLEKLGFRVEAAHHEVGDGQQEIDFRFDNALATADKLQTFKMVVKTIARKYHLHASFMAKPVEGLAGNGMHTNMSLLKDGKNAFYDKDGQYNLSTTALTFLNGILEHARAITCVANPTVNSYKRLIPGFEAPVYISWASRNRSPMVRIPNANEVGTRLEMRSTDPTANPYLLLSACLKAGLTGIKEGKLPMAPVTSNLFEMTDDERKELGIKPLPSTLHNAIKAFKEDEVVKSAFSEHIVDSFLELKETEWALYTQSVSEWEVKRYFNY

SEQ ID NO: 3049 - protein, 146 aa, Triticum aestivum
MICSRPAPHRLESSSSSAPARIPYPAPQPPSRRGAARHSTEESAEMSGVTADEDKKPAGDGGGAHINLKVKGQDGNEVFFRIKRSTQLKKLMNAYCDRQSVDLNSIAFLFDGRRLRGEQTPDELEMEEGDEIDAMLHQTGGCFPGP

SEQ ID NO: 3050 - protein, 638 aa, Saccharomyces cerevisiae
MNQPQIGTYNVGTQLTVGSHQVEIIKYLTSGGFAQVYSALINPPDPHSNSSVACLKRVIVPDKPSLNTLRAEVDAMRLLKNNRYVVSYIDSHAAKAMLHNGSYEVFVLMEYCERGGLIDFMNTRLQNRLHEFEILQIMSQVTQGVAAMHALQPPLIHRDIKIENVLISANNEYKLCDFGSVCGIIRPPRNSQELSYVQQDILKNTTAQYRSPEMIDTFRGLPIDEKSDIWALGIFLYKLCYYTTPFEKGGDLAILSGKFEFPLYPNYSEQLKGLIRDILVQDPRHRPNVYQLLKRISIMQNVPCPINDIQVVQAPSSHLNLTELHQLSATQNILSLNSPTTMENTMPNATFQISMADNTTTAQMHPNRKPSQIAYDASFSNSAKGSQPLFDKSQNMYHALDPPLVEPLASSVSNNDNELKANSATKLKQAIVSEAHTFRQNNSIDFPLQNIIPQYEDSSSSSDESYSGDVDELKKTRSLGSYSTRGNIKKNQSVKESLTSSSLPGTSFTPTSTKVNLKHENSPFKSTFVNTIDNSKDDLNKPSYEDLDVSKQNLKNSIQQRMIDKLNSSEESFNARKMSKVKLHEKGEIDKPTMLKSSGPISKDKKTKPTPPPKPSHLKPKPPPKPLLLAGRKLSLDK

SEQ ID NO: 3051 - protein, 486 aa, Bacillus anthracis str. A2012
MITTEIKRVKNHINGEWVESTGTEVEAVPNPATGKIIAYVPLSPKEDVEKAVEAAKAAYETWSKVPVPNRSRQLYKYLQLLQENKEELAKIITLENGKTLTDATGEVQRGIEAVELATSAPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFHEDNYVGPLIRESHKERVLGYINSGVADGATLLVDGRKIKEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLGTNGTDGVQFYTRKKVVTERWF

SEQ ID NO: 3052 - protein, 406 aa, Brucella suis 1330
MSEEFHKIRRLPPYVFEQVNRLKASARAAGADIIDLGMGNPDLPTPQNIVDKLCEAVQDPRAHRYSASKGIPGLRRAQAQYYARRFGVKLNPDTQVVATLGSKEGFANMAQAITAPGDVVLCPDPTYPIHSFGFIMSGGVIRSVQAKPDDNFIPTLERGVKHSIPKPIALILNFPSNPTAYVATLDFYKDVVAFARKHDIVILSDLAYSEIYFDGNPPPSVLEVPGAMDVTVEFTSMSKTFSMPGWRMGFAVGNERLIAALTRVKSYLDYGAFTPIQVAATAALNGDGSDIAYVRNVYKQRRDVLVESFGRAGWDVPPPAATMFAWVPIPERFRSLGSLEFSKLLVEQADVAVAPGVGFGEHGDDYVRIALVENEHRIRQAARNIKRFFSAKDENLQNVIPLEGHR

SEQ ID NO: 3053 - protein, 317 aa, Klebsormidium flaccidum
EFAINGFGRIGRNFLRCWNGRENSPLEVVVINDTGVKQASHLLKYDSILGTFDADVKVVGDDAISVDGKVIKVVSNRDPTKLPWGEMNIDLVIEGTGVFVDEAGAGKHLEAGAKKVLITAPGKGNIPTYVIGVNEEKYKHSEKIISNASCTTNCLAPFVKVLDQKFGVVKGCMTTTHSYTGDQRLLDASHRDLRRARAAALSIVPTSTGAAKAVALVLPQLKGKLNGIALRVPTPNVSVVDLVIQTEKKTFAEEVNNAFREAANNELKGILDVNDEPLVSIDFRCSDVSSTVDSSLTMVLGDDMVKVVAWYDNEWNS

SEQ ID NO: 3054 - protein, 162 aa, Zea mays
MDAVMFGLETPLMAALQHLLDVPDGDAGAGGDNKTGGGATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 3055 - protein, 141 aa, Oryza sativa
MGILLTRDTLLRATRRRRERTRLLRGLIPLLLGLTLHHLGHTLHSMGTLSLVATLHLVVTPNMVATLLRATPDHLGTRISSHGHGGHMGYGGHGGFGGYGHGYGGHHGGKFKHGKHGHHGKFKHGKHGHGMFGGGKFKKWK

SEQ ID NO: 3056 - protein, 409 aa, Triticum aestivum
MEPVFFSLEEAMPEPDSNPCRTSSPPLEAHMLVAGLGGVGAGEVVGGCATNECATEWCFQKFVDEPWLLNVPTAPVANPEASTLYPNPTAEGSRKRPYDVHEMVGPEEVIPTPPAASPVVDPVAYNAMLRRKLDAHLAAVAMLRTTRGICPQSSHDNGASQNSDSIQGSENHTGDVSLHQLSSSSLEPSPSDGDMEGEAQTIGTMHISAEKANKRKESNRDSARRSRSRKAAHAKELEEQVSLLRVANNSLMRHLADVSHRYVNISIDNRVLKANVETLEAKVKMAEETMKRVTCTNNFPQAMSSISSLGIPFSGSPLNGICDNPLPTQNTSLNYLPPTTTNFDVNNNYIPEPALAFQIQDQIPSLHMQPMSCLDHHPQRMHIGIPTSAPTPQRESTTLDSTEIVNMVM

SEQ ID NO: 3057 - protein, 281 aa, Glycine max
  unsure (1)..(281): unsure at all Xaa locations
MPPSPSFPSENRTKWRKRRKRESYKRNQKRHGDDDDSDDDNEPDDDDSDDQFRSPSAQIAAPRRVDIEVVSPEGVQISRFPPAIRREVXRPHAVVVAIAALEVGDDKSHHNNVPVLENVSHGQLQVLSAVSTDCLGGGSSFVVAPPPVSXGSGVVKRFGSRVLVVPMHSDWFSPASVHRLERQAVPHFFSGKLPDHTPDKYVECRNYIVARYMEEPGKRITVSSCQGLLVGVGNEDLTRIVRFLDHWGIINYCAQGPSCENSDNETYLEEDTSGAICVPST

SEQ ID NO: 3058 - protein, 290 aa, Solanum berthaultii
LNSSYRVPFESFRVPFVDLQEATNNFDEKFHIGLGGFGKVYRGVLRDGTKVALKRCKRESSQGIEEFQTEIEILSFCSHPHLVSLIGYCDERNEMILVYDYIENGNLRSHLYGSDLPSMSWEQRLEICIGAARGLHYLHTSAVIHRDVKSINMLLDENFVAKITDFGLSKKGTELDQTHLSTLVQGTIGYLDPEYFIRGQLTEKSDVYSFGVVLFEVLCARPAIVQSLPREMVNLAEWAVDSHNKGQLEQIIDLNLAAKIRPESLRKFGETAVKCLALSSGDRPSMGDVL

SEQ ID NO: 3059 - protein, 243 aa, Triticum aestivum
MGGGNDGHGYPPGGQGGYPPAGYPPQQGGYPPQQGGYPPQQGYPPAPGAYPPAPGAYPPAPGAYPPAPGAGGPDGEKGLLSNIMHGVAGAHGGGHGYPSGGHGYPSGGHGYPPQQGYPPQHGYPPQQHGYPPQQHGYPPAGYPGSSGHSGSHGGGGMGMGGMLAGGAAAAAAAYGAHKISHGSHGGGGHMMGGMMGGHGGYGGGYGHHGGKFKHGKHGHGKFKHGKHGKHGMFGGGGKFKKWK

SEQ ID NO: 3060 - protein, 344 aa, Hyoscyamus niger
MATFVSNWSTKSVSESFIAPLQKRAEKDVPVGNDVPIIDLQQHHHLLVQQITKACQDFGLFQVINHGFPEELMLETMEVCKEFFALPAEEKEKFKPKGEAAKFELPLEQKAKLYVEGEQLSNEEFLYWKDTLAHGCHPLDQDLVNSWPEKPAKYREVVAKYSVEVRKLTMRMLDYICEGLGLKLGYFDNELSQIQMMLTNYYPPCPDPSSTLGSGGHYDGNLITLLQQDLPGLQQLIVKDATWIAVQPIPTAFVVNLGLTLKVITNEKFEGSIHRVVTDPTRDRVSIATLIGPDYSCTIEPAKELLNQDNPPLYKPYSYSEFADIYLSDKSDYDSGVKPYKINV

SEQ ID NO: 3061 - protein, 458 aa, Escherichia coli K12
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 3062 - protein, 475 aa, Streptococcus agalactiae NEM316
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGQRIGKLAGMRPIMLELGGKDAGIVLADADLDNAAKQIVAGAYDYSGQRCTAIKRVLVVEEVANELAEKISENVAKLSVGDPFDNATVTPVIDDNSADFIESLVVDARQKGAKELNEFKRDGRLLTPGLFDHVTLDMKLAWEEPFGPILPIIRVKDADEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 3063 - protein, 302 aa, Arabidopsis thaliana
MSLVENLFLEPQSKRRKINPETIESPSPNCNHWFVRNKICISCYTTVDNFEGRSFDYLYKGMQMSNEALGFTKGLISQTSWLEDKKLHLVLDLDQTLIHTIKTSLLYESEKYIIEEVESRKDIKRFNTGFPEESLIKLRPFVHQFLKECNEMFSMYVYTKGGYDYARLVLEMIDPDKFYFGNRVITRRESPGFKTLDLVLADERGIVIVDDTSSVWPHDKKNLLQIARYKYFGDKSCLFSEDKKKIDESDEKGPLNTALRFLKDVHEEFFYDWSKKDLDSVDVRPLLKEISLRWKRKADGVV

SEQ ID NO: 3064 - protein, 477 aa, Ceramium horridum
KNERYESGVIPYAKMGYWDPEYAVKDTDILALFRITPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKQLGTVIIMIDLVIGYTAIQSMGVWSRKNDMILHLHRAGNSTYSRQKIHGMNFRVICKWMRMAGVDHIHAGTVVGKLEGDPLMIKGFYDTLLESHLAVNLPQGIFFEQDWASLRKVTPVASGGIHCGQMHQLLDYLGNDVVLQFGGGTIGHPDGIQAGATANRVALEAMVIARNEGRDYVTEGPQILRDAAKTCGPLQTALDLWKDITFNYTSTDTADFVETPTANV

SEQ ID NO: 3065 - protein, 336 aa, Streptococcus sp.
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINSAMKAASNDSFGYTEDPIVSSDIVGVSYGSLFDATQTKVMEVDGSQLVKVVSWYDNEMSYTAQLVRTLEYFAKIAK

SEQ ID NO: 3066 - protein, 168 aa, Triticum aestivum
MAGGGELVVSFGEMLVDFVPTVAGVSLAEAPAFLKAPGGAPANVSIAVARLGGEAAFVGKLGDDEFGRMLAAILRDNGVDDGAVVFDAGARTALAFVTLRADGEREFMFYRNPSADMLLTADELNVDVIKRAAVFHYGSISLIAEPCRSAHLRAMEIAKEAGALLSYD

SEQ ID NO: 3067 - protein, 119 aa, Glycine max
MAFAHYLLAVPVEPSPNFPTNPPKPNPSLSSSSSSSISSHCFNLSSSLRPKHSLFSRFRRICHKAKAKPQEPEVTVASDAFTQFKHLLLPITDRNPYLSEGTRQAIATTSALAKKDGAD

SEQ ID NO: 3068 - protein, 88 aa, Oryza sativa
PGVFFPGWGPPVPPQAENPVFWVRPVPRGIPGYAPLFFSKVFPKGLGAKLQVFSPDFIDGDFFNACAGVPKARVYGPALNCMAGPCSN

SEQ ID NO: 3069 - protein, 394 aa, Oryza sativa
MAAAGEERGGGASGGASPADEESMRRTGSEARGAGTGCGVPARRRSRAGGGVPPRVPTRHRREGARRPPCVPARPQRRGGARRPPQSPRAHDEEEEPAMAAVSLHASPRATAEEEPAAHRAFPCAHDEDEEPAAHRVSPRTRSASASIAGRRRPRAPTAPRAPPSLPRQSHQRVAGVGVLHLASSTAASVSALMSAPSAPPSALSLLTVHADCPSLRRPRQLTTPTARPRRVHCTIDSISLLVLPCRTPVRPKPLATVASPGVKYLSIGEMEAQPPAHAQLGGSATLAKAGGREAAAEEEVVLWREDARRFETPDGEAYLQYRLLAAAQPRSSSSGDGGGGGGATTPAAVMEMAHTYVPGSKRGRGLAARLCDAAFAHARERGMRVLPTCSYIS

SEQ ID NO: 3070 - protein, 429 aa, Candida albicans
MGCGASVPVDDDEIDPFLQDKRINDAIEQSLQLRQQNSKKGVKLLLLGAGESGKSTVLKQLKLLHKGGFTQQERRQYSHVIWCDVIQSMKVLIIQARKLKIKLDCDQPNNSLIPYKQIILRSDPLKQIDASVAGGTDFLNDFVVKYSEENKNKRRLKSTGTTDIWGKDDDSNINSDAINQALESSLNKDSEQFTRLSIAEAIHKLWKLDSGIKKCFDRSNEFQLEGSADYYFDNVVNFADTNYLSTDLDILKGRIKTTGITETDFLIKSFQFKVLDAGGQRSVRKKWIHCFEDITAVLFVLAISEYDQNLFEDERVNRMHESIVLFDSLCNSKWFANTPFILFLNKIDIFENKIKKNPLKNYFPDYDGKPDDTNEAIKFFETNFLKINQTNKPIYVHRTCATDSKSMKFVLSAVTDMIVQQNLKKSGIM

SEQ ID NO: 3071 - protein, 92 aa, Glycine max
  unsure (1)..(92): unsure at all Xaa locations
VGFPTSKTYNDITSIVSNGGRLQCMHVWPPLGKKKSETLFYLPYLYDAQSAXKYXYLLKKGWIPXWEFQLDHSLVYHDHYRLPRYYDGRYWT

SEQ ID NO: 3072 - protein, 377 aa, Oryza sativa (japonica cultivar-group)
MAFYNGASVVALLLLVSTAARAAGDGLLLNGNFEYQPSKSQMNGTRVMAEYAIPYWKITGFVEYISSGQKQGDMLLTVPEGAHAVRLGNEASIEQQISVTRGMYYSITFSAARTCAQSEKLNVSVAPGPESGELPIQTVYTSSGWDSYAWAFKAKRGLVSLIIHNHGEDDDPACGPLIDSVAIKTLYPPQATQNNMLRNGDFEEGPYMFPNAAWGVMVPPISEDDHSPLPGWMVMSDTKAVKCVDSAHFTVPHGARAVELVSGLETALMQEVRTVPGRSYRLEFSVGDASDGCVGSMQVKGYAGQGCTTVTYSSQGTGGHTRASLEFAAVANTTRVVFVSSTYITKWDGTLCGPVVDDASLVCVSQQQPPARRLLRL

SEQ ID NO: 3073 - protein, 351 aa, Azotobacter vinelandii
MSKFWSPFVKNLVPYVPGEQPKLSKLVKLNTNENPYGPSPRAIAAMQAELNDGLRLYPDPNGERLKQAIADYYGVRSSQVFVGNGSDEVLAHIFHGLFQHGRPLLFPDVTYSFYPVYCGLYAIPFETVALDEEFRIRVEDFVRPNGGIIFPNPNAPTGCLLPLESIERLLESNPDSVVVVDEAYVDFGGETAIGLVDRHANLLVTQTLSKSRSLAGLRVGLAVGHPELIEALERIKNSFNSYPLDRMAIAGAAAAFEDRAYFEQTCRQVIDSRERLVGELQRLGFEVLPSAANFVFARHPVHDAERLAAGLREQGVIVRHFKQERIRQFLRITVGAPEQNRALTDVLAALC

SEQ ID NO: 3074 - protein, 254 aa, Zea mays
  unsure (1)..(254): unsure at all Xaa locations
MAPPLALFLLAAIVLSRAVSHGHGGGGGFYDPASVTQLSSRPRAFLYSGFLSDTECDHLVSLAKGSMEKWMVADNESLQVLRYETGQKYDAHFDYFHDRNNLKLGGQRVATVLMYLTDVNKGGETVFPNAEGSHLQYKDETWSDCSRSGLAVKPKKGDALLFFNLHVNATADTGSLHGSCPVIEGEKWSATKWIHVRSFDNPPDVRTDAPCSDDKELCPRWAAIGECHRNPTYMVGTKDTLGFXARKSCGVCDA

SEQ ID NO: 3075 - protein, 357 aa, Magnaporthe grisea
MAEFVRAQIFGTTFEITSRYSDLQPVGMGAFGLVCSARDQLTNQNVAIKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALAHEYLTPYHDPTDEPIAEEKFDWSFNDADLPVDTWKIMMYSEILDYHNAEAGMQQMDDQFTGQ

SEQ ID NO: 3076 - protein, 215 aa, Coxiella burnetii RSA 493
MKNNVIIIGISGPSASGKSLLANTIVNELGSDQVVVISEDSYYKDLGDMPFEERAKINYDHPDSLDHELLYQHLLQLQQGNAIAVPCYDHSRHRRLEKTKTVGRHRIIVLEGILLFVEAQLREIMDIRIFMDTPLDICLLRRLQRDIVERERSLEGVLTQYQETVRPMYLQFTEPSKRYADIIVPRGGENRIAIEMIQAKMRELLGVNGALKRHA

SEQ ID NO: 3077 - protein, 494 aa, GIBBERELLA ZEAE PH-1
MGIFKTAILLAGASLNVLASQFPLNDADSPLASTFQVHQSSLSPEHSIRIKEQVDDSICDARVKQYTGWLDIGNQHLFFWYFESKNAPATDPLVLWLTGGPGGSSMLGLLQELGPCLINEHGNGTVHNPYGWNANANYIFVDQPAGVGFSYLDKDEPIPGNSFVAADSMHKFMQLFTTEVFPDLANRPFHISGESYGGHYIPILGATIVAQNNLYPKRPQVNLESVLIGNGYVSPLDTAFGYWETLCTTNPGVSEPIFNSTRCDIMAANLPRCLDLARVCYEHPDHAICSAASEVCWEGVIKWYDGESGSNGGRNRFDISVPCQSDDDLCYKESALIQNYLNLPRVFKALGVPSAVTNYSILSWDVAEAFELGIDTGISTQSQILYLLNHDIDVLMYQGNLDLACNTAGNLKWSNSMEWKGQPAYVAQRPKAWGAWGEEIGWYKEVKIQMGASDKKTTFSFATVDGAGHMVPQGKPKQALELVNRWLKKRTFAG

SEQ ID NO: 3078 - protein, 250 aa, Glycine max
MSRRYDSRTTIFSPEGRLYQVEYAMEAIGNAGTAIGILSKDGVVLVGEKKVTSKLLQTSTSTEKMYKIDDHVACAVAGIMSDANILINTARVQAQRYTYAYQEPMPVEQLVQSLCDTKQGYTQFGGLRPFGVSFLFAGWDKNFGFQLYMSDPSGNYGGWKAGAIGANNQAAQSILKQDYKDDITREEAVQLALKVLSKTMDSTSLTSEKLELAEVFLSPSGKVKYEVCSPEALTKMLVKSGVTQPATDTA

SEQ ID NO: 3079 - protein, 354 aa, Oceanobacillus iheyensis HTE831
MSKFWSSLAKQVDPYIPGEQLNDDTIIKLNTNENPYPPSNQVIQAIDEASKNLRLYPSPTVDELRSEIGEMYGLSQDHIFIGNGSDEVLAFSFMSFFEPGNRIKYPEITYSFYPVYAKLFNISTDVIPLNDDYTIPVEHFYNSEGGVIFPNPNAPTGIFLEIDQIKRILENNPNQVVIIDEAYIDFALESAVTLVEAFPNLLVIQTMSKSRSLAGLRIGFAIGNPELIIGLERIKNSFNSYTVDRLAIAGAIEAIRDKDYFLQTTTKIIESRSYLKEQLETRHFDILPSQANFLLVSHKEVNAEVLYQELKKQGILVRYFQKPGLENFLRISIGTPAQIEKLLKKIDHIIKPSP

SEQ ID NO: 3080 - protein, 658 aa, Desulfitobacterium hafniense
MTSNEGITISDDENTLTAGERGPTLIEDFLSREKLAHFDRERIPERVVHARGYGAHGEFQPYESLADLTMADFLQDPNKKTPLFVRFSQVVGSKGCNETNRDVRGFSIKFYTDEGNFDLIAINMPVFFIQDAIKFPDLIHAVKPEPDNEYPQGQTDHNTFWDFMANNKETAHMSLWIASNRAFPKSFRTMEGFGVHTFRLVNKDGKSHFVKFHIKPLLGVHSLIWDEAQRLGSDADFHRRDLWENIEIGNYPEYEMAIQVIKEEDEFAYDFDLLDPTKLWPEEEIPLRRIGKIILNRNVENAFAETEQSAFHPGNIVRGIDFSNDPLLQGRLFSYTDAQQARLGPNHQQLPINRPVCPFANNQRDGASRLVIDRGKVAYHRNGLANNSPYTVPGTQGGFVTYPSTVEGHKVRSTAPSFKDHYSQAKMFWNSMSEVEKRQIIGAYCFELGKCGPFVRQEWVDVLAHISTELAKSVSKELGTTVPADVEESPVTKSSPALSLHNTIFVPDTLRVAVFLAQGFDGPGVSKVLETLAEAKLRVVIVHDTLGKVSGTEGVTYEVHDSFLTGSPLVYDGILIVGSGNITPYFTYTAQKFTTDIYNHFKPIGIIQKGDAVLEPLGLLADEGIVTDSGPDFAGRFIKAMAKQRFWNRPSFLYPAMV

SEQ ID NO: 3081 - protein, 422 aa, Glycine max
  unsure (1)..(422): unsure at all Xaa locations
MLPLLHLTHSSMALRLNPIPTQTFSLPQMPSLRSPRFRMASTLRSGSKEVENIKKPFTPPREVHVQVTHSMPPQKIEIFKSLEDWADQNILTHLKPVEKCWQPQDFLPDPSSDGFEEQVKELRERAKELPDDYFVVLVGDMITEEALPTYQTMLNTLDGVRDETGASLTSWAIWTRAWTAEENRHGDLLNKYLYLSGRVDMKQIEKTIQYLIGSGMDPRTENSPYLGFIYTSFQERATFISHGNTARLAKEHGDIKLAQICGMIASDEKRHETAYTKIVEKLFEVDPDGTVMAFADMMRKKIAMPAHLMYDGRDDNLFDSYSSVAQRIGVYTAKDYADILEFLVGRWKVEQLTGLSGEGRKAQEYICGLPPRIRRLEERAQARVKESSTLKFSWIHDREXTTLNAPREEHGEIFRQYRSEKC

SEQ ID NO: 3082 - protein, 481 aa, Paraglossum crassinervium
AARIKNERYESGVIPYAKMGYWDPDYVTKDTDILALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAASGEVKGHYMNVTAATMENMYERAEFAKALGTVIIMIDLVIGYSAIQSMAIWARRNDMILHLHRAGNSTYSRQKIHGMNFRVICKWMRMAGVDHIHAGTVVGKLEGDPLMIRGFYNTLLLPYLEVNLLQGIFFEQDWASLRKVTPVASGGIHCGQMHQLLDYLGDDVVLQFGGGTIGHPDGIQAGATANRVALESMVIARNEGRDYVPEGPQILRDAAKTCGPLQTALDLWKDITFNYTSTDTPDFVETPTANV

SEQ ID NO: 3083 - protein, 480 aa, Martensia fragilis
  unsure (1)..(480): unsure at all Xaa locations
QAIKNERYESGVIPYAKMGYWDPNYVTKETDVLALFRVTPQPGVDPVEASAAVAGESSTATWTVVWTDLLTACDLYRAKAYKVDAVPNTSDQYFAYIAYDIDLFEEGSIANLTASIIGNVFGFKAVXXXXXXXXXXXXXXXXXXXXXXXXXIVERERMDKFGRPFLGATVKPKLGLSGKNYGRVVYEGLKGGLDFLKDDENINSQPFMRWKERFLYSMEAVNRSIAATGEVKGHYMXXXXXXXXXXXXXXXXXXXXXPVIVMIDLVIGYTAIQTMAIWARKNDMILHLHRAGNSTYSRQKVHGMNFRVICKWMRMAGVDHIHAGTVVGKLEGDPLMIKGFYDTLLEPYLDINLPQGIFFQQDWASLRKVTPVASGGIHCGQMHQLLDYLGNDVVLQFGGGTIGHPDGIQAGATANRVALEAMVIARNEDRDYVAEGPQILRDAAKTCGPLQTALDLWKDITFNYTSTDTADFVETPTANV

SEQ ID NO: 3084 - protein, 355 aa, Pisum sativum
MADQDNSTRRPQREAKKRAVAALCEQRKRKRVALGDITNDVVSETEKLVSDSHSHTQKKKKRNIAKSPVPEKLEDPQLCEPYVSDIHDYLRNLEVDPSKRPLPDYIQKVQRDINANMRGVLVDWLVEVAEEYKLVADTLYFSVSYIDRFLSLNDLSRQKLQLLGVSSMLIASKYEEIKPPEVEDFCYITDNTYSKEEVLSMEAEILKTLKFELGGPTIKTFLRRFITKVGQEGVDASELQFEFLCCYLAELSLLDYNCVKFLPSMVAASVVFLARFMLNPKSRPWNSAICQFTSYKPADLKECVLNMHDLYLGRKGATLQAVRDKYKQHKFKCVATTPSPPEISLSFFEFRGADP

SEQ ID NO: 3085 - protein, 337 aa, Glycine max
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 3086 - protein, 334 aa, Nitrosomonas europaea ATCC 19718
MHTGTTLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYHNA

SEQ ID NO: 3087 - protein, 271 aa, ASPERGILLUS NIDULANS FGSC A4
MATPQADKQAVSKAAGQSLVIEEGPLMAPGPNEILVKVEACGVCFSDVFAQNNVMGGGFPIAPGHEIVGRVADRKGSCKACRKDWYQMCDSQVINGVTKDGGYAEYCLLNPEAAVRVPAHLSAAKYVPIPCAGVSVSNSIHHMKVPVGETVAIQGLGGLGHLAIQYTNKMGFRPLGGGDEAALGGFGSPWKVVDSICLNTALRFSSGHAATPQTQKRRLPLRSCKDRLSGGRVPSSQSKRGIRINVEEDSQVPGCHYDGMIQHYGHGNEEV

SEQ ID NO: 3088 - protein, 129 aa, Triticum aestivum
MADHDPELEAIRQRRMQELMGQRGGAASPQNAGQQKAQEDAKLEAEERRQMMLAQILSSEARERISRIALVKPDKARGVEDVLLRAAQTGGISEKVSEERLISLLEQINTHTSKQTKVTIQRRRFDDDD

SEQ ID NO: 3089 - protein, 379 aa, Zea mays
METPLSSRRITRSLAAASAQKSAAAGPDSAALFSRAKNAAAGETQPRAALHDITNDSPIVGLAAGALHATDTTPASTAAKTRRRAPRRTPGSGEALLRGQVKALLHKVEEEQGCAAAALVRPARIQALLGVSRSPAQLLAPTPANTPQIEPVPTPREGLLLLDGATVMPCVLDEEELLIPKLQVIAASLHPPHQAEEKLGDCQLNRALVFDDSPEKCEESSGSSVSSTFSLQESSTGSYVDKSSSPEDDSSSAWSIQVHATSEKGDEEELGVEELAAEYTDEEEEEEDWDEDSDDDCYDDLCEEISRMTVLEEEEKKKTVLPQFEGKHTRFIYNSDDEIERVEEADAAEATAELRALMLRGLLVPEGRHLRFHDEDADE

SEQ ID NO: 3090 - protein, 485 aa, Pseudomonas syringae pv. syringae B728a
MLKNQLKDPSLLVDRAYVDGQWISADDGATLTISNPATGEALAQVPALQGVETRRAIEAADRAWPAWRARPAAERAALLERWHQAMLDNVEDLALIMTFEQGKPLNESRGEIRYGASFVKWFAEEARRSYGETIPAPSADRRLMTLKQPVGVCAAITPWNFPNAMITRKCAPALAAGCPIIVKPSDLTPLSALALALLAERVGIPAGVFNVITGMPTGIGEELTGNPVVRKISFTGSTPVGRLLMRQSAEHIKRLSLELGGNAPFIVFDDADLEQAVTGIMLSKFRNAGQTCVCANRILVQNGIYDRFAARLVEEVSKLKVGNGLEEGVTIGPLINPAAVSKVARHIDDALSQGAKLLHGGSPDGTSQFVQPTVLGDTHAGMLLANEETFGPVAPLMRFTDEAEALALANATPYGLGAYYFTQDLRRSWRFGEALEFGMVGLNTGIISMEVAPFGGVKQSGLGREGSSYGLDEYLEVKAFHVGGL

SEQ ID NO: 3091 - protein, 443 aa, Lolium perenne
MFIESFRVESPNVRYGAGEIQSEYRYDTTELVHESHNGASKWVVRPKSVGYQFRTDTNVPKLGVMLVGLGGNNGSTLMAGVIANREGISWATKDKVQQANYFGSLTQASTIRVGSYNGEEIYAPFKSLLPMVSPDDIVFGGWDISSMNMADAMTRAKVLDIDLQKQLRPYMESIVPLPGIYDPDFIAANQGSRANNVIKGTKKEQMQQIIKDIREFKEKNKVDKVVVLWTANTERYSAVSVGLNDTTENLLASVEKNEAEISPSTLYAIACVMEGVPFVNGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILFEPGEHPDHVVVIKYVPYVGDSKRAMDEYTSEIFMGGKSTIVLHNTCEDSLLAAPIILDLVLLAELSTRI

SEQ ID NO: 3092 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNPGTEVVEAKAGGGSATLSMGQAAARFGLSLVRALQGEQGVVECAYVEGDGQYARFFSQPLLLGKNGVEERKSIGTLSAFEQNALEGMLDTL

SEQ ID NO: 3093 - protein, 221 aa, Microcystis aeruginosa
HKTQREALEFLQDFKSHLDETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 3094 - protein, 494 aa, Prevotella ruminicola
MKIACKFSKLSTFMLFLLKEMFNFATYMKVFVTILASLCIASMHAADFNIKSYGAKNDTTVLSTHALQQAIDACSDAGGGRVVVPAGIYKIGTIQLKSHVHLYLEQGATLYGSTRLEDYIPMKSDYLSLRTQTTTIQLIYADGVQDVSIDGLGTIDGRGRAFKKLSWNDEGITRPHLIPFIQSQDILVRGITLRNSGCWMQHYLACDRLNIDGIKVFNRNNYNNDALDIDGCHEVIVRGMIADSDDDGITLKSTSPRLCENVRISDCVVSSHCNAVKLGTETNGGFRNINISGIVVKPSYNQQEKFFGQWIGSSAISLEIVDGGVLENVNIADFTVEGTESPIFVRLGNRGRGYKTGQHIDHVGSIDGVRINNILIRNAGSMGCSITGLPGYPVRNVWISNVSIHHKGGVKKDQLTEIADSIANEKAADYPEATMWGNLPAKGFFVHHARNVQFSNIHVSTVDEDVRPDFVEVDTKGWGDQGDGTYRNPAPILM

SEQ ID NO: 3095 - protein, 62 aa, Brassica napus
MRGILVDWLVEVSEEYTLVPDCVYLTVYLIDWFLHGKYLERQRLQLLGITCMLIASKYEEIY

SEQ ID NO: 3096 - protein, 434 aa, Staphylococcus epidermidis ATCC 12228
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 3097 - protein, 346 aa, Brucella melitensis 16M
MAPRAKKAPAGKTQASSVNAPKAPSPANFDKKQELEAYREMLLIRRFEEKAGQLYGMGFIGGFCHLYIGQEAVVVGMQMALQEGDQVITGYRDHGHMLAVGMSARGVMAELTGRRGGLSKGKGGSMHMFSKEKNFYGGHGIVGAQVSLGTGLAFANHYRENKSVSLTYFGDGAANQGQVYESFNMASLWKLPVIYVIENNRYAMGTAVSRSSAETDFSKRGLSFNIPGIQVDGMDVRAVKAAADLATEWARSGRGPIILEMLTYRYRGHSMSDPAKYRSKEEVQKMRSEHDPIEQVKNRLIEKGWATEEELKEIDREVRDIVADAADFAEHDPEPDASELYTDILL

SEQ ID NO: 3098 - protein, 860 aa, Oryza sativa
MPVADCESGLSPADVTGAGAANGNPGHWRSYYRHVLLLAYQSCGVVYGDLSTSPLYVYKSTFIIGSLRRFQDEEIVFGVFSLVFWTLTLIPLLKYVFIVLAADDNGEGGTFALYSLLVRHAKFSLMPNQEAADEELTSYYRPGYAPQETPILTALRRFLENHRKSRTFLLVTVLFGASLVIGDGVLTPPMSGERAYRNTTTTWCVVWVADVIDDRSFVLAAGWAVLSSFSGLQVHSTALTSGEVEILSCTVLVCLFMVQHWGTHRVAFLFAPVVIVWLLLLGALGVYNIVVWNPRVLRALSPYYLVRFFQHTGKDGWISLGGILLSMTGKQTLFCSLHCDSSTTYFIIIYIWTEAMYADLGHFTAASIRVAFVGLIYPCLVLQYMGQAAFLSKSPHCDIHFVFFESIPTGIFWPVLVIATLAAIVGSQAVISATFSIVRQCTALGCFPRVKIVHTSRRIHGQIYSPEINWILMLLCIAVTMGLRDTTLIGNAYGMACAGVMLVTTLLMALVIVFVWQYSCLVAALFLVAFGVVEAVYLSAALMKVPQGGWLPLVLSLVFVAVMYVWHYGTRRKHQFDVQNKVSLRWIHALGPSLGIVRVPGIGIIYSELATGVPAIFSHFVTNLPAFHQVLVFICVKAVPVPHVRDEERHLVGRIGPREFRMYRCVVRHGYKDVLAEDTDFENDLVLRIAEFVQMEADFDQRCSISDDGVVASVEVEGRMAVRPCQDGAPHAGARRGGERVVARAAAAAKPESLIHSMHTMHEAESPGFASRRRVRFEVANQHTDPRVKEELSALVEAKHAGVAYIMGHSYIKARKSSSVFKKFAVNVAYAFLRKNCRGPGLVLNIPHISLIEVGMIYYV

SEQ ID NO: 3099 - protein, 430 aa, Agrobacterium tumefaciens str. C58 (U. Washington)
MQDKILLIEDSVALSMLLRTRLSDETEAEVVHCASMAEADALMQANNFTLALTGLNLPDAPKGEILTLLSERKVPAIVFTATVDEEARKRYAEKKIIDYIVKDGHRTVDAVVKTVDRIMTNKRFSVLVVDDARTARSGLVEILERQNFKVSEAHSGNRALEILSQDPSIQLVITDYHMPDMDGYELTRRIRDSRSSEDLRVIGISSSTDRLLSASFLKAGASDFVYRPFVPEELQCRIDNNIETLKQLKRLRELAERDHLTGLPNRRSFFERTRALMDVINDNDESGAVAILDIDHFKKINDTLGHDAGDRALKKLAELLQGMCDEQRHIPARLGGEEFAVFLRGLDARAAYAFCEELREQVEKNGRQLSGSSLALTISLGVVEIEKGEPFDNQLNAADQLLYLAKANGRNRVYSDIMIQEGLQKIGLNG

SEQ ID NO: 3100 - protein, 458 aa, Pseudomonas syringae pv. tomato str. DC3000
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSTSGTEIGISNLWAHGGFMPNGVTGLIASFAVVMFAFGGIEIIGITAGEAKDPQRSLPQAINAVPLRILLFYVLTLFVLMCIYPWPQIGTQGSPFVQIFDNLGIASAATILNIVVISAAVSAINSDIFGAGRMMYGLARDGQAPASFARLSRQGVPWMTVLVMGVTLLGGVLLNYLIPKDVFLLIASLATFATVWVWLMILLTQVAMRRSMSREEVTQLKFAVPFWPYGPAAAIAFMLFIFGVLGYFPDNRAALIVGAIWIALLLIAYGLWVKPKALNKTH

SEQ ID NO: 3101 - protein, 469 aa, Porphyra perforata
VIRYAKMGYWDADYVIKDTDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKEVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 3102 - protein, 212 aa, Magnolia praecocissima
  unsure (1)..(212): unsure at all Xaa locations
ENKINRQVTFAKRRNGLLKXAHELSVLCDAEVALIIFSTRGKLYEFCSSPSMLQTLERYQKCSYSTLEVSAPTNETQSSYQEYLKLKARVEILQRTQRNLLGEDLGPLSTKELEQLENQLEMSLKQIRSTKTQFMLDQLLDLKEGQCWRKQQGLKRKLEEMVEKSSSAVVGHRCTKHVFXKIANLLILRDSSSLWIANQHXRWXTIPCMKIR

SEQ ID NO: 3103 - protein, 252 aa, Triticum aestivum
  unsure (1)..(252): unsure at all Xaa locations
VRGRVGKKKKKKKKKKKKKKKKKKKKKDHTKKKGKNSSRSFPIDLVRQFARQILESVTFMHDLRLIHTDLKPENILLVSPDTIRVHDYKIPIPPPKDGSVFKNLPKSSAIKLIDFASTTFDHQDHIFVVSTRHYRAPXAILGLGWNYPCDLCRVGCILIDLCSREALFQTHENLEHLAMMKNVLCPLPKHMIARADRRAEKYFRRGLMLDCPEGAASLESMKAGWKLPHLQNLDMQHVXHSDWDLIDLLPRA

SEQ ID NO: 3104 - protein, 339 aa, Geobacillus stearothermophilus
MKAAVVEQFKEPLKIKEVEKPTISYGEVLVRIKACGVCHTDLHAAHGDWPVKPKLPLIPGHEGVGIVEEVGPGVTHLKVGDRVGIPWLYSACGHCDYCLSGQETLCEHQKNAGYSVDGGYAEYCRAAADYVVKIPDNLSFEEAAPIFCAGVTTYKALKVTGAKPGEWVAIYGIGGLGHVAVQYAKAMGLNVVAVDIGDEKLELAKELGADLVVNPLKEDAAKFMKEKVGGVHAAVVTAVSKPAFQSAYNSIRRGGACVLVGLPPEEMPIPIFDTVLNGIKIIGSIVGTRKDLQEALQFAAEGKVKTIIEVQPLEKINEVFDRMLKGQINGRVVLTLEDK

SEQ ID NO: 3105 - protein, 492 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 3106 - protein, 504 aa, GIBBERELLA ZEAE PH-1
MSTHEKEHNVAQASSDTADSDSPAAGFRPKGWMYKTLRLGRLELWYASPKVQLFMVSIVCFLCPGMFNALTGLGGGGQVSNEAQDHANTALYSTFAVVGFFAGTFANRLGLRLTLSIGGLGYCVYAASFLCYSHTQNMPFVVFAGALLGVCAGLLWAAQGSIMMSYPPEQSKGRYISWFWVIFNMGAVIGSLIPLAQNINKKAGPVSDGTYAAFIALMAIGAILALMICDADKIVREDNTKVIVMKNPSWSTEIKGLWETLYSAPWVVLLFPMFFSSNIFYTYQNVNMNLAQFNVRTRALNNLLYWLAQIFGALIIGYALDISSVRRSVRAKISLVVLFVLTFAIWGGGYAWQKDQRPREIAMNPANENDKIDWDDGAKRFVAPMILYFFYGFFDAAWQTCIYWYMGALSNSGRKTANFAGFYKGIQSAGAAIFWRMDGLGKPFDTIFAATWACLGASLVIAAPVIFMKIQDSISMEEDLKFSDEKIEDVVVAPTTKKTTDIES

SEQ ID NO: 3107 - protein, 205 aa, Triticum aestivum
  unsure (1)..(205): unsure at all Xaa locations
MAPTVMASSATSVAPFQGLKSTAGLPVSRRSNGASLGSVSNGGRIRCMQVWPIEGIKKFETLSYXPPLSTEALLKQVXDYLDSAPKWVPCLRVQQGGFIFPLSTTHPLGYYDGRYWXTMXETAYFRCTDPPSVQRSGGVKKEYLDPYSASSVRQLRKSMRQIALSHGLQESARLNTHHTGNIKCNAVAPTFCGGSFTSLPKLSRK

SEQ ID NO: 3108 - protein, 587 aa, Oryza sativa (japonica cultivar-group)
MESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQPLTCYQAVVNNLDDAHDQIDRAISTAIRESKPVYISVSCNLPAVPHPTFSRDPVPYFLSPRLSNQASLHAALDATLAFLDKAVKPVLVAGPKLRVAKAGGAFVDLADASGHAVAAMPSAKGLVPETLPRFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPEGQLPECEAGEALRVNVLFKHIQRMIGGTEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 3109 - protein, 307 aa, Agrobacterium tumefaciens str. C58
MMKENTMDLNRTVRKAVIPVAGNGTRFLPATKAMPKEMLTIVDRPVVQYAVDEAMQAGIEHIIFVTSRNKTAIEDYFDSAPELINTLTRSGKTVQVLQLEKMLPVAGTVSYTRQQVPLGLGHAVWCARELVGKEPFALLLPDMVSYGARGCIAGLMELYDEVGGNILGVEECLPEEVSSYGVVGVGQKVNHGFSVTEMVEKPEPSKAPSNYYLNGRYILQPEIFDILARQERGAGNEIQLTDGMKRLAEKQPFHAQKYSGRTFDCGSKQGFIAANVAFSLMRSDMEAQVLASVKELIANHESRVQAA

SEQ ID NO: 3110 - protein, 564 aa, Triticum aestivum
MSQSSPFFSIAPAHAGAGGQAAAAALLLRCPAAQLPPAIHCFRLAKVSPAKTLSSHLVLPRATLSSFANADDGSGANSDASGEQSGGSELSEMAKAFHISPRMAMSISVVIAFAALTVPLAMRSLLFHGTTKMKVLAYLTLLSGFYMAWNIGANDVANAMGTSVGSGALTLRQAVLTAAVLEFSGAFLMGTHVTSTMQKGILVTSVFQGNDSLLFAGLLSSLAAAGTWLQVASSYGWPVSTTHCIVGAMVGFGLVYGGVNAVFWSSLARVSSSWLISPLMGAAVSFLVYKCIRRFVYSAPNPGQAAAASAPIAVFTGVTAISFAAFPLSKTFSIAVLQALVCGAIGAVFVSRAIKKQLGDLLSSEAEKIATADNTDVQQGGFDVAGPRGAQLQIVYGVFGYMQVLSACFMSFAHGGNDVSNAIGPLAAALSLLQGVASSAEIVIPTEVLAWGGFGIVAGLTMWGYRVIATIGKKITELTPTRGFAAEFAAASVVLFASKLGLPISATHTLVGAVMGVGFARGLNRVRAETVREIVVSWVVTIPVGALLSVIYTLILTKILKYFM

SEQ ID NO: 3111 - protein, 118 aa, Oryza sativa
  unsure (1)..(118): unsure at all Xaa locations
VKDLDERTWAGDHNRFCDHTXGIHVPRIQDPTRERRMRFADSVIDELYTYIDGYDTRNPARANPXNPSIELGAEFKKVGCFLGRCKQIPSIVELDTLTVWRDARIGSSITLKGKVTIT

SEQ ID NO: 3112 - protein, 332 aa, Saccharomyces cerevisiae
MIRIAINGFGRIGRLVLRLALQRKDIEVVAVNDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLEKEATYDQIKKAVKAAAEGPMKGVLGYTEDAVVSSDFLGDTHASIFDASAGIQLSPKFVKLISWYDNEYGYSARVVDLIEYVAKA

SEQ ID NO: 3113 - protein, 206 aa, Triticum aestivum
MGEQGTSGSEGGGSMVEAQAPAKKGDGRAADPRLQGISDAIRVVPHFPKPGIMFNDITALLLRPGVFKDAVDMFVERYRGMVIAAVAGIEARGFIFGPAIALAIGAKFIPLRKPGKLPGAVISENYTLEYGTDCLEMHVGAVEPGDRVVVVDDLVATGGTLSAAIKLLERAAADVVECACLIGLPKFKDFYKLDGKPVYILVESKK

SEQ ID NO: 3114 - protein, 431 aa, Arabidopsis thaliana
MGGSDENRHGVIGPMNRQQGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNECRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 3115 - protein, 315 aa, Phaseolus lunatus
MSNFPVINFERLNGEERKDTMEKIKDACENWGFFELVNHGIPHDLLDTVERLTKEHYQKCMEERFKELMASKGLEAIQTEVKDMDWESTFHLRHLPESNISEVPDLVDEYRKVMKDFALRLEKLAEQLLDLLCENLGLEKGYLKKAFYGSRGPTFGTKVANYPPCPNPELVKGLRPHTDAGGIILLFQDDKVSGLQLLKDDQWVDVPPMRHSIVVNIGDQLEVITNGKYKSVEHRVIAQTDGTRMSIASFYNPGSDAVIYPAPELLEKEAEEKAQLYPKFVFEDYMKLYAKLKFQAKEPRFEAFKASNFDPIATA

SEQ ID NO: 3116 - protein, 117 aa, Glycine max
  unsure (1)..(117): unsure at all Xaa locations
MASSMIFSPADTTVNRAGAGMAGPFTGLKYMAGFPTXRKTNNDLTWIARHGGKRPCMHVWPTIGKKKFETLSYLPDLDDXPLAKEGQYPLKKGWDPLLGITLEHRFAYPEHKKAPGY

SEQ ID NO: 3117 - protein, 387 aa, Zea mays
MADQANQPTVLHKLGGQFHLSSTFSEGVRARNICPSVSSYERRFATRNYMTQGLWGPSMSVSGGINVPVMQTPLCANAPAEKGGKNFMIDFMMGGVSAAVSKTAAAPIERVKLLIQNQDEMIKSGRLSEPYKGIADCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 3118 - protein, 488 aa, Delamarea attenuata
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 3119 - protein, 434 aa, Glycine max
PRRPSVRLFACTASDHVNLTRPEPYGAGVGGLSRDIPETANVKLPCNTTHCQNSSKSKQARPITVGIVLLTIAVSAIGILTFTVYRRRKQKLGSTFDISEGCLSTDEANGAYRKNGSPLVSLEYSNGWDPLADSRNFNGDRQDMFQSFRFNLEEVESATQYFSELNLLGKSNFSATYKGVLRDGSVVAVKSISKTSCKSDEAEFLKGLNILTSLRNENLVRLRGFCCSRGRGECFLVYDFVSNGNLSCYLDVKEGDGEVLEWSTRVSIVKGIAKGIAYLHAYKAKKQALVHQNISAEKVLIDQRYNPLLSDSGLYKLLTNDIVFSALKGSAAKGYLAPEYTTTGRFTEKSDVYAFGVLLFQILTGKQKITSAMRLAAESFKFPEFIDPNLHGKFFEYEAAKLARMALLCSHESPFERPSMEAIVQELGNCSSCL

SEQ ID NO: 3120 - protein, 607 aa, Triticum aestivum
  unsure (1)..(607): unsure at all Xaa locations
MDTHIGSVDGPSPAAVNGAVGCPASAPGCPIMSSHPVVSPGEASLGRHLARRLVQVGVSDVFAVPGDFNLTLLDHLVDEPGLRLIGCCNELNAGYAADGYARARGVGACAVTFTVGGLSVLNAIAGAYSENLPVICIDGGPNSNDYRTNRILHHTXGIPDFSQELRCFQTVTCHQAVVTNLDDAHEQIDTAIATALRESKTVDLSISCNLPGLPHPTFTRDPVPFFLAPRMSNKMGLEAAVEATVEFLNKAVKPVLVAGPKLRVAKAGKAFVDLVEAASGYAYAIIAIGRFVPETHPHFLGTHLLGRRQPFCARRDWRVGRRLFAGPTFNDCRSLGWSFLPKKDKDIIVRPERVIAGNGTACGCAMIREYRTGLARRIRKKNTANENXKNIFVFVGHPLQGEANATEPLRVHVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWNYTALVEAIHNGEGKCWTAKVKCEEELTAAIETALGEKKDSLCFIEVIAHKDDTSKELLEWGSRVSAANSRPPNPQ

SEQ ID NO: 3121 - protein, 194 aa, Glycine max
ACATYFKCINIFNRIMTIADDVNYYDIRKKCVGDLCYDFSVMEDFLNKKTVRDALGVGDLDFVSCSSTVYSAMMQDWMRNLEVGIPTLLEEGIKVLVYAGEEDLICNWLGNSRWVNAMEWSGQKQFGASGTVPFLVDGAEAGTLKSHGPLSFLKVYEAGHMVPMDQPKAALEMLRSWMQGKLTMTKSGDNVSPK

SEQ ID NO: 3122 - protein, 148 aa, Synechocystis sp. WH 8501
MSNWLEHSVQIEVDAPMELVWGLWSDLEQMPQWMKWIDSVKILDENPELSRWKLASGGLEFTWLSKILKVVPHQIIQWESVDGLPNRGAIRFYDRQGSSIVRLSVAYGIPGWLGKLMDNLFLGRVVESTIMADLERFRDYAMKAKENQ

SEQ ID NO: 3123 - protein, 320 aa, Oenococcus oeni MCW
MSEFITIGEPIVTFASTDADADLVHAENFKKIVGGAELNVAIGVSRLGHSTQYISRVGNDPLGTFVKNEIKSNQVGADYVSSDNDNWTAFQLKEKVTVGDPLTFNFRRNSAAAHLSSGIIDRVDLSDVKIAHMSGIFPAISKTAQTSFRHLFERLNQRNIFTTFDPNLRPSLWPNEKTMIKTINELAAFADVVLPGTNEGEILIGSKDPETIADFYLQADKTKTVIVKVGPQGAYVKNKGQSGYYVNGFKVGKVVDTVGAGDGFALGYITATLEGKSQKSAVMRGNAVGALQVQTPGDNDGYPTVKKLADFYAKEGVSEK

SEQ ID NO: 3124 - protein, 534 aa, GIBBERELLA ZEAE PH-1
MLGQKSIKVNGADCGVEAILLGVITSIGGFLFGYDTGQISSMLLFSDFKERFAQGPAGDKEWNPYIQSILVSLMSIGSLIGALSGAYTADWWGRRKSMTFGVAVFIIGNIIQISAMESWVHMMMGRFIAGLGVGNLSVGVPMFQSECAPREIRGAVVASYQLMITIGILISNIACFGFKKMDTSSASWRIVIGLGILFSLPLGIGILIVPESPRWLASRGDWEGAQIALGRLRGMKHNLDHPLVQDDLKEMKDILEKERQVGQGSWAECFNPKSGIPKLVWRTFLGFFIHFLQQWTGVNYFFYYGASIFESAGIEDPIQTQLILGAVNVATTFMGLWFVERFGRRWPLFIGALWQAGWLAVFAAIGTAMNPSESKAVGIVLIVCACMFIASFASTWGPMAWVVIGESFPLRTRAKQASIATAGNWLGNFMIAFLTPIATAGISYGYGFVFVGTNLAAAALVWFFLFESRALSLENVDLMYGQEGLKPWNSHKWVPPGYITREQRDEVHFQRGNEKPRNSESHSGEDSRVESVMA

SEQ ID NO: 3125 - protein, 387 aa, Oryza sativa
MWRLKVAQGGGALLRSTNGFAGRAVWEFDPDHGTPEDRANVERVRRDFTDHRLRRPESADLLMRMQFARENNHQRRGDRIPPAVNKLGEKEQVTEETVMASLRRALDEFSSLQADDGHWPGDLSGAIFIMPVLIFSLYATGSLDTVISSEHRREICRYIYNHQNEDGGWGMLILGSSTMFATCLNYVTLRLIGEEPSNEQLARGHAWIISHGGATLVPQWGKICLSFIIRGKFWGPTRVVYVPMAYLYGKKFVGPITPTILALREEIYTDPYHTIDWAQACNACSKEDLVCPRTLLQNVVWTSLYKWVEPVLGSRPMNKLRERALDRLMEHIHYEDENSQYLCLCPVNKALNMVCCWVEDPNSDSFKRHLARIPDFLWLSEDGMKAQ

SEQ ID NO: 3126 - protein, 492 aa, Glycine max
MDPYKLRPSSAFNSPFWTTNSGAPVWNNNSSLTVGARGPILLEDYHLVEKLANFDRERIPERVVHARGASAKGFFEVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDLGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAETFPIPPAICSGRREKCGIEKENNFKQPGERYRSWAPDRQDRFNRRWVDALSDPRVTHEIRSVWISYWSQADRSLGQKIASRLSMRPNI

SEQ ID NO: 3127 - protein, 198 aa, Sulfolobus tokodaii
MTNIPEIPYKAVVNIENIVATVTLDQNLDLYAMERSVPNVEYDPDQFPGLIFRLEAPKVTSLIFKSGKMVVTGAKSTDELIKAVKRIIKTLKRYGMNLTGKPKIQIQNIVASANLHVIVNLDKAAFLLENNMYEPEQFPGLIYRMEDPRVVLLIFSSGKMVITGAKREEEVHKAVKKIFDKLVELDCVKPFEEEELEF

SEQ ID NO: 3128 - protein, 323 aa, Pelargonium x hortorum
MENFPVIDMEMLNGEERSAAMNMIKDACENWGFFEIKNHGISHELMDKVERLTKEHYAKFMEQRFKEMVASKGLDATQSEIDDLDWESTFFLRHLPTSNISEIPDLEHDYRLAMKEFAERLEKLAEELLDLLCENLGLEKGYLKKAFYGSKGPTFGTKVSNYPPCPKPELIKGLRAHTDAGGLILLFQDDKVSGLQLLKDGRWIDVPPMRHSIVINLGDQLEVITNGKYKSVMHRVIAQTDGNRMSLASFYNPGSDAVIYPAPALIEEENQNPIYPKFVFEDYMKLYAGLKFQAKEPRFEAMKAMPLPMAMDTTPLQGPVATA

SEQ ID NO: 3129 - protein, 414 aa, Streptomyces coelicolor A3(2)
MTPAGSELRRTLGLGDAAVVGLGSMIGAGIFAALAPAAGAAGSGLLLALAGAAVVAYCNALSSARLAARYPASGGTYVYGRERLGEFWGYLAGWSFIVGKTASCAAMALTVGAYVWPEQAHTVAVAAVVALTAVNYGGIQKSAWLTRVIVAVVLAVLASVVVVCLGSGRSDAGRLDIGLSGGAGGVLQAAGLLFFAFAGYARIATLGEEVRDPRRTIPRAIPLALGLTLAVYGCVAVAVLSVLGPVGLGQATAPLADAVRTAGLPGLVPVVRAGAAVAALGSLLALILGVSRTTLAMARDRHLPQALAAVHPRFQVPHRAELAVGAVVAVLAATVDVRGAIGFSSFGVLVYYAVANASAWTLDPSRLSRVVPALGLIGCVVLAFSLPAVSVVVGVGVLAVGVVAYGVRGQQVPR

SEQ ID NO: 3130 - protein, 293 aa, Zea mays; identical to SEQ ID NO: 2668

SEQ ID NO: 3131 - protein, 762 aa, Triticum aestivum
  unsure (1)..(762): unsure at all Xaa locations
MPPLYVFSLGLLLLLHIPHWCPSSAAASDTLTAGQSLAVGSKLVSRNGKFALGFFQPAAGITSKSQNTTSSSWYLGIWFNKIPVFTAVWVANRDQPITGPNLNLTQLKISSYGNLVIVNNDSVVWSTHTVNNRTQTSSINTTTGAAVLLNSGNLALTVTESPSSSDLPLWQSFDYPTDIFLPGSKFGRNKVTGLIHQSISKKSLIDPGLGSYSIELEETKGIVLKRRNPLVVYWHWASSKTSSLSLIPILNSILDLDPRTKGLINTTYVDNNQEEYYTYTSPNESSPTFVSLDISGLIKLNVWSQANQSWQIIYTQPADPCTPAATCGPFTVCNGIAQPFCDCMMNFSQKSPLDWEFNDRTGGCIRSTPLHCNTSSNNKNITSSTDMFHSIAQVTLPYNPQSIDFANTQSECEEACLSSCSCTAYSYNSSRCSVWHGELLSVNLNDGIDNTSEDVLYLRLAVKDLLPSLKKKKKKPKVGVTIASIIGFGLIMVMLLLLIWRYKFKCCGLPIYDNPGSAGGIVAFRYTDLVRATKSFSEKLGGGGFGSVYKGVLSDSTTTIAVXRLDGARQGEKQFRAEVSSIGLIQHINLVKLIGFCCEGDHRLLVYEHMLNGSLDGHLFKKSNANVVVLNWNIRCQISLGVARGLCYLHQSCRECIIHCDVKPGNILVDASFAPKVADFGLAAFVGRDFSRVMTTFRGTAGYLAPEWLSGVAITPKIDVLCEEGWGGGGWVCVGVGCGVLGVAVGVEGCYVQVGVGDGEGG

SEQ ID NO: 3132 - protein, 97 aa, Triticum aestivum
  unsure (1)..(97): unsure at all Xaa locations
IAGSVNNIEVEVDMPLVLTIVQKYQGCIFITVETSGRNAIXSVLKSGDQVLYTXSFFGDELGTANKLVFTMTDFQAKPDSVYFVVSYVGGYIDVTPL

SEQ ID NO: 3133 - protein, 509 aa, Xanthomonas axonopodis pv. citri str. 306
MNALASAKSLNNDPHSIFKPRYDNFIGGQWVAPHSGQYFDNTTPINGKVFTSIARSTAPDIEAALDAAHAAKDAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDAFMEKALSRVAAIKQGNPLDPNTMVGAQASSEQLEKILSYIDIGKQEGAEVLIGGERNTLDGDLAEGFYVKPTVFKGHNKMRVFQEEIFGPVVSVTTFKDEADALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 3134 - protein, 207 aa, Daucus carota
MERADQQARGFQGYRKIHQQQQLPASGTASTGTDNNPAAGDQDCLVREQDRFMPIANVIRLMRKSIPSHAKISDDAKELVQESVSEFISFVTSEANYRCQKEQRKTITAEDVLWAMSSLGFDDYVEPLTFYLDRFREADGGERSALRGEPLVRRSGEHGAPGIPPTFAPGYYMGPHNALLGAVTMGSFVNDVHNAGPSGAGVNTLDP

SEQ ID NO: 3135 - protein, 564 aa, Schizosaccharomyces pombe
MFGVYFVLLFLSSALIHVANAGSNAEWRKRIIYQILTDRFAVDDGSTDNPCDPDANQYCGGTWKGIENKLDYIEDMGFNAIWISPIDKNIEGDIDGAGYAYHGYWNTDYESLNEHFGTEDDLVSLITAAHKAGIWVMLDSIVNSMALAPPLADADYSSLNPFNKESYFHPYCLIDWDITDNETNVMDCWQDSGVLLADLDVESSDVSSYLSDHFKSLISKYDFDGLRIDAVKMMNYTFFPDFVDATGVYSVGEVFSYDPDTMCSYMSVLPGVTNYFLQLYINFSFTATGAGFTLIPTYQEVMASNCSKYDSTLMLTFIENHDLYRFPYYTSDQSQIMGALSFVLIWDGIPSIFYGQEQGFNGGEDPANRPALWLTDYDQSNPYYTVIKTMVAFRKFVITQDPDWVTSTYQSIESAVDHYVGQKNDVLVMFNNMGVTNNLTIYEVETNYTANEVVSDVFGHRTLTVGADKTLTASMTNGYPLIMYPHSKMSGFTLPTVNRTVMPSTSATATTTVYTSYYSPSYSARSFTGTGSIFTISSSSRLILSFKTLVFGLGVTAMLFVLFF

SEQ ID NO: 3136 - protein, 408 aa, Pseudomonas putida KT2440
MTAVAEVSQARPLMPVEQALEQLLALAEAAPIRETENLPLAEAEGRVLATDLVASLDLPPWPNSAMDGYALRLADWQGQPLPVSQRIFAGHAPQPLQPGTCARIFTGAPVPEGADCVEMQENTEVLEDGRVRFLEALRTEQNIRPQGQETRKGEQVMSAGTRLGPIELGLAATLGHGRLDVVRKVKVAVLSTGDELVEPGLPLGPGQIYNSNRRLLVSWLQRLGCEVVDAGILPDDLARTRACLAELGGVDLILSTGGVSVGEADYLGAALREAGELALWKLAIKPGKPLTFGHFQGVPVIGLPGNPASTLVTFGLLTRPYLLRRQGVIDVTPLRFDMPAGFDWPKPGTRREYLRARIEQGRVRIYKNQSSGVLRSAAWAEGLVEVREGSTPKQGDIVPFIPFSELLG

SEQ ID NO: 3137 - protein, 521 aa, Gossypium barbadense
  unsure (1)..(521): unsure at all Xaa locations
MVGNSLAGLQDHLKLAREYALEGLYDTSIIFFDGAIAQINKHLNTLDDPLIRSKWMNVKKALSEETEVVKQLDAERKAFKEAPNGAAVLLPTRSCQIIFLCFHPLDEYPTSSGAPMDDPDVWRPPSRDTSTRRPARGGQAGMRKSPQDGISGRGNTRTAATGRGAKAGASSRTNTGVRGSTTGKKGTGSGKSSKGDSANGDAEDGKLKRSQYEGPDPDLAEMLERDVLETTPGVRWDDVAGLTEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCNARGASGEHESSRRVKSELLVQVDGVNNTGTNEDGSRKIVMVLAATNFPWDINEALXKRLEKRIYIPLPNFESRKELIRINLKTVEVAADVDIDEVARRTEGYSGDDLTNVCRDASLNGMRRKIAGKTRDEIKNMSKDEISKDPVTMCDFEEALAKVQRSVSQADIEKHEKWFSEFGSA

SEQ ID NO: 3138 - protein, 455 aa, Coxiella burnetii RSA 493
MPIRTTNPSTGEVIKTYQEMTDQQVEDIINDVHYDYEKWRSVGFKERGGKLRRIAERLRKNKTDYAKLIATEMGKPITAGEAEAEKCAWVCDYYADHAEALLKPRIVNTDWKKSYVTYQPSGVIFGIMPWNFPLWQVFRFAAPNLMAGHGCLLKHASISTGTALAIEKLIQSADLPDNIFRTLVINTEKASDVISHPKISAVTLTGSEGAGKAVGSAAGKALKKVVLELGGNDAYLILKDADLEKAAEACVESRLSNSGQSCIAAKRLIIVENVYDEFKALVIEKAQSYRMGDPLKKETELGPLARSDLRDTVHGQVRESIDKGALLETGGEIPESKGFYYPPTVLSGVRAGQPAFDDEVFGPVIALIRAKDEKHAIEIANNSKFGLGAAVFTNDNERGEKIAASELQAGTCVVNTFVKSDPRLPFGGVKHSGYGRELAAEGIRSFMNVKTVVVD

SEQ ID NO: 3139 - protein, 396 aa, Triticum aestivum
FFTDAYDLFCISLVTKLLGRIYYYREGADAPGSLPPNLAAAVNGVAFCGTLSGQLFFGWLGDRMGRKRVYGMTLMCMVLCSIASGLSFGSTPGSVMATLCFFRFWLGFGIGGDYPLSATIMSEYANKKTRGGFIAAVFAMQGFGILTGGVVTLIVSAAFRAAFPTQAYQDAPLASTPAQADFVWRFILMFGAVPALMTYYWRMKMPETARYTALVAKNAKQAAADMSKVLQVDIGAEEEDPKANDGVGAADDRNSFGLFSGEFLRRHGLHLLGTATCWFLLDIAFYSQNLFQKDIFTAINWIPKAKTMSALEEVHRIARAQTLIALCGTVPGYWFTVALIDRIGRFWIQLGGFFFMAVFMLGLAFPYHHWTTPGNHIGFVVLYALTFFFANFGPNA

SEQ ID NO: 3140 - protein, 381 aa, Cicer arietinum
WRSLRRACATKIFSPQQLDSTQFHRKRKVQDLLNYVQKCCEKGEALDFGEVVLATVMNSISETFISMDLFHYCDPSNDDDNKKSREFKEMVFGIMEEVGRPNVVDFFPFLKLFDPQGVRTRMRNHFEKLLAFFYEVMKERMRLRASGESKEYKDVLDSFLDLLNEENSQLCRHDVLHLFTDLFVAGIDTTSTTMEWAMAELLHNPSKLARLRKELEQIHGKFGQIEESDASKLPYLRAVVKEILRLHPSVPFLVPHKSKDDGELGGFMVPKNAQILVNVWSIGRNSSIWDNQIHLNLKDFWRVKLISKGRDFELVPFGAGRRICPGLPLASRSIHYIMASLLHHFNFKLADDLKPDDMDMSHKFGVTLHKAQPLRVVPIKA

SEQ ID NO: 3141 - protein, 395 aa, Glycine max
  unsure (1)..(395): unsure at all Xaa locations
ISLSHRLNAVKPSKTLSICHHATALLQADFDSPDVIAEAGMNATREGYTRYTPNAGTLELRHAICRKLKXQYGITYSSDQIVVSNGANQSIVQAVLAVCSPGDEVIIPAPFYTSDPEIARLADATPVILPSHISNNFLLDPKLLEASLTERSRLLILCSPCNPAGSVYSKKLLEEIAQIVAXIKHPKLSVLSDEIYEHIXYAPTTHTSFASLPGMWDRTPTVNGFSKTFAMTGWRLGYIACPKHFVAAFGKIQSQFTSGASSISQKAGVAALGIGYAGGEAVSTMVKAFRERKFQVISSLXGFIHVAFQYSIDHHHLATLHKKFKNSEKLNTLAQVITXVLLIFFTHNRFALVLGSAFGDDSCIRISYDESLTNLKTTMERIKKALIPLSSDALV

SEQ ID NO: 3142 - protein, 129 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMD

SEQ ID NO: 3143 - protein, 317 aa, Glycine max
MGSEVSKQMERRKTIQTEKKSLSDLKSSGEDYPGSDYRPQDRKNWMSHLDPQKLRINQIVWPGTHDSATNKIGIPLLTRPFAQCQSLSIYRQLSLGTRVLDIRVQEHRRVCHGILLTYGVDLVLNDVKKFLSDTQSEIIILEIRTEFGHEDPPEFDKYLEEQLGEHLIHQDDAVFGKTVAELLPKRVICVWKPRKSSQPKPGSPLWSAGFLKDNWINTDLPSTKFDGNLNHLSEHPPVTSRKYFYRIENTVTPVADNPVLCVKPVTRRIHGYARLFIAQCFAKGFADRLQVFSTDFIDEDFVDACAGLTHARVEGKA

SEQ ID NO: 3144 - protein, 102 aa, Glycine max
  unsure (1)..(102): unsure at all Xaa locations
SNISSTVHLQPAVLYDAGCTNLKSMAVFPTRKTNNYITSIASNCGRVQCMQVWPPIVKKNFETLSYLPDLYDAQFAYEVXYLLMKVCIPFLEFVLEHIFLFP

SEQ ID NO: 3145 - protein, 444 aa, Pseudomonas fluorescens PfO-1
TLRKFAGLGALLSIVMPGLAMAADEVAAPVLNSGDTAWMLTSTALVLFMTIPGLALFYGGMVRSKNILSVMMQCFAITGLISVLWVIYGYSIAFDTTGMEQGVVNFNSFVGGFGKAFLAGVTPASLTGPAALFPEAVFITFQMTFAIITPALIVGAFAERMKFSAMLIFMGIWFTLVYAPIAHMVWSGNGGLMWDWGVLDFAGGTVVHINAGVAGLIACLVLGKRKGFPTTPMAPHNLGYTLMGAAMLWVGWFGFNAGSAAAANGTAGMAMLVTQIATAAAALGWMFAEWITHGKPSALGIASGVVAGLVAITPAAGTVGPMGALVIGLAAGVVCFFCATTLKRKLGYDDSLDAFGVHGIGGILGAILTGVFAAPSLGGFGTVTDIAAQVWIQCKGVGFTVIYTAIVTFIILKVLDAVMGLRVTEEEESVGLDLAQHNERGYNL

SEQ ID NO: 3146 - protein, 99 aa, Zea mays
SVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQ

SEQ ID NO: 3147 - protein, 89 aa, Oryza sativa
  unsure (1)..(89): unsure at all Xaa locations
MRHHSSSVIQRRADRASVRAYQMSAGREEDKNPSPGEGSXDHMNFKVKGEDTNEVFLTIKRSTQLXKLMNTYCDREGWHSNAIGFLWGG

SEQ ID NO: 3148 - protein, 534 aa, Lycopersicon esculentum
MGLDAVARLGVSILSDGDQVSVDSITLFVALLCGCIVIGHLLEESRWINDSITTLVIGLSTGGIILLTTKGKSSHLLEFDEQLFFIYVLPPIIFNAGFQVKKKQFFRNFVTIMLFGAVGTLISFSIISFGAKELLGKLDIGFLELRDYLAIGAIFSATDSVCTLQALNQDETPRLYSLVFGEGVVNDATSVVLFNAIQKLDLSHINSRAALVFTGNFLYLFLASTFLGVLIGLLSAYLIKKIYLGRHSTDREVALMILMAYLSYVMAELFDLSGILTVFICGIVMSHYTWHNVTFNSKVTTRHAFATLSFIAEIFIFLYVGMDALDIEKWRFVKDSPGKSVGVSAALLGLVLVGRACFVFPLSLFSNCLKRSEHDKFGLKLQVTIWWAGLMRGSVSMALAYNQFTRFGHTQQPGNAVMITSTITIVLFSTVVFGLITKPLVRFLLPSSQGFNNLISSEQSFARPLLTNEQELELEMGNVDPVRPSGLSILLKEPSYTIHNHWRRFDDAFMRPLFGGRGFVPDAPELSKGGCDQY

SEQ ID NO: 3149 - protein, 514 aa, Escherichia coli
MKIRSQVGMVLNLDKCIGCHTCSVTCKNVWTGREGMEYAWFNNVETKPGIGYPKNWEDQEEWQGGWVRDVNGKIRPRLGNKMGVITKIFANPVVPQIDDYYEPFTFDYEHLHSAPEGKHIPTARPRSLIDGKRMDKVIWGPNWEELLGGEFEKRARDRNFEAMQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEREVDLYERQCEVFLDPHDPSVIEEALKQGIPQNVIDAAHGSPVYKMAMDWKLALPLHPEYRTLPMVWYVPPLSPIQSYADAGGLPKSEGVLPAIESLRIPVQYLANMLSAGDTGPVLRALKRMMAMRHYMRSQTVEGVTDTRAIDEVGLSVAQVEEMYRYLAIANYEDRFVIPTSHREMAGDAFAERNGCGFTFGDGCHGSDSKFNLFNSSRIDAINITEVRDKAEGE

SEQ ID NO: 3150 - protein, 257 aa, Zea mays
TRTCRLYDAVNVLLSLQNPNGGYGTWELARTYPWIEIFNMTEIYADIMVEHQYVECTSSVMQALVLFREKYPWHRKDEIDQCIRGATEFIEKLQNDDGSWFGSWGICFTYGTWFAIDGLSAVGQSYGNSTCIQKACKFLLAKQLKNGGWGESHLSSTTKAYTNLDKEKSHIVNTAWAMLALMKAGQAERDPTPLHKAARLIMSMQLSNGDFPQEEMIGSFLKNGPLCYMAYRNIFPIWALGEYQKLVLQCDLQWPTF

SEQ ID NO: 3151 - protein, 509 aa, GIBBERELLA ZEAE PH-1
MTFPSDIHTFHSGRPQPESSSKSNTFVSVDPSNAKPLATIYTTTSEQLNQTVAAAQAAFPAWSQTPAPRRAAILLKAASILRERNDELALTETLDTGKPWSETSTVDVVTGADVLEYYAHMAAGSFPGQNTRLRPDAFVLTTHEPLGVCAGIGAWNYPIQIALWKSAPCLAAGNCMVYKPSEVTPLHAETLAQIYIEAGVPPGVFNVVYGDGIAVGAPLVAHSGIAKVSFTGQVSTGSKVASQAVTDMKGVTMELGGKSPLVILPDADVEDAADTAMVANFFSTGQVCTNGTRVFVPDTLLSQVEEAIVQRCREGIRMGLPRKTETNFGPMVSAAQQEKVKMYIQHGRTVDKAKVLFNGSQEASMPQPTSDGFWVHPVVFTNCTDDMRVTREEIFGPVMCIMPYKTQGRPRQEWLSDLIARANDTPMGLAAGVVSSDVGLAQEVVQKLDAGITWINTWGESPAEMPVGGWKMSGIGLENGHEGISAYMRTKSTLIQLGRGACKGVFSKL

SEQ ID NO: 3152 - protein, 64 aa, Zea mays
GILISPGPGEPQDSGISLQTVLELGPTIPIFGVCMGLQCIGEAFGGKIIRAPSGVMHGKSSPVY

SEQ ID NO: 3153 - protein, 305 aa, Zea mays
  unsure (1)..(305): unsure at all Xaa locations
ITMDPTKFRPSSSHDTTVTTTNAGAPVWNDNEALTVGPRGPILLEDYHLIEKVAHFARERIXPERVVHARGASAKGFFECTXHDVXTSLTCADFLRAPGVRXRPVIVRFLDGDPPSGVPPETIREPARGFPPGKFYXTREGQLGNLLGATNFPRLLQSAKGIKFSPDVIHAFKPNPRSHVQEYWRVFDFLSHLPESLHTLFFLFDDVGVPSDYRHMEGFGVNTYTFVSAAEKATIRKPNDFKQPGERYRSWDADRQDRFVRRFADSLGHPKVSQELRSIWIDLLAKCDASLGMKIATRLNMKPNM

SEQ ID NO: 3154 - protein, 520 aa, Glycine max
MPSFMAFLSHPYFFAALSASLTLLVVQLLFRKLNKRHSRKKYHPVAGTIFNQMLNFNRLHHYMTDLAAKHRTYRLLNPFRYEVYTTEPTNVEYILKTNFENYGKGLYNYHNLKDLLGDGIFTVDGEKWREQRKISSHEFSTKMLRDFSISIFRKNVVKLVNIVSEAATSNSTLEIQDLLMKSTLDSIFQVAFGTELDSMCGSSQEGKIFADAFDTSSALTLYRYVDVFWKIKKFLNIGSEAKLRKTTEILNEFVFKLINTRILQMQISKGDSGSKRGDILSRFLQVKEYDPTYLRDIILNFVIAGKDTTAATLSWFMYMLCKYPEVQEKAAEEVKEATNTKRISSYNEFVYSVTDEALERMNYLHAAITETLRLYPAVPVDAKICFSDDTLPDGYSVNKGDMVSYQPYAMGRMKFIWGDDAEDFRPERWLDENGIFKPESPFKFTAFQVNNNMKCTTCTGPRVCLRVRFAYRQMKIFAAVLLGCFRFKLKDEKKNVTYKTMINLHIDEGLEIKAFNRYRD

SEQ ID NO: 3155 - protein, 257 aa, Triticum aestivum
APVPRRPSPPFSSAGRSTAASSPIWTWGHSHGSAAPIAAHTSPPPPSTGRPAPPPPQDPPPHPSPPDPDARALAPAALALTPATRCASAACGSGAPRNRNLPGKSFSRKDPDAEVIALSPRALMATNRYVCEICGKGFQRDQNLQLHRRGHNLPWKLKQRNPNEVVRKKVYVCPEPGCVHHDRSRALGDLTGIKKHFSRKHGEKKWKCDKCAKRYAVQSDWKAHSKVCGTREYRCDCGTLFSRRDSFITHRAFCDAL

SEQ ID NO: 3156 - protein, 477 aa, Gracilaria gracilis
KNERYESGVIPYAKMGYWDPDYVVKDTDVLALFRVTPQPGVDPVEASAAVAGESSTATWTVVWTDLLTACDLYRAKAYKVDAVPNAPDQYFAFISYDIDLFEEGSIANLTASIIGNVFGFKAVKALRLEDMRIPVAYLKTFQGPATGLVVERERMVKFGRPFLGATGKPKLGLSGKNYGRVVYEGLKGGLDFLKDDENINSQPFMRWKERFLYSMEGVNRAIAASGEVKGHYMNVTAATMEDMYERAEFAKQLGSVIIMIDLVIGYTAIQTMAIWARKNDMILHLHRAGNSTYSRQKSHGMNFRVICKWMRMSGVDHIHAGTVVGKLEGDPLMIRGFYNTLLQTHLKVNLPQGIFFEQDWASLRKVTPVASGGIHCGQMHQLLDYLGNDVVLQFGGGTIGHPDGIQAGATANRVALESMVLARNESRDYVAEGPQILRDAAKTCGPLQTALDLWKDITFNYTSTDTADFVETPTANV

SEQ ID NO: 3157 - protein, 242 aa, Nicotiana tabacum
MGRGKVQLRRIENKINRQVTFSKRRGGLVKKAHEISVLCDAEVALIVFSHKGKIFEYSSDSCMEQILERYERYSYTERRLLASNSESSVQENWSLEYAKLKAKIDLLQRNHKHYMGEDLDSLNLKDLQNLEQQLDTSLKLIRSRKNQLMHESISMLQKKEKAIQEENNMLSKKIKEKDNTVGQQVEWHQQNQVPTSTSFLLQPHPCLNIGGNYQEEAEEARRNELDLNLDSLYPCHMGCFAT

SEQ ID NO: 3158 - protein, 126 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGE

SEQ ID NO: 3159 - protein, 422 aa, Oryza sativa
MQHQQRMKQAAAAAQQQQMMQQALLMQHPHHPHPGLLAAPQIEPIVSGNLPPGFDSSTCRSVYVGNIHLQVTDSLLHEVFQSIGPVEGCKLIMKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVTSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 3160 - protein, 499 aa, Aspergillus oryzae
MMVAWWSLFLYGLQVAAPALAATPADWRSQSIYFLLTDRFARTDGSTTATCNTADRKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCLIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 3161 - protein, 375 aa, Lycopersicon esculentum
MACCFPVILDRSMRSSFKLSKSSSSSKLDKSKSSICSPTSLSTKKKSIQENDNLVVCFGELLIDFVPTVSGVSLAEAPGFKKAPGGAPANVAVGIARLGGSSAFIGKVGADEFGYMLADILKQNNVDNSGMRFDTHARTALAFVTLKSDGEREFMFFRNPSADMLLTEAELDKNLIQKARIFHYGSISLIAEPCRSAHLAAMETAKNAGCILSYDPNLRLPLWPSEEAAREGILSIWDQADIIKVSEDEITFLTNGEDAYDDNVVMTKLFHSNLKLLLVTEGGDGCRYYTNNFHGRVSGVKVAAVDTTGAGDAFVGGLLNSMASDPDIYMDEKKLRDALLFANGCGAITVTEKGAIPALPTKEAVLKILDGATAN

SEQ ID NO: 3162 - protein, 277 aa, Glycine max
FKSKNFRSPDAEKGITLAPFLSKFSSIKIVGMDGYVPIIDYKQIEKTTNNFQESNILGEGGFGRVYKACLDHNLDVAVKKLHCETQHAEREFENEVNMLSKIQHPNIISLLGCSMDGYTRLVVYELMHNGSLEAQLHGPSHGSALTWHMRMKIALDTARGLEYLHEHCHPAVIHRDMKSSNILLDANFNAKLSDFGLALTDGSQSKKNIKLSGTLGYVAPEYLLDGKLSDKSDVYAFGVVLLELLLGRMQIEKLVPALSQSIVTLAMLYLTQLSKFT

SEQ ID NO: 3163 - protein, 196 aa, Zea mays
  unsure (1)..(196): unsure at all Xaa locations
SHRQPWIHTSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRXIVDFFSHHPEXLHMFTXLXFDDXGIP

SEQ ID NO: 3164 - protein, 91 aa, Brassica oleracea
  unsure (1)..(91): unsure at all Xaa locations
LQVXATTSQLXLRHHNFHLGNNYGCSTGADYXYNGSMMDISVVPEPSESDTTVQHPREPKETKDQLSGPPTQQLTPAERAARVLRYREKKK

SEQ ID NO: 3165 - protein, 488 aa, Colpomenia peregrina
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAAATCGPLKAALDLWKDITFDYTSTDTPDFVEVATGSR

SEQ ID NO: 3166 - protein, 666 aa, Streptococcus agalactiae 2603V/R
MQHVNHSSFDKASKAGFIIALGIVYGDIGTSPLYTMQSLVENQGGISSVTESFILGSISLIIWTLTLITTIKYVLVALKADNHHEGGIFSLYTLVRKMTPWLIVPAVIGGATLLSDGALTPAVTVTSAVEGLKVVPSLQHIFQNQSNVIFATLFILLLLFAIQRFGTGVIGKLFGPIMFIWFAFLGISGLLNSFAHPEVFKAINPYYGLKLLFSPENHKGIFILGSIFLATTGAEALYSDLGHVGRGNIHVSWPFVKVAIILSYCGQGAWILANKNAGNELNPFFASIPSQFTMHVVILATLAAIIASQALISGSFTLVSEAMRLKIFPQFRSTYPGDNIGQTYIPVINWFLFAITTSIVLLFKTSAHMEAAYGLAITITMLMTTILLSFFLIQKGVKRGLVLLMMIFFGILEGIFFLASAVKFMHGGYVVVIIAVAIIFIMTIWYKGSKIVSRYVKLLDLKDYIGQLDKLRHDHRYPIYHTNVVYLTNRMEEDMIDKSIMYSILDKRPKKAQVYWFVNIKVTDEPYTAEYKVDMMGTDFIVKVELYLGFKMRQTVSRYLRTIVEELLESGRLPKQGKTYSVRPDSNVGDFRFIVLDERFSSSQNLKPGERFVMLMKSSIKHWTATPIRWFGLQFSEVTTEVVPLIFTANRGLPIKEKSELTTTGD

SEQ ID NO: 3167 - protein, 408 aa, Coix lacryma-jobi
MEHVISMEEILGPFWDLPPSPPPLPLPEQQPLVTDTGSVVIDGVVTQGGGDGEGGDMMGQNTTEWTFERLLEEEILINKTTLVTNSSCSTLNIDPVVEVDQGTMASGAVSAVGDPMEYNAILKRKLEVDLVAFKMWRASSVVNSERSQDSNNHNGGSKNVVQNKLNGEDPINNHAQNVDLRVRLATSSSSRDPSPSDEDMDGEVEILGFKMPTEERVRKRKESNRESARRSRYRKAAHLKELEDQVEQLKAENSCLLRRLAALNQKYNEANVDNRVLRADMETLRAKVKMGEDSLKRVMEMSSLPPSMPIPALPSSSDASVPIQDDIINYFSTTPAADEDAPVDNNSFIIMPMADPLQLVQAEDQPTMGAMELIQKTMGAMPTSPGSALQESQLLGLGPDETINMDMY

SEQ ID NO: 3168 - protein, 487 aa, Bacillus anthracis str. A2012
MTVQTAQIVKNYIGGEWVESISTKMEAVYNPATGEVIAQVPLSTKVDVEQAVLAANEAFKSWSKTAVPRRARILFKYQQLLVDNWEELAKLITIENGKSYNEAYGEVLRGIECVEFAAGAPTLMMGKQLPDIATGIESGMYRYPIGVIGGITPFNFPMMVPCWMFPLAIACGNTFVLKPSERTPLLAARLAELAEEAGLPKGVLNIVNGAHDVVNGLLEHKLVKAISFVGSQPVAEYVYKKGTENLKRVQALAGAKNHSIVLNDANLELATKQIISAAFGSAGERCMAASVVTVEEEIADQLVERLVAEANKIVIGNGLDEDVFLGPVIRDNHKERTIGYIDSGVEQGATLVRDGREDTAVKGAGYFVGPTIFDHVTKEMKIWQDEIFAPVLSIVRVKSLDEAIEIANESRFANGACIYTDSGASVRQFRETIESGMLGVNVGVPAPMAFFPFSGWKDSFYGDLHANGTDGVEFYTRKKMLTSRWEK

SEQ ID NO: 3169 - protein, 360 aa, Zea mays
MEDLSDLGGHGHPGAAAWRPAAPSLASSSKVSVQVYTVPSSAATGREARGQGVAPMMHASSVAGHGGRAADLDPVKAKIVSHPSYHRLLAAFLDCHKVGCPPEAAEEIAAVAREREAWQRAAAGDVAHTRPDPELDQFMESYCELLVTWKEELTRPLREAEEFLTTVEAQLNSITNTGPTMGAFISSAAAADKTGVVDMSDDEQEEGSGMEAEVALGIDPCSDDKELKKQLLRKYSGCLGNLRKELCKKRKKDKLPKEARQKLLSWWELHYRWPYPSEMEKIALAESTGLEQKQINNWFINQRKRHWKPSEEMQFAVMDGFHPAPPNAAAFYVDARLVGATPAMFYARPDHGAHHGLWHN

SEQ ID NO: 3170 - protein, 436 aa, Haemophilus somnus 129PT
MSIYTYICFLSTISILIGFVTQKISDRIQYTIAITATATVGSLILLIAGSTNLFHLDDIAQNVMQRIDFKDFLLNGILGFLLFAGALGIKLPVLKSQKLEITILALFSTIASTLFIGVLFYGISALLRLHIDFIYCILFGALISPTDPIAVLAIIKNLKAPKKLSMKVEGESLFNDGVGLVIFTTIFTVAFGGHEPTAMEITKLFLAEAVGGIFFGLILGVIAHFLISATDDGSLEILLTLTIPTAGFMLANLLHVSGALAMVVAGIMISNWTRHSGFSEQSQHYLDHFWEMIDHFLNSLLFLLIGSAMLLVNFTSQAIILSLIAIPVCLFCRYASVWIPFKFLSMKTVYNPYTLRILTWGGLRGGLSLAMALSIPATSAFLENIGMNVRDLFIIITYSVVLFSILIQGTTIETMIRKSKEATLQKRGYIGLKNQT

SEQ ID NO: 3171 - protein, 603 aa, Oryza sativa
METHIGSVDGAAAAADNGAVGCPASAVGCPMTSARPGVSARRGVAGTAPGEAAGAGGRQRRVRVPGDFNLTLLDHLIAEPGLLVGCCNELNAGYAADGYARSRGVGACAVTFTVGGLSVLNAIAGAYSENLPVICIAGGPNSNDYGTNRILHHTIGLPDFSQELRCFQTVTCTQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYPYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVLRASAGEEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKKDCLCFIEVIAHKDDTSKELLEWGSRVSAANSRPPNPQ

SEQ ID NO: 3172 - protein, 256 aa, Pantoea endophytica
  unsure (1)..(256): unsure at all Xaa locations
GAAGGIGQALALLLKTQLPSGSELSLYDIAPVTPGVAVDLSHIPTAVKIKGFXGEDARPALQGADVVLISAGVARKPGMDRSDLFNVNAGIVKNLVQQIAEVCPKACIGIITNPVNTTXXIAAEVLKKAGVYDKNKLFGVTTLDIIRSNTFVAELKGKQPTEVEVPVIGGHSGVTILPLLSQIPGVSFTEQEVADLTKRIQNAGTEVVEAKAGGGSATLSMGQAAARFGLSLVRALQGXKGVVECAYVEGDGQYAR

SEQ ID NO: 3173 - protein, 507 aa, Lolium rigidum
MNLEVAFLHEYASPRALVVAVVLVLVAVHLARSTSRAERLRRKLPCPRFTLPVIGHLHLIGSLPHVGLRDLARKHGPDVMLLRLGAVPTLIVSSPSAARAVLRTHDHVFASRPDTVVGDILFVGSTNVGHSPYGEYWRQVRKIITTHVLTAKKIRANLPYREQEARLALASVREAAAAGTAVDLTHLFSHFAHDMVSQAVAGRIHREDRWGKLFHDLFVGNGQLLGGFNLDDCFPSLARLGIGSANIAKQRKRWDDLLDEVIDRHTSTPMEKGDEPDFIDVMLSVQDEYKLTRNNIKSILMDMFQAGTDTTFIWLDYAMAELARAPQVMAKLQAEVRRCSTTNQLLTQEDLSSMSYLKAVMKETMRLHPPGPLLLPHASIADCEVEGYVVPAGTRVIINVWAIGRHASSWERAEEFVPERFLEGSVDANSDFYGNDFRLLPFGSGRRMCPGINFATLTFEIILANLIYHFDWELPEGSPGVDMTEAFGMDVHRKENLLLVPRVAKIV

SEQ ID NO: 3174 - protein, 492 aa, Secale cereale
MDPCKFRPSSSFDTKTTTTNPGQPVWNDNEALTVGPRGPILLEDYHLLEKIAHFARDIPEPFVHAGRASAKGFFECTHDVTGLTCADFLPSPGAGTPVIVRFSTVIHERGSPETIRDPRGFAVKFYTREGNWDLLGNNFPVFFIRDGIKFPDVIHAFKPNPKSHVQEYWRVFDFLPHHPESLHTFFFLFDDVGIPTDYRHMDGFGVNTYTFVTRAGKSHYIKFHWRPTCGVSCLMDDEATLVGGKNHSHATQDLYDSIDAGNFPEWKLFVQVIDPEQQDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKKNHYDGAMNFMHRDEEVDYYPSRHAPLRHAEPASFPVPTRPVVGKREKTRIKKENDFVQPGERYRSWAPDRQDRFVALRRRLAHPKVSHELRVIWIDFLSKCDKSCGMKVANRLNVKPSM

SEQ ID NO: 3175 - protein, 115 aa, Glycine max
  unsure (1)..(115): unsure at all Xaa locations
MGQRYENNVFKSHISNIEAAPGMTQTVHLPPPLQTDPTIRGKQNGKPKGSRNAKSAAHRPYADSTNSTAVNNCRSDSSLXLLTKKFASLIHDAKDGTLDLNRTAEILEVQKKRIY

SEQ ID NO: 3176 - protein, 610 aa, Zea mays
METLLAGNPANGVAKPTCNGVGALPVANSHAIIATPAAAAATLAPAGATLGRHLARRLVQIGASDVFAVPGDFNLTLLDYLIAEPGLTLVGCCNELNAGYAADGYARSRGVGACAVTFTVGGLSVLNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKANLEYAVEAAADFLNKAVKPVMVGGPKIRVAKAREAFAAVADASGYPFAVMPAAKGLVPEHHPRFIGTYWGAVSTTFCAEIVESADAYLFAGPIFNDYSSVGYSLLLKREKAVIVQPDRMVVGDGPAFGCILMPEFLRALAKRLRRNTTAYDNYRRIFVPDREPPNGKPNEPLRVNVLFKHIKGMLSGDSAVVAETGDSWFNCQKLRLPEGCGYEFQMQYGSIGWSVGATLGYAQAAKDKRVIACIGDGSFQVTAQDVSTMLRCGQKSIIFLINNGGYTIEVEIHDGPYNVIKNWDYTGLVNAIHNSEGNCWTMKVRTEEQLKEAIATVTGAKKDCLCFIEVIVHKDDTSKELLEWGSRVSAANSRPPNPQ

SEQ ID NO: 3177 - protein, 127 aa, Triticum aestivum
AGRAGFERDYWLGRMGMYDQYQDWRLDVDNMNYEELLALEDRIGYVSTGLREDEIVRGLRVGKHLPFDRKHFLTETERSCSICQEEFEASEEIGRLSCGHGYHVHCIKQWLSRKNACPLCKTAVSKP

SEQ ID NO: 3178 - protein, 288 aa, Zea mays
MRTKKEELKVEEENETSLEGRGIINVDPAPRRSFMSVLVGVHTMPGKHSRAPPHPHGGTRLQQQTPALRAAARVDVRFVLCARPMPPEAPRVRCARGARLRRRAWSSTAPRTRRRGRRTRTSRACPPCSAPAPVAAAGRTTYVMKVDDDTFLQLDALADTLRSAPREDMYCGVGLPFHDRQFPPFMLGMGYLLSWDLVEWIATSDMVRREAMGVEDLTTGKWLNMGHKAKNRVNIFPRMYDYKSAKGEDFLENTIGVHQLKQDLRWAHTLEHFNVTRLEPSNMLLHNF

SEQ ID NO: 3179 - protein, 74 aa, Glycine max
  unsure (1)..(74): unsure at all Xaa locations
ASSMISSPAVTTVNRAGGRMXAXFTGLQSMAWLPTRXTHHDITFIASNGGRGPCLPGWXPPFGRRKFRTFSTLP

SEQ ID NO: 3180 - protein, 597 aa, Oryza sativa (japonica cultivar-group)
MDTTIGSVPTASDAAAPAPAANSAPREATLGRHLARRLAEVGARDVFTVPGDFNLTLLDELEAEAGAGHGGVRLVGCCNELNAAYAADGYARARGGGVGACAVTFTVGGLSAINAVAGAFSENLPVVCIVGGPNSNDYGSNRILHHTIGLPDFTQELRCFQTVTCYQAVVNNLEDAHEQIDAAISTAIKESKPVYISISCNLPSIPHPTFSRHPVPFFLSPRLSNQMNLEAAVETAAAFLNKAVKPVLVGGPKMRVAKACKSFVELADACGYPVAVMPSAKGLVPEHHPRFIGTYWGAVSTPFCAEIVESADAYLFAGPIFNDYSSVGYSLLLKKEKAIIVQPDRVVIGHGPAFGCVLMKDFLHALSARLKKNTAAYENYRRIYVPPGEPPLSEPGEPLRVNVLFQHIQKMLSANSAVIAETGDSWFNCQKLKLPEGCGYEFQMQYGSIGWSVGATLGYAKAAKDKRVIACIGDGSFQVTAQEVSTMLRWGQKSIIFLINNGGYTIEVEIHDGPYNVIKNWNYTGVVEAFHNGEGKCYTAKVRTEEELKEAIEEAQGPKKDCLCFIEVIVHKDDTSKELLEWGSRVSAANSRPPNPQ

SEQ ID NO: 3181 - protein, 264 aa, Zea mays
TRPTKLRPGIWNFLQKASNLFELHLYTMGNKLYATEMAKVLDPTGTLFAGRVISRGDDGDPFDSDERVPKSKDLDGVLGMESAVVIIDDSVRVWPHNRHNLIVVERYTYFPCSRRQFGLPGPSLLEIDRDERPEDGTLASSLAVIERIHHNFFSHPNLNEADVRSILASEQRRILTGCRIVFSRVFPVGDASPHLHPLWQTAEQFGAVCTNLVDDRVTHIVANSPGTDKVNWALSKGKFVVHPGWVEASALLYRRANEHDFAVK

SEQ ID NO: 3182 - protein, 575 aa, Podospora anserina
MAIDIRTQGLKKPVPVAQYLFARLYEIGIRSVHGLPGDFNLVALDYIPKAKLKWVGSVNELNAAYAADGYARALGISALVTTFGVGELSAMNGVAGAYSEHVPVVHIVGCPSTISQRNGMLLHHTLGNGDFNVFANMGSQIACNTARLNNPAEIAEQIDFALRECWIHSRPVYIMLPTDMVEKQIEGARLDTPIDLSDPPNEPEREDYVVDVVLRYLHAAKNPIILVDACAIRHRCLEEVRNLVDKAKLPVFVTPMGKGAVNESSPTYGGVYAGTGSQPAVQELVESADLVLSIGALKSDFNTTGFSYRTSQLNTIDFHSDHCKVRYSEYPGVAMKGVLRKLIERVDTTKLSSEKLAPKVVNEVSENRDSTETITQAWFWPRVGEYFKEKDLVVTETGTSNFGIWESKFPPDVVGITQILWGSIGWSVGAAQGVAQAVKDMGEDRRTILFVGDGSFQLTVQEVSTMIKHKLRVTIFLIYNEGFTIERCIHGMEAEYNDIRRWNYTEIPTVFGATDKEVRKHIIKTKSELEKLLADKDFNDAKGLQLVELWMPKHDAPRALKLTAEQSAKNNARME

SEQ ID NO: 3183 - protein, 439 aa, Agardhiella ramosissima
PGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVSERERMDKFGRPFLGATVKPKLGLSGKNYGRVVYEGLRGGLDFLKDDENINSQPFMRWKERFLYAMEGVNRSIAATGEVKGHYLNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 3184 - protein, 419 aa, Prionitis ramosissima
DTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAMVMARNEGRDYVAEGPQILQDAAKTW

SEQ ID NO: 3185 - protein, 364 aa, Xanthobacter flavus
MLEPNADHRAAVAQAAGVAASRITLTVMLDEWAGADARRRAVADTVCALATGCASLAAAIAEGPLAGDLARTLSSGEAGEGQKALDVISNDIVIGALKAAPVAAVASEENDAPVLLDPTAPLLVAIDPLDGSSNIDTDISVGTIFAVFPRPEGADASEPSAFLQNGRDMLAAGYVIYGPHTAMMLTLGAGTWHFALDRAGLFRLVDAEVKVKEGAAEFAINMSNYHHWDVPVRDYVDDCLAGKKGPRERDFNMRWVASMVADAHRIFQRGGIYLYPGDGRKGYTHGRLRLLYEAFPVAFLMEQASGSATDGRGAILDLSATGLHQRVPFIFGSRDEVARVSRYHLEPNGHGERSPLFARRGLFI

SEQ ID NO: 3186 - protein, 870 aa, Ostreococcus tauri
MDRIGSPFAQSTTTVLDRPRQYVDDAEMGADHLAHKELLWKLSSTYLPNDVGSLQRSLVRHVEYTLARRRYKLDDNTFYQATAHSVRDRLIERWTDTQQYSAKVGAKKVYYLSLEFLIGRSLGNAVSNLGLRGAYAEALRQIGYNLEDIMSEEKEPALGNGGLGRLASCFLDTLATQNYPAWGYGIRYKYGMFEQRILNGQQVEFPDYWLTDGNPWEVERLDVQYPVRLFGHVREFKDQEGNTRYAWQGGEVVMAQAYDTPIPGYGTYNTNNMRLWSSKPSHEFDLASFNAGNYYGAVEAKERCESITSVLYPNDATDEGKRLRLKQQYFFVSATLQDIFRRFKKSVGRTATTKIQDMPKKVAIQLNDTHPAIAIPELMRLLLDVEYLSWEEAWEISRNVFAYTNHTILPEAMEKWSVPMITELLPRHMQIIYEINHRFLLEVQKLWPNDDTRLSAMSIIEESTPKMVRMSNLAVIGSHTVNGVAMIHTKLLKSTLFPDFLLMWPEKFINVTNGVTPRRWLLQANPALSSIYTGMVGPGWVNDLKRLEPIKTMAQDALFRQRWRAAKQTNKNAVVDWLYKTMGIQVNPNALFDMQVKRIHEYKRQLLNVLGIVHRYAEITQATPEQRNQMVPRVCIMAGKAAPGYVMAKNLIMLVCAVSEVVNADAACRDLLKVIFIPNFNVSLAELLIPASDVSQHISTAGLEASGTGNMKFVMNGGLIVGTMDGANIEIAQAIGEHNMFTFGAKASEVAAIRRTMSHHPPKIDPRLQRATQMIRSGVFGKPKDGEYHQLLDAIDPHKDVYLTAQDFPSYLRAMDEADAQFQLEEKWTAKCIESACSMWMFSSDRTIREYAAKIWNVEPLPFRPPKHQN

SEQ ID NO: 3187 - protein, 891 aa, Saccharomyces cerevisiae
MITEEPTSPHQIPRLTRRLTGFLPQEIKSIDTMIPLKSRALWNKHQVKKFNKAEDFQDRFIDHVETTLARSLYNCDDMAAYEAASMSIRDNLVIDWNKTQQKFTTRDPKRVYYLSLEFLMGRALDNALINMKIEDPEDPAASKGKPREMIKGALDEGGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDFAKFNNGDYKNSVPQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPRRLFGHLLPRHLEIIYDINWFFLQDVAKKFPKDVDLLSRISIIEENSPERQIRMAFLAIVGSHKVNGVVELHSELIKTTIFKDFIKFYGPSKFVNVTNGITPRRWLKQANPSLAKLISETLNDPTEEYLLDMAKLTQLEKYVEDKEFLKKWNQVKLNNKIRLVDLIKKENDGVDIINREYLDDTLFDMQVKRIHEYKRQQLNVFGIIYRYLAMKNMLKNGASIEEVAKKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSLANVGFFSSDRCIEEYSDTIWNVEPVT

SEQ ID NO: 3188 - protein, 237 aa, Oryza sativa (japonica cultivar-group)
MACLVDEGHATSFLCPLVKASERGCLQVVQWFVNRHVSDIEMCLAVTTAASCGHFAVATYLLAHIPRHVLEALSPQILKAARGQGSGSFEGVSFLLRSNFLNDAAATYAVADSIATTSTMDIPQDLVDFLKEQWSQAAFAEGVEAGEDHFVNITRVLRRGASPIRLHDLPEPMALAIAYLPLYRACASARGQLLPQRLRGELVEAVGRLGVPVNMENNRRDFLAVLEHYFPSFITGA

SEQ ID NO: 3189 - protein, 523 aa, Yarrowia lipolytica
MIILYVLAVAVSFLIFKRVTYTMRSRELAKKWHCEEPHNLNEFPLNLPLFFLIINASRRHELLDTLLGLFRSFAPTKTVKQVLLGSFTIIPTNDPENIKAVLATQFKDFCLGQRHGQLAPVLGDGIFTLDGQGWQHSRAMLRPQFARDQVSDVEMIERHVQMMLLRIPNNKKFDIQELFFNLTLDTATEFLFGQTVGSQTVEMPNEDKSTVSDMPKDMRKSFQEDFNVAQHHGGIRTRFQMFYWLWRPTELFSSSKRVHAFVDHYVEKALANSDEEKSDDKYIFLRELAREVKDPRVLRDQALNILLAGRDTTAGVLSWIVYELARHPEVWKKLRAEIHQDFGDGSDLSQITFEGLKRCEYLRFVINETLRLYPSVPLNVRYASRDTTLPRGGGPDESKPILVRKGDTIVYNVFSMHRTEEFWGKDCDEFRPERWAEKGSRGWEYLPFNGGPRICLGQQYALTETSYVITRICQLFTNIENADTAVEPPQKLHALTLCHLNGVFVKMTRDEAAFAETEKLINA

SEQ ID NO: 3190 - protein, 313 aa, Nostoc sp. PCC 7120
MMSRPIILGIVGDSAAGKTTLTRGIAQVLGPENVTLICTDDYHRYDRQQRAEIGITALHPDCNHLDIMQQHLSLLRTGQPILKPVYSHKTGSFEPPQYIKPNKFVIIEGLLGYSTRAARDCYDVKVYLAPPENLRAKWKVKRDTQKRGYTPEQVLAELEKREPDSEQFIRPQRQWSDIVVSFYPPHEDGDETNGHLNVRLVLRPTIPHPDFTSIINLTNGSSVSAIRLGLDRDMSKPVDVLEVDGHATLEQVNKLEHILCSDMPYLSSVCDRESNPELGKIAGTTGETLQSYPLALTQLIITYHMLKATQIYQ

SEQ ID NO: 3191 - protein, 686 aa, Geobacillus stearothermophilus
SSSASVKGDVIYQIIIDRFYDGDTTNNNPAKSYGLYDPTKSKWKMYWGGDLEGVRQKLPYLKQLGVTTIWLSPVLDNLDTLAGTDNTGYHGYWTRDFKQIEEHFGNWTTFDTLVNDAHQNGIKVIVDFVPNHSTPFKANDSTFAEGGALYNNGTYMGNYFDDATKGYFHHNGDISNWDDRYEAQWKNFTDPAGFSLADLSQENGTIAQYLTDAAVQLVAHGADGLRIDAVKHFNSGFSKSLADKLYQKKDIFLVGEWYGDDPGTANHLEKVRYANNSGVNVLDFDLNTVIRNVFGTFTQTMYDLNNMVNQTGNEYKYKENLITFIDNHDMSRFLSVNSNKANLHQALAFILTSRGTPSIYYGTEQYMAGGNDPYNRGMMPAFDTTTTAFKEVSTLAGLRRNNAAIQYGTTTQRWINNDVYIYERKFFNDVVLVAINRNTQSSYSISGLQTALPNGSYADYLSGLLGGNGISVSNGSVASFTLAPGAVSVWQYSTSASAPQIGSVAPNMGIPGNVVTIDGKGFGTTQGTVTFGGVTATVKSWTSNRIEVYVPNMAAGLTDVKVTAGGVSSNLYSYNILSGTQTSVVFTVKSAPPTNLGDKIYLTGNIPELGNWSTDTSGAVNNAQGPLLAPNYPDWFYVFSVPAGKTIQFKFFIKRADGTIQWENGSNHVATTPTGATGNITVTWQN

SEQ ID NO: 3192 - protein, 985 aa, Oryza sativa
MTRVIHDSGEGMQKEALAMVSSDVNFPKGHFPDYKIGPNNQIIDPEEIHEAVPLKEIVAKETAQLLEQRRRLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAELAGAAVAAALDGGEEGSRAARLHSFFASVISGIFGQGEEEEEGEMATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 3193 - protein, 514 aa, Vicia sativa
MFQFHLEVLLPYLLPLLLLILPTTIFFLTKPNNKVSSTSTNNNIITLPKSYPLIGSYLSFRKNLHRRIQWLSDIVQISPSATFQLDGTLGKRQIITGNPSTVQHILKNQFSNYQKGTTFTNTLSDFLGTGIFNTNGPNWKFQRQVASHEFNTKSIRNFVEHIVDTELTNRLIPILTSSTQTNNILDFQDILQRFTFDNICNIAFGYDPEYLTPSTNRSKFAEAYEDATEISSKRFRLPLPIIWKIKKYFNIGSEKRLKEAVTEVRSFAKKLVREKKRELEEKSSLETEDMLSRFLSSGHSDEDFVADIVISFILAGKDTTSAALTWFFWLLWKNPRVEEEIVNELSKKSELMVYDEVKEMVYTHAALSESMRLYPPVPMDSKEAVNDDVLPDGWVVKKGTIVTYHVYAMGRMKSLWGDDWAEFRPERWLEKDEVNGKWVFVGRDSYSYPVFQAGPRVCLGKEMAFMQMKRIVAGIVGKFKVVPEAHLAQEPGFISFLSSQMEGGFPVTIQKRDS

SEQ ID NO: 3194 - protein, 483 aa, Bacillus subtilis subsp. subtilis str. 168
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEGEGVWIKYHFKTEQGVKNLDVNTAAKIAGENPDYHTEDLFNAIENGDYPAWKLYVQIMPLEDANTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFGDNGGGSVYYEPNSFGGPKESPEDKQAAYPVQGIADSVSYDHYDHYTQAGDLYRLMSEDERTRLVENIVNAMKPVEKEEIKLRQIEHFYKADPEYGKRVAEGLGLPIKKDS

SEQ ID NO: 3195 - protein, 95 aa, Brassica oleracea var. gongylodes
MGRGRVEMKRIESKINRQVTFSKRRAGLLKKAHEISILCDAEVSLIVFSHKGKLFEYSSESCMEKVLEHYERYSYAEKQLKVPDSHVNAQTNWSV

SEQ ID NO: 3196 - protein, 450 aa, Triticum aestivum
MGQGSPGGMGKQGGLPGDRKPGDGAAGDKKDKKFEPPAAPSRVGRKQRKQRGPEAAARLPPVAPLSKCRLRLLKLDRVKDYLLMEEEFVASQERLRPSEDKTEEDRSKVDDLRGTPMSVGSLEEIIDESHAIVSSSVGPEYYVSVLSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTAKMTLAEDVNLEEFVMTKDEFSGADIKAICTEAGLLALRERRMKVTHADFKKAKEKVMFKKKEGVPEGLYM

SEQ ID NO: 3197 - protein, 375 aa, Chlamydomonas reinhardtii
MAFTMRAPAPRATAQSRVTANRARRSLVVRADKDKTVVIGLAADSGCGKSTFMRRMTSIFGGVPKPPAGGNPDSNTLISDMTTVICLDDYHCLDRNGRKVKGVTALAPEAQNFDLMYNQVKALKEGKSVDKPIYNHVSGLIDAPEKIESPPILVIEGLHPFYDKRVAELLDFKIYLDISDDIKFAWKIQRDMAERGHSLESIKSSIAARKPDFDAYIDPQKKDADMIIQVLPTQLVPDDKGQYLRVRLIMKEGSKMFDPVYLFDEGSTISWIPCGRKLTCSFPGIKMFYGPDTWYGQEVSVLEMDGQFDKLEELIYVESHLSNTSAKFYGEITQQMLKNSGFPGSNNGTGLFQTIVGLKVREVYERIVKKDVVPV

SEQ ID NO: 3198 - protein, 498 aa, Glycine max
  unsure (1)..(498): unsure at all Xaa locations
MDPYKHRPXSAFNSPFWTTNSGAPIWNNNSSLTVGARGPILLEDYHLVEKLANFDRERIPERVVHAXRGASAKGFFEXVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDLGXVPQDYRHMDGFGVNTYTLINKAGKAVYVKFHWKTTSGIKCLLEEEAIKVGGANHSXHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHXNHHEGFMNFIHRDEEVNYFPSRYDPVRHAERFPIPPAIXSGRREKCGIEKENNFKQPGERYRSWAPDRQDRFARRWVDALSDPRXVTHEIRSVWISYWSQADRSLGQKIASXHLSTRPNI

SEQ ID NO: 3199 - protein, 57 aa, Glycine max
PIDVKYECETITHGPNLGDPLVGWRGNNGSTLTSGVIANTEGISWASEDKIQHANYF

SEQ ID NO: 3200 - protein, 256 aa, Silene latifolia
MGRGRVELKRIENKINRQVTFAKRRNGLLKKAYELSVLCDAEVALIIFSNRGKLYEFCSGPSSMLKTLERYQKCSYGAVEVNKPSKELESSYKEYLKLKARYESLQRAHRNLLGEDLGPLNVKELDQLERQLESSLKQIRCIKTQSMLDQLTDLQSKEHALMEANKSLKAELERIMVKDNQVRQSWEGHHEHQNVHYEHQHAHSQHQHAHSQGLFQPIDCNPNLHLGYNAETSDHQLTAGTSHAQVPGFLPGWMQM

SEQ ID NO: 3201 - protein, 331 aa, Saccharomycetales
VRVAIDGFGRIGRLVMRIALSRPBVZVVASBBPFIBLDYAAYMFKYDSTHGRYAGEVSHDDKHIIVDGKKIATYQERDPANLPWSSGDSVIAIDSTGVFKELDTAQKHIDAGAKKVVITAPSSTAPMFVMGVDSEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVBVSVVBLTVKLDKETTYDEIKKVVKAAAEGKLKGVLGYTZBAVVSSBFLGSBHSSIFBASAGIZLSPKFVKLVSWYBBZYGYSTRVVDLVEHIAKA

SEQ ID NO: 3202 - protein, 388 aa, Streptomyces coelicolor A3(2)
MRTGIWLVGARGSVATTTVVGAAALRAGLVPATGCVSALEAFDGVPLPGFDELVFGGHDVVGTGLVKRAEQLAEAGVVPRGLPGVLTAELDAADAEIRPAPPGTEEGGDGTPDQASAAGAIVADLTGFRERLGLDRVVVVNVSSTQPPAVPHPAHASAAALREALARGERPLPVSSLYAYAALRAGCAFVDFTPSTGARLPALDELAREQGLPYAGSDGKTGETLVKSVLAPMFARRALRVRSWSGTNLLGGGDGATLADPERVVSKNASKGLVLEAELGHAVEGGVHIHHVPDLGEWKTAWDHVTFEGFLGARMTLQFTWQGCDSSLAAPLVLDLARFMALAHRAGVAGPVPELGFFFKDPVGSAEHDLAAQYASLAAWARSVGAPA

SEQ ID NO: 3203 - protein, 293 aa, Vigna angularis
MASSLLILCLVLVSLASSALCAAPRRPVDVPFGRNYIPTWAFDHIKYFNGGSEIQLHLDKYTGTGFQTKGSYLFGHFSMNIKMVPGDSAGTVTAFCLSSQNAEHDEIDFEFLGNRTGQPYILQTNVFTGGKGDREQRIYLWFDPTKAYHRYSVLWNMYQIVFLVDNIPIRVFKNLKELGVKFPFNQPMKVYNSLWNADDWATRGGLEKTDWSKAPFVAEYKGFHVDGCEASVNSRFCATQGKRWWDQTEFRDLDSFQWRRLKWVRQKFTIYNYCTDRTRYPQLPPECRRNRDI

SEQ ID NO: 3204 - protein, 549 aa, Escherichia coli CFT073
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSILEENLERRFRLAALRSERAELYHLRATREISNETLQKLLHDLDLLEALLIEENQ

SEQ ID NO: 3205 - protein, 537 aa, Halobacterium sp. NRC-1
MRRERARILLDALLTLGPTFIKLGQLLSTRPDVLPTEYIEELAELQDRVPPADWAEAQRVIEDELGPVDDVFDAFNRESISGASLGQVYTADVDDQQVAVKVRRPGIESLVEADLRAIRWSIPIVVRFVGQGQAFSLENLADEFAKTIREEMDYSREGRMLTEIRANFADEPDIVIPTVYEEYSSDRVLTMQYIEGTKISDVDTLERRGVDRSQVSETLERAYLQMIIEDGVFHADPHPGNLAVQDDGSIVFYDFGMSGRVDSFIQDKIVEFYVGVANQDIDAILDALIDMGTLSPEADRAVMADVMELAIQDARGENIETYRVQQIVGKVEDTIYEFPLRLPPNLALVLRVATVVEGVCVTLDPEFDFITVATDYLAEQGYREESIRQFAAGTAEEFQAAATSVLRVPPKLERALDKVEREDLYVRADLEDSNRVIDALARRVVLGLVLATSVPTTAFLYVTADVTAAAISGAFTAAVGAALYKTFRRRNGLQASPQFTRQNLRERDGDGDDGGTALARSGSQIEADDAGTATNGD

SEQ ID NO: 3206 - protein, 399 aa, Rickettsia prowazekii
MSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPVFVNCGIENNFKLSVEALEHSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTIIQSQSTSNPCSISQMAAIEALNGTQDYIKSNALNFQKKRDLALSILEEVTYFECYKPEGAFYLFVKCDKIFGTKTKSGRIIANSNNFSEYLLEEAKVAVVPGIAFGLDGYFRISYATSMQELEEACIRIKHACNAL

SEQ ID NO: 3207 - protein, 447 aa, Streptococcus pyogenes MGAS8232
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCVCTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMVGPAGAWMVSIGALISITGLNMGESIMVPRYGAAIADEGLLPAAIAKQNQNGAPLVAILVSGAIAIVLLLTGSFENLAKLSVVFRFFQYIPTALAVMKLRKDAPDANVIFRVPFGPIIPILAVIVSLVMIWGDNPMNFVYGAVGVIIASSVYYLMHGRNHQMDQMPPEEQI

SEQ ID NO: 3208 - protein, 473 aa, ASPERGILLUS NIDULANS FGSC A4
MLLDTTTFHNVINGQLTSTATTRHSLNPATKKENPAVPVSTAKDVDDAVSVAKTAFKSWSRTSYEERRRACLAYADTLEANKEALAALLTQEQGKPLDQAAVEVGMAVTWTRQLPTIEIPENVIQDKEECRIVQRYTPLGVAAAIVPWNFPVLLAVGKIIPAVYTGNTVIVKPSPYTPYCALKLAELAISHFPPGVIQALSGGDDLGPMITEHPGIDKISFTGSTATGKKVMASASKTIKRVTLELGGNDAAIVCDDVDIDKVVPNLAILSFLTSSQICMMIKRLYVHEKIYDKFLQKFVAFVSNFKVGAGTQEGVFIGPVQNEMQYKKAKDLFSSIESEKLCAVLGGTITASDGYYIAPTIIDNPPESSRVVQEEPFAPILPVLKWSDEDDVIARANGTDSALAASVWSVDMERAQRIAGQLAGGSVWINSHFEVSPFAPFGGHKSSGIGVEWGLSGLLGYCNSQTIWMKKA

SEQ ID NO: 3209 - protein, 427 aa, Glycine max
MSLSVPKLARPLPLHHHSSYGSLTMSFHTFTPFLGSTHKLRFISPIKLNAPRFNSSVVSVSDLFKNNKPKSTTNLLITKEEGLQLYEDMVLGRSFEDMCAQMYYRGKMFGFVHLYNGQEAVSTGFINFLKKEDCVVSTYRDHVHALSKGVPARAVMSELFGKATGCSRGQGGSMHMFSKEHNLIGGFAFIAEGIPVATGAAFSSKYRREVLKEADCDHVTLAFFGDGTCNNGQFYECLNMAALWKLPIVFVVENNLWAIGMSHLRATSDPQIWKKGPAFGMPGVHVDGMDVLKVREVAKEAIERARRGEGPTLVECETYRFRGHSLADPDELRDPAEKAHYAGRDPISALKKYMIENKLASEQELKTIDKKIEEVVEDAVEFADESPHPPRSQLLENVFADPKGFGIGPDGKYRCEDPKFTEGTAHV

SEQ ID NO: 3210 - protein, 457 aa, Alcaligenes faecalis
MSRFEQIQSREAGLHKRLNARQMSMIAIGGAIGTGLFLGSKFAIGFAGPGVVLSYVIGGFIALVLMGCLAEMTVEHPTSGSFGAYAEFYIHPLAGFLVRYSYWACIVLAVGTEVTAVADYMKFWFPEVSPWIWIVFFSAVLIAVNAYSVKAFGSVEYWFALIKVFAIIAFIVLAIGMLTGYYQPAQVQENLLGQGGFMPNGWYGVWVGVIISIFSYLSIEMIAVAAGEAENPEQAVRQAFKATIWRLIIFYLLSLSLIVMLVPWQVLIADGTSSPFITVMQSVGIPYADSILNFIVIIAALSAMNSMLYISTRMMFSLSRAGDAPLVLGKVARNGVPLNALALSASGVGVAAVVYAYNPETAFPVMIALSMFGALFTWGMIFLTHLFFRRRVAQEGVQLRFRMPAYPIGTLLGLIGIVAILITTWFINIFHYTLLFGVPFLLTLIVIYFVRSKSRVA

SEQ ID NO: 3211 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANKILGNQVKKAVEGLSDDQLKEVVIAYEPIWAIGTGKSSTSEDANEMCAHVRQTLADLSSQE

SEQ ID NO: 3212 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTELFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKERKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGFPKGMDPSQLIMEEKFGLTLQKEPPLYIVPKTRD

SEQ ID NO: 3213 - protein, 617 aa, SYNECHOCOCCUS SP. WH 8102
MTLTSASTVVGGLDANAPQTISGAAALMDALRRHGVDTIFGYPGGAILPIYDALHIAESEGWVKHILVRHEQAGTHAADAYARATGKVGVCFGTSGPGATNLVTGIATAQMDSVPMVVITGQVPRPAIGTDAFQETDIFGITLPIVKHSWVVRDPADLGSIVAQAFLIAASGRPGPVLIDIPKDVGQEQFNYVPVEPGSVIPGGFHQPEPPLDAAVAAALDLIEQAQRPLLYVGGGAISACAHDSLRMLAERYQLPVTTTLMGKGAFDENDALSVGMLGMHGTAYANFAVTECDLLIAVGARFDDRVTGKLDTFAPRARVVHFEIDPAEIGKNRKADVAVLGDLGLSLARMVEISLQRTAEPRTAAWLERINTWKDRYPLTIPPAEGAIYPQEVLLAVRDLAPDAIVTTDVGQHQMWAAQHLRNGPRGWISSAGLGTMGFGMPAAMGAQVAMPDRQVVCIAGDASILMNIQELGTLAAYGLPVKVVIVNNHWQGMVRQWQESFYDERYSASDMLNGMPDFIALARSFGVDGVKITDRELLHRDLAAALQSPTPTMIDVHVRRGENCYPMVPPGKSNAQMVGLPSHPELAMGTTRTCSSCGAITAHEHRFCPQCGASL

SEQ ID NO: 3214 - protein, 458 aa, Pyrus pyrifolia
MATGVIDKLKSHVATLSQISENEKNGFINLVARSVSGEAQHVDWSKIETPTDEVVVPHAGLEPAPKDTAEIKALLDKLVVLKLNGGLGTTMGCTGPKSVIEVRDGLTFLDLIVMQIEHLNDKFGSSVPLLLMNSFNTHDDTQKIVEKYSKANVQIHTFNQSQYPRLVVDDFTPLPSKGQTGKDGWYPPGHGDVFPSLKNSGKLDLLLSQGREYVFISNSDNLGAIVDLKILHHLIKNKNEYIMEVTPKTLADVKGGTLISYEGKVQLLEIAQVPEEHVDEFKSIEKFKIFNTNNLWVNLNAIKRLVDADALKMEIIPNPKEVDGVKVLQLETAAGAAIKFFDNAIGINVPRARFLPVKATSDLLLVKSDLYNVRDGFVIRNKLRRDPQNPIIQLGPEFKKVDDFLSRFKSIPSLLECDGLRVDGDIWFGSGIKLKGNVHCSVSSEEMLNIPDNITLRE

SEQ ID NO: 3215 - protein, 339 aa, Mycobacterium tuberculosis H37Rv
MTVRVGINGFGRIGRNFYRALLAQQEQGTADVEVVAANDITDNSTLAHLLKFDSILGRLPCDVGLEGDDTIVVGRAKIKALAVREGPAALPWGDLGVDVVVESTGLFTNAAKAKGHLDAGAKKVIISAPATDEDITIVLGVNDDKYDGSQNIISNASCTTNCLAPLAKVLDDEFGIVKGLMTTIHAYTQDQNLQDGPHKDLRRARAAALNIVPTSTGAAKAIGLVMPQLKGKLDGYALRVPIPTGSVTDLTVDLSTRASVDEINAAFKAAAEGRLKGILKYYDAPIVSSDIVTDPHSSIFDSGLTKVIDDQAKVVSWYDNEWGYSNRLVDLVTLVGKSL

SEQ ID NO: 3216 - protein, 409 aa, Vibrio parahaemolyticus RIMD 2210633
MELATTVTELRYALDTFFFLISGALVMWMAAGFAMLEAGLVRSKNTTEILTKNFCLYAIACTTYLVIGYNIMYVDNGEGGWLPSFGGLIGTQGEGADHSLESDFFFQVVFVATAMSVVSGAVAERMKLWSFLLFSAVLTAFIYPMEGYWTWGGGFLSEAGFSDFAGSGIVHMAGASAALAGVLLLGARKGKYGKNGEIYPIPGSNMPLATLGTFILWFGWFGFNGGSQLMVSDFENATAVGQIFLNTNAAAAAGSIAALFVCKTTWGKADLTMILNGALAGLVAITADPLSPSPLYAVAIGAVSGALVVFSIIGLDKLKIDDPVGAISVHGVCGFFGLMVVPLSNGEATFGAQLLGAAVIFAWVFGASLVVWAILKATVGIRVTEEEEMEGMDMHDCGVGAYPEFVTVK

SEQ ID NO: 3217 - protein, 531 aa, Schizosaccharomyces pombe
MGFKRGKNFTLVMLIFVSMAGWMFGADTGSIGGVTSMRDFRERYADRYDPITDQYSLSSARQGLLTGMVNVGSLFGCIISSPIADRFGKRLSIIGFCAVYIIGIIVQVTAVPSWVQIMVAKIWTGIGIGALSVLAPGYQSETAPPSIRGTVVVTYQLFVTGGIFIAACINMGTHKLHKTAQWRVSIGINLLWGIITMIGILFLPESPRYLIQVGKDEEAVRVLSESAELFPDSEEVQNEYHRLKSSIDEEFAGGPCSWASIFGKDIRYRTFLGMFVMSLQQLTGNNYFFYYGFSVMQGAGINSPYLSAMILDAVNFGCTFGGMYVLERFGRRNPLIIGGIWQSICFFIYSAVGSRALYHKNGTSNTRAGAVMIVMACLFIFGFAQTWAPAAYVIVGESYPVRYRSKCAAVATASNWLWNFLISFFTPFIQASIGFKYGYVFASCNLTGAIVIFLFAKETKGLTLEEINELYMSVIKPWESGNFKLNYSEQKKVEKEKSRKGGARGESVEYVERASNTDSSPQYSSHEEDYA

SEQ ID NO: 3218 - protein, 330 aa, Triticum aestivum
MEEVFSSNSKSKAGQMAGEAIAGAEKKPRPKPEQKVECPRCKSGNTKFCYYNNYSMSQPRYFCKACRRYWTHGGSLRNVPIGGGCRKPKRSGTSDAHKLGVASSPEPTTVVPPSTCTGMNFANVLPTFMSVGFEIPSSLSLTAFGSSSSSNTAAMMSPGGTTSFLDVLRGGAGGLLDGSLSQNNGYYYGGPAIGSGNGMLMTPPAVSFGIPVPMQQHGDLVVGGNGIGAATASIFQGATSEEGDDGMGGVMGLQWQPQVGNGGGGGGVSGGVHHLGTGNNVTMGNSNIHNNNNNDSGGDDNNGGSSRDCYWINNGGSNPWQSLLNSTSLM

SEQ ID NO: 3219 - protein, 500 aa, Oryza sativa
MAGGFSVSGSGVEFEAKITPIVIISCIMAATGGLMFGYDVGISGGVTSMDDFLREFFPTVLKKKHEDKESNYCKYDNQGLQLFTSSLYLAGLTATFFASYTTRRLGRRLTMLIAGVFFIVGVIFNGAAQNLAMLIAVPLFLSEIAPTRIRGGLNILFQLNVTIGILFANLVNYGTAKIHPWGWRLSLSLAGIPAALLTLGALFVVDTPNSLIERGRLEEGKAVLRKIRGTDNVEPEFNEIVEASRVAQEVKHPFRNLLQRRNRPQLVIAVLLQIFQQFTGINAIMFYAPVLFNTLGFKTDASLYSAVITGAVNVLSTLVSVYSVDRVGRRMLLLEAGVQMFLSQVAIAVVLGIKVTDRSDNLGHGWAIMVVVMVCTFVSSFAWSWGPLGWLIPSETFPLETRSAGQSVTVCVNLLFTFVIAQAFLSMLCHLKYAIFAFFSAWVVVMSLFVLFFLPETKNIPIEEMTERVWKQHWFWKRFMDDADKHHVVPNGGKSNGATV

SEQ ID NO: 3220 - protein, 267 aa, Oryza sativa (japonica cultivar-group)
MDEGGGAGAAAAAAGNAAGAAVHHNARSAEDVFRDFRARRAGIVKALTTDVEKFYRQCDPEKENLCLYGLPNETWDVTLPAEEVPPELPEPALGINFARDGMIEKDWLSLVAVHSDAWLLSVAFYFGARFGFDKEARRRLFTMINGLPTVYEVVTGIAKKQTKVSNGSSKSNKSNPKPSKQSNSNSKPAKPPQPKDEEDSGPEGTEDEDQAYMCGACGETYANGEFWICCDVCEKWFHGKCVRITPAKAEHIKQYKCPGCSSKRSRE

SEQ ID NO: 3221 - protein, 641 aa, Schizosaccharomyces pombe
MKIVDLIDKIPNGNAFYSFEYFPPKTTVGLENLSSRITRMSRNMMPLFSSVTWGTAGSTAEVSIYLAKMLEQHHKIPACLHLTCTNVDKAIIDKALETAKEYGIRNILALRGDPPLNSDHWEGKVSEFEHAVDLVRYIREKYGDYFCIGVAAYPEGHVDSNVPELSKDPLRDIPFLIEKVEAGADFIITQIFYEPEAFIKFENFVRNHSSNALRNIPIIPAIMPIQSYGSLKRMTRLCGCSVPSSLMQRLNAAKPDDEAIKNIGVEHIVDMIKKIMDNVQGRVHGFHFCTLNLERSVALILKNSGLLTKRWKQVESEMEDEKLLRTTRKRLSLDEPAELHNQVVVPSQQPVADKSSNLFVTSKQSSVSGHKDNLTEEAPFSVSEGSGVLGRQANWDDFTNGRFGDPRSPAYGEIDGYGPTLHFPPSEALKLWGYPVDESDITSLFQKHIMSDISAIPWIDEPVEVETKTIAKYLLKLNGNSWWTVGSQPAVNGAPSADPVFGWGPKGGRVFQKAFVECFVNGKDLKDFITKWHDNPQVTYYAGNNKSEFLTNAPKDGASAVTWGVYPGREIIQSTIIAEVSFKAWLSESFQVWGEWANLYSKNTPSRKLLENCINDRWLVTVIHHDFMDKNGLWKVLEIDF

SEQ ID NO: 3222 - protein, 333 aa, Zea mays
  unsure (1)..(333): unsure at all Xaa locations
MASSNSNSSSNPLEAMGAFFSKQVDRRKLVTTEKRALATRLSSSGDTFPGSEHRPADRKRWMAELGADKLRVHQVVWPGTHDSATNKIGVPLVTRPFAQCQSMSVYEQLAMGTRVVDVRVQEERRVCHGILATYPVXVPRGRPGRVLGETESELLILEIRTEFGHEDPPGFDRFLADKLGEHLIPQDEAVFHRTVAELLPRRVICVWKPRKSPPPRPGDPLWSAGYLKDNWIDTDLPETKFESNLKFLGQQPPVADRRFFYRVENTVTPKADNPVLCVWPVTKRIHGYARLFIAEAFAKGLGDKLQVFSTDFIDGDFVDACAGVTKARVDGTA

SEQ ID NO: 3223 - protein, 528 aa, Photobacterium profundum
MFFNLEGLLPEAIESIEEQTERAYQQYQKFDKDMDKHIYLRNIQDTNETLFYRLVENHITEMMPIIYTPTVGAACEDFSNIYRRGRGLFISYPNRDRIEDMLNNASRQNVKVIVVTDGERILGLGDQGIGGMGIPIGKLALYTACGGISPAYTLPVVLDVGTNNPQRLSDPMYMGWRHTRISGQEYDNFVDEFIQAVKRRWPDALIQFEDFAQKNAMPLLERYKNKICCFNDDIQGTAAVTVGSLLAACKAAKSKLSEQRISFLGAGSAGCGIAEAIIAQMVSEGISEAQARSQVFMVDRWGLLIDDMPNLLNFQQALVQKRDTVNEWDLADNNVSLLDVMRNAKPTVLIGVSGVPGLFSEDVIREMHAHCKRPIVFPLSNPTSRVEATPADIINWTDGNALVATGSPFEPVVHNGKTYPIAQCNNSYIFPGIGLGILAVNARRVTDEMLMASSRALAECSPLAINGHGALLPPLEDIQKVSRKIAFAVAKKAIEQGKAPKNSDERILDKIDANFWQSDYRNYKRTSF

SEQ ID NO: 3224 - protein, 366 aa, Triticum aestivum
  unsure (1)..(366): unsure at all Xaa locations
MRHWLCCNGRSGDDDDRHEVEHSKAQGNKIDGKQKSSKPADQPEPDISPPTIDVPELSFEDLKEKTDNFGSSSLIGEGSYGRVYHATMDDGRQAAIKKFDASENEPNDEFLKQVSLVSRLKHENLVEMLGYYVEGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMLGGQQSLVTWATXPRLSEDKVKQCVDPRLKGEYPPKGVAKLGAVAALCVQYEAEFRPNMSIVVKALSPLLQQRAAGSELAPAPGA

SEQ ID NO: 3225 - protein, 572 aa, Schizosaccharomyces pombe
MKDNQQAVQLQQPTTIGHYLAVRLAQAGVKHHFVVPGDYNLGLLDKLQYNNYLEEVNCANELNCAFAAEGYARANGIAACVVTYSVGAFTAFDGIGGAYAEDLPVILISGSPNTNDIGSSHLLHHTLGTHDFSYQYEMAKKITCAAVSIQRPTEAPRLIDYAIKMALLKKKPVYIEVPTNVASQPCAAPGPASLITEPETSNQEYLQMAVDISAKIVNGKQKPVLLAGPKLRSFKAESAFLELANSLNCSVAVMPNAKSFFPESHPNYAGIYWGQASTLGAESIINWSDCIICAGTTFTDYSSNGWTSLPPKANVLHVDVDRVTVSDAEFGGVLLRDFLHELAKKVKANNASVVEYKRIRPESLEIPMENPKAALNRKEIIRQVQNLVNQETTLFVDTGDSWFGGMRITLPEKARFEIEMQWGHIGWSVPSAFGYAIGAPKRNVVVFVGDGSFQETVQEVSQMVRLNLPIIMFLINNRGYTIEVEIHDGPYNRIKNWDYAAIVEAFNAGEGHAKGFRVGNGHELAEAIRQAKENSQGPTLIECNIDQDDCSKELINWGHNVGAANGKPPAKE

SEQ ID NO: 3226 - protein, 147 aa, Glycine max
MQGLRRCSNDVVQLDLSTPTTTTTTTTTTTNNTNSSSFSSSCSLSIDVDESTEARIQRLISEHPVIIFTRSSCCMCHVMKKLLATIGVNPTVIELDDHEIAALPLPDHRTPAVFIGGSSVGGLESLVALHVSGHLVPKLVQVGALWV

SEQ ID NO: 3227 - protein, 429 aa, Azotobacter vinelandii
MAKIVDIKGREVLDSRGNPTVEADVILDNGIIGSACAPSGASTGSREALELRDGDKARYLGKGVLKAVANVNGPIRDLLLGKDPADQKALDRAMIELDGTENKASLGANAILAVSLAAAKAAAKDKGVPLYAHIADLNGTPGVYSMPVPMMNIINGGEHADNNVDIQEFMVQPVGAKSFAEALRMGAEIFHNLKAVLKARGLNTAVGDEGGFAPNLSSNEDALAAIAEAVGKAGYKLGSDVTLALDCASSEFYKDGKYDLAGEGKTFDAAGFADYLAGLTQRYPIISVEDGMDESDWAGWKGLTDKIGAKVQLVGDDLFVTNTKILREGIEKGIANSILIKFNQIGSLSETLEAIQMAKAAGYTAVISHRSGETEDSTIADLAVGTAAGQIKTGSLCRSDRVSKYNQLLRIEEQLGAKAPYRGRAEFRG

SEQ ID NO: 3228 - protein, 331 aa, Eremothecium gossypii
MVKVAINGLGKIGRLVMRIALSRANVEVVAINDPFITVDYAAYMFKYDSTHGKYAGDVQYEGNTLVIDGKKIKVFQERDPAQLPWGEEGIDIAIDSTGVFKELDSAQKHIDAGAKKVVITAPSSTAPMFVMGVNEEKYAGETIVSNASCTTNCLAPLAKVIDEQFGIEEGLMTTVHSLTATQKTVDGPSMKDWRGGRTASGNIIPSSTGAAKAVGKVLPQLNGKLTGMAFRVPTVDVSVVDLTVKLNKETTYDEIKAAIKAASEGKLKGILGYTEDAVVSTDFLGDNNSSIFDASAGIMLSPKFVKLVSWYDNEYGYSTRVVDLVEHVAAN

SEQ ID NO: 3229 - protein, 544 aa, Schizosaccharomyces pombe
MSIFKKSSNTAPSQHEDVEALASDEADLAALGYKQEFKREFSAWTSFCVSFSVLGLLPSFASTMYYTTGYAGTPAMVWGWLIAMVFVQCVANGMAELCSSMPTSGGLYYAAAVLAPKGWGPFAAWLTGWSNYLVQVTGPPSVAYSFAGMILTLVQLHNPNFETQNYQIFLLAVAAMIAQGFISSMPTKVLAVFNTWGTVLNMLFLAIVMITVLAVAGTKTPRGFNSNHKVWNEFDNQTDWSNGMAMLMSFAGVIWTMSGYDSPFHLSEECSNASVAAPRAIVMTSAFGGIVGWLLNLCIAYTIVDVNAAMNDDLGQPFVVYLRQVCNYKTTVALTSLTVICSFMMGQGCMVAASRVTYSYARDGVFPFSKYLAIVDKRTKTPNVCVWMNVVVGILCCLLIFAGEAAINAIFSVGAIAAFVAFTTPIFLRVFFVKEDEFKRGPWHLGKFSKINGYAACAFVLLMVPILCFPQFRGKDNTPDAMNWTCVVFGGPMLMVLIWWFVSARKWFKGPRLTIGVDDAVSEINVLEGVTKSDDDSISTLKKK

SEQ ID NO: 3230 - protein, 381 aa, Streptococcus mutans UA159
MHMKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 3231 - protein, 137 aa, Glycine max
  unsure (1)..(137): unsure at all Xaa locations
SQLRSPPPRYAGGGELQSLXAWFGPEGTVTPLHHDPHHNILAQVLGRKYIRLYPAFIAEDLYPHTETMLSNTSQVDVDNIDLKEFPRVENLEFIDCILEEGDLLYIPPKWWHYVRSLSTSFSVSFXWRAAVQPSGGS

SEQ ID NO: 3232 - protein, 192 aa, Arabidopsis thaliana
MFAVENGLQGDPRLKAISDAIRVIPHFPKTGIMFQDITTLLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQFDELTL

SEQ ID NO: 3233 - protein, 410 aa, Glycine max
CRSNANLKQQVGLAPRPICSFEGNNQRKFVAMASTVPVEQVNNGPLQVTGDSFIREHLRKLAPYQPILPFEVLSARLGRKPEDIVKLDANENPYGPPPEVMEALGSMQFPYVYPDPESRRLRAALAHDSGLEAEYILAGCGADELIDLIMRCVLDPGDKIVDCPPTFTMYEFDAAVNGALVIKVPRRPDFSLNVEQIAEVVKQEKPKCIFLTSPNNPDGRSFDDEVLLKILELPILVILDEAYIEFSAIESRMSWVKKHDNLIVLRTFSKRAGLAGLRVGYGAFPLSIIEYLWRAKQPYNVSVAAEISACAALQNPTYLENVKNALLKERGRLYDLLKEVPFLRPFPSHSNFILCEVTSGKDAKKLKEDLAQMGLMIRHYDKKELKGYVRVTVGKPEQTDTLMKCLKRLS

SEQ ID NO: 3234 - protein, 572 aa, Bacillus subtilis
MGTNVQVDSASAECTQTMSGRLMLIESLKKEKVEMIFGYPGGAVLPIYDKLYIQVGTYPSRHEQGAIHAAEGYARVSGNRCRHCHVRPGATNLVTGLADAMIDSLPLVVFTGQVATSVIGSDAFQEADILGITMPVTKHSYQVRQPEDLPRIIKEAFHIATTGRPGPVLIDIPKDVATIEGEFSYDHEMNLPGYQPTTEPNYLQIRKLVEAVSSAKKPVILAGAGVLHGKASEELKNYAEQQQIPVAHTLLGLGGFPADHPLFLGMAGMHGTYTANMALHECDLLISIGARFDDRVTGNLKHFARNAKIAHIDIDPAEIGKIMKTQIPVVGDSKIVLQELIKQDGKQSDSSEWKKQLAEWKEEYPLWYVDNEEEGFKPQKLIEYIHQFTKGEAIVATDVGQHQMWSAQFYPFQKADKWVTSGGLGTMGFGLPAAIGAQLAEKDATVVAVVGDGGFQMTLQELDVIRELNLPVKVVILNNACLGMVRQWQEIFYEERYSESKFASQPDFVKLSEAYGIKGIRISSEAEAKEKLEEALTSREPVVIDVRVASEEKVFPMVAPGKGLHEMVGVKP

SEQ ID NO: 3235 - protein, 413 aa, Nicotiana plumbaginifolia
MGVIELCNTSSICIGRANPSCCSIERNQRRRIICMASSVPVQEESQQKQRVTGDAFIRPHLLKLSPYQPILPFEVLSTRLGRKPEDIVKLDANENPYGPPPEVIEALGAMKFPYIYPDPESRTLRAALAEDSGLESEYILAGCGADELIDLIMRCVLDPGDMIVDCPPTFTMYEFDAAVNGAHVIKVPRNPDFSLDVERIAEVVEHEKPKCIFLTSPNNPDGSIIDDETLLKILDLPILVILDEAYVEFSGMESKMKWVKKHENLIVLRTFSKRAGLAGLRVGYGAFPKSIIEFLWRAKQPYNVSVAAEVAACAALKNPAYLENVKVALVQERERLFNLLKEVPFLDPYPSYSNFILCKVTSGMDAKKLKEDLATMGVMIRHYNSKELKGYVRVSVGKPEHTEALMKCLKHFY

SEQ ID NO: 3236 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 3237 - protein, 99 aa, Triticum aestivum
MSGAGEEDKKPAEGGAHINLKVKGQDGNEVFFRIKRSTQLKKLMNAYCDRQSVDMNAIAFLFDGRRLRGEQTPDELEMEDGDEIDAMLHQTGGSVPSTT

SEQ ID NO: 3238 - protein, 305 aa, Streptomyces griseus
MATQALGTALRLGVFDRIGTGELRAEALAGSLGTHPRATLRLLRALAGLQLLSEPEPGAFRTTAAGNVLRADAPGTMVAMARMFTDPVMLRGWDLLDESVRTGETTFDTVFGTDFFGHLREHPELSAAFNEAMSQGTRLTAETVPHHYDFGRFQRLVDIGGGDGTLLASILRAHQEPRGVLFDTAEGLAQAPRRLAREGLDGRVTLETGDFFASAPAGGDLYLLNSIIHDWDDAVRGHLRHIRDVIPDHGSLLIVEPVLPATVPADRPDNVYLSDLNMLVNVGGRERTADDFAALCTAGGFACGA

SEQ ID NO: 3239 - protein, 488 aa, Glycine max
  unsure (1)..(488): unsure at all Xaa locations
PSSSLESSTAMTTATEKLSALKSAVAGLNEISESEKNGFISLVSRYLSGEAQHVEWSKIQTTTDXVVVPYDTLAPTPDGSSDVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVAEDFLPLPSKGHTDKDGWYPPGHGDVFPSLLNSGKLDALLSQGKEYVFVANSDNLGAIVDLMYLTHXVEILNHLIQXRNEYCMEVTPKXTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARANPENPSIELGPEFKKVSNFLGRFKSIPSIVELDSLKVAGNVWFGAGVILKGKISIVANPGVKLEVPDGAVISDKEINGPEDLL

SEQ ID NO: 3240 - protein, 71 aa, Oryza sativa
  unsure (1)..(71): unsure at all Xaa locations
GLLGGLVGWRFFIRDGIKFPDVIHAWKPNPXSHVQEYWRVCDFLSHHPESLHIFFFRWGGGGILTDHGRMD

SEQ ID NO: 3241 - protein, 474 aa, Rhizobium etli
MSISKFSSTFARVGAALAALLAPAVAFAQETAAPAARPRLPRFTMDKGDNTWMLVSSALVLLMTIPGLALFYGGLVRAKNMLSVLMQVFMITAVVSLIWVTYGYSLAFTDGGSLNSFIGGFSKAFLAGVNTSSLAETFSKGVAIPEYTFIVFQMTLPCITPGLIVGAFAERVKFSAVMLFVVLWVTFIYFPMAHMVWFWGGPSSYSAPAGLIFSYGAIDFPGATVVHINAGNRGLVAAIMLGKRTGYKKEIMRPHSMTLTMVGASLLWVGWFGFNAGSNLEANGYASLAMINTFVAAAAAVSWCIVESLARGKASMLGGASGAVAGLVAITAAAGFAARWASIVLGLVVSPICYFFVDVVKNKFNYDDSLDVFGVHCIGGIIGALGTGILVNPALGGAGIVDYSTADFAATYRGTATQVLNQAKGVLTTLLWSGIGSAILYKIVDVVIGLRVSVEAEREGLDLSTHGEPAYHAS

SEQ ID NO: 3242 - protein, 485 aa, Lycopersicon esculentum
MVSISKNNQKQQLLSKIATNDGHGENSPYFDGWKAYANNPFHLTDNPTGVIQMGLAENQLCFDLIQEWVVNNPKASICTVEGAENFQDIAIFQDYHGLPEFRQAVARFMEKVRGDRVTFDPNRIVMSGGATGAHEMLAFCLADPGDAFLVPTPYYPGFDRDLRWRTGVQLFPVVCESCNDFKVTTKALEEAYEKAQQSNIKIKGLLINNPSNPLGTLLDKDTLRDIVTFINSKNIHLVCDEIYAATVFDQPRFISVSEIVEDMIECNKDLIHIVYSLSKDLGFPGFRVGIVYSYNDTVVNIARKMSSFGLVSAQTQHLLASMLSDEVFIDKFIAESSERLGERQGMFTKGLAEVGISTLKSNAGLFFWMDLRRLLKEATFDSELELWRIIINEVKLNVSPGCSFHCSEPGWFRVCFANMDDETMRIALKRISYFVLQPKGLNNIAAIKKQCSRRKLQISLSFRRLDHEFMNSPAHSPMNSPLVRT

SEQ ID NO: 3243 - protein, 400 aa, Magnetospirillum magnetotacticum
MISVEVARETLLTGIKPVGTEVISLSQATGRILAEDLTARVSHPPVAVSAMDGYAVRAEDLAQVPHTLQMIGQSAAGAAFTGTVGPGQCIRIFTGAPVPKGADAVIMQENTRRDAERIEILTSAPAGRHVRPAGLDFAAGDMLIPAGTVMGGRTVGLAAAMNIPNLLVRRKPRIAILSTGDEIVLPGDQPGPSQIVGSNGPGLAAMVTALGAEAIHLGIAKDTRDSLDTMIKAAAGADMLVTTGGASVGDYDLVQDALKSAGMNLGFYQVAMRPGKPLMFGDMKGIPVLGLPGNPVSSMVCAIIFLEPAIRALTGRSTVTQAINALLGRDLPPNDARMEFMRGTLERTDDGLVVALPFEQQDSAVISGLARATCLVVRPPHAPTAQMGDMVQVIPLPAVL

SEQ ID NO: 3244 - protein, 923 aa, Pisum sativum
MELRVICIIRLVVACVLCLCIFIRSASSATEGFESIACCADSNYTDPKTNLNYTTDYRWYSDKSNCRQIPEILLSHRSNINFRLFDIDEGKRCYNLPTIKDQVYLIRGTFPFDSVNTSFYVSIGATELGEVTSSRLEDLEIEGVFRAPKDNIDFCLLKEDVNPFISQLELRPLPEEYLHDFSTNVLKLISRNNLCGIEDDIRFPVDQNDRIWKATSTPSYALPLSFNVSNVELNGKVTPPLQVLQTALTHPERLEFVHVGLETDDYEYSVLLYFLELNDTLKAGQRVFDIYLNSEIKKEGFDVLEGGSKYSYTVLNISANGSLNITLVKASGSKFGPLLNAYEILQARPWIDETDQTDLEVIQKMRKELLLQNQDNEALESWSGDPCMLFPWKGVACDGSNGSSVITKLDLSSSNLKGTIPSSVTEMTKLQILNLSHNHFDGYIPSFPPSSLLISVDLSYNDLTGQLPESIISLPHLNSLYFGCNQHMRDDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVANFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESTITTQNVSHPQPR

SEQ ID NO: 3245 - protein, 443 aa, Pisum sativum
MRDHKGEVQYFIGVQLDGSQHVEPLHNCIAEDTRKEGELLVKETAENVGEAVKELPDANQKPDDLWMNHSKVVRPKPHRKDDDAWRAIQKVLENGEQVGLKHFRPIKPLGSGDTGSVHLVELEGTGQYFAMKAMDKGVMRNRNKVHRACTEREILDMLDHPFLPALYASFQTKTHVCLITDYYPGGELFLLLDQQPTKVLKEDSVRFYAAEVVIALEYLHCLGIIYRDLKPENVLIQSNGHVSLTDFDLSCLTSSKPQLILPAIEEKKKRKKKKNKGQQKNQQVPMFMAEPMRASNSFVGTEEYIAPEIITGSGHTSAVDWWALGILLYEMLYGYTPFRGKTRQKTFANILHKDLKFPKSKPVSPHGKQLIYWLLHRDPKNRLGSLEGANEIKNHPFFKNINWALVRCTKPPELDGPILLDNDEKKEAKEIDPGLDDLQKNIF

SEQ ID NO: 3246 - protein, 763 aa, Panax ginseng
MWKLKIAEGNKNDPYLYSTNNFVGRQTWEFDPDYVASPGELEEVEQVRRQFWDNRYQVKPSGDLLWRMQFLREKNFRQTIPQVKVGDDEAVTYEAATTTLRRAVHFFSALQASDGHWPAENSGPLFFLPPLVMCVYITGHLDTVFPAEHRKEILRYIYCHQNEDGGWGLHIEGHSTMFCTTLSYICMRILGEGPDGGVNNACARGRKWILDHGSVTAIPSWGKTWLSILGVYEWIGSNPMPPEFWILPSFLPMHPAKMWCYCRMVYMPMSYLYGKRFVGPITPLILQLREELYGQPYNEINWRKTRRVCAKEDIYYPHPLIQDLLWDSLYVLTEPLLTRWPFNKLREKALQTTMKHIHYEDENSRYITIGCVEKVLCMLVCWVEDPNGDYFRKHLARIPDYIWVAEDGMKMQSFGSQEWDTGFSIQALLDSDLTHEIGPTLMKGHDFIKKSQVKDNPSGDFKSMYRHISKGSWTFSDQDHGWQVSDCTAEGLKCCLIFSTMPEEIVGKKIKPERLYDSVNVLLSLQRKNGGLSAWEPAGAQEWLELLNPTEFFADIVIEHEYVECTSSAIQALVLFKKLYPGHRKKEIDNFITNAVRYLEDTQMPDGSWYGNWGVCFTYGSWFALGGLAAAGKTYYNCAAVRKAVEFLLKSQMDDGGWGESYLSCPKKVYVPLEGNRSNLVHTGWALMGLIHSEQAERDPTPLHRAAKLLINSQMEDGDFPQQEISGVFMKNCMLHYAAYRNIYPLWALAEYRRRVPLPSLGT

SEQ ID NO: 3247 - protein, 481 aa, Vicia faba var. minor
MVVEKNASNNHHQTFYVSIDQQIDSKFFDDDGRVKRTGTSWTASAHVITAVIGSGVLSLAWAIAQLGWIAGPIVMFLFAWVTYYTSVLLCECYRNGDPVNGKRNYTYMEVVHSNLGGFQVQLCGLIQYLNLVGVAIGYTVASAISMMAIVRSNCFHRSGGKDPCHMNSNIYMIAFGAVQIIFSQIPDFDQLWWLSIVAVVMSFTYSTIGLGLGIGKVIENKKFAGTITGINDVTKAQKTWGSLQALGDIAFAYSFSMILIEIQDTIKAPPPSESKTMKKATLISVIVTTFFYMLCGCFGYAAFGNSSPGNLLTGFGFYNPFWLLDIANAAIVIHLIGAYQVYCQPLFAFVENYTAKRFPDSDFVNKDVKIPIPGLDRYKLNLFRLVWRTVYVILTTLISMLLPFFNDIVGLLGAIGFWPLTVYFPVEMYIIQKKIPKWSTKWICLQLLSGACLIITIAATIGSIAGLILDLKVFKPFKTIY

SEQ ID NO: 3248 - protein, 317 aa, Zea mays
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEALGVDYVDESEVLTPADDAHHINKHNFRVPFVCGCRDLGEALRRVREGAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSTGLGEAMVGINLNDPKVERYAARSE

SEQ ID NO: 3249 - protein, 425 aa, Magnetospirillum magnetotacticum
MTAIIDIHGREILDSRGNPTVEVDVVLETGVIGRAAVPSGASTGVHEACELRDGDKKRYLGKGVQKACDSVNGEIYDALSGMDVEDQILIDKTMIDLDGTPNKSRLGANAILGVSLAAAKAAAEESGLPLYRYVGGAFASILPVPMMNIINGGAHADNPIDIQEFMIMPVGASSCSEAIRMGAEVFHALKKTLKDAGHNTNVGDEGGFAPNLKSAEMALDFIMKSIETAGYKPGDDIMLALDCASSEFFKEGKYVMAGAKKTYDQKGLVKFYAKLVGSYPIISIEDGCAEDDLVGWELLTDALGAKVQLVGDDLFVTNPERLSMGIDKGLANSILVKVNQIGTLSETLEAVDMAHKAGYTAVMSHRSGETEDSTIADLAVATNCGQIKTGSLSRSDRIAKYNQLIRIEELLGSAARYAGQTIMKR

SEQ ID NO: 3250 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVREIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 3251 - protein, 470 aa, Pterocladiella capillacea
  unsure (1)..(470): unsure at all Xaa locations
GVIPYAKMGYWDPDYAVKETDVXALFRVTPQPGVDPVEASAAVAGESSTATWTVVWTDLLTACDLYRAKAYKVDDVPNTNDQYFAYIAYDIDLFEEGSIANLTASIIGNVFGFKAVKALRLEDMRIPVAYLKTFQGPATGILVERERMDKFGRPFLGATVKPKLGLSGKNYGRVVYKGLKGGLDFLKDDENINSQPFMRWKERFLYSMEGVNRSIASSGEIKGHYMNVTAATMEDMYERAEFAKQLGXXXXXXXXXXXXXXXXXXXXXXXXXXXXXXXXRAGNSTYSRQKSHGMNFRVICKWMRMAGVDHIHAGTVVGKLEGDPLMIKGFYNTLLLTHLDTNLPQGIFFEQDWASLRKVTPVASGGIHCGQMHQLLDYLGVDVVLQFGGGTIGHPDGIQAGATANRVALEAMVIXXXXGRDYVAEGPQILRDAAKTCGPLQTALDLWKDISFNYTSTDTADFVETPTANV

SEQ ID NO: 3252 - protein, 488 aa, Vaucheria hamata
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNATAGTMEEMYERAEYAKKLGTIIVMIDLVVGYTAIQSMSIWARKADMILHLHRAGNSTYARQKNHGINFRVICKWMRMAGVDHIHAGTVVGKLEGDPLMVKGFYNTLLDTKLDINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVEIATKSK

SEQ ID NO: 3253 - protein, 497 aa, symbiont bacterium of Paederus fuscipes
MTTPTRADWEIRAKDLNIEGRAFVNGEYRNAASGETFDCLSPVDGRFLAKVASCDQADAEQAVKAARAAFDSGVWSRLAPAKRKRTMIRFADLLLKNAEELALLETLDMGKPISDSLHIDVSSAANSIYWNAEAIDKIYDEVAATPHEELGLVTREPVGVVTAIVPWNFPLLMACWKLGPALATGNSVILKPSEKSPLTAIRIACLATDAGIPTGVFNVLPGYGHTVGKALALHMDVDTLVFTGSTRIAKQLMIYAGESNMKRIWLEAGGKSPNIVFADAPDLKAAAEAAASAIAFNQGEVCTAGSRLLVERSIKDRFLPLVVEALKGWKPSNPLDPDTNVGALVDTQQLHTVLSYIEAGHKDGARLMVGGKRILEETGGVYVEPTLFDGVDNAMKIAREEIFGPVLSVITFENAEEAVRIANNTQYGLAAAVWTSDLSKAHLTAKALRAGSVWINQYDGGDMTAPFGGFKQSGNGRDKSLHAFDKYTELKATWIKL

SEQ ID NO: 3254 - protein, 493 aa, Catharanthus roseus
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 3255 - protein, 816 aa, Clostridium thermocellum ATCC 27405
MKAIIMAGGEGSRLRPLTCDLPKPMVPIMNIPIMEHIINLLKKHGITEIGVTLMYLPQKIKDYFGNGSNFGVNITYFTEDTPLGTAGSVKNAEDFLDETFIVISGDSLTNMNITKAIEFHRMKNSKATLVLTRVDVPLEYGVVITDKSGAITGFLEKPSWGEVFSDTVNTGAYILEPEILKYLEKGKKVDFSQDLFPYLLLKKEPMYGYVMDDYWCDIGDLQAYLQAHYDVLEGKIQLDINGTEIQKGVWVGSGAIIEPGAILNPPCVIGDNCRIESGAVIDSLSVIGNNNVIERDSSVKRSVIWDGNYIEYGSKIRGAILCSKTNLKRYVHIFENAIVGDNCLINERVVIKPNIKIWPQKTVEPFAIVDRNIIWGSKHSKSIFGENGLSGIINVDISPEFATRLGAAYGSIFKKGSKVVVSSTTANSARMFKHAFISGILSVGVEVFNLSSLLTPLARHAINFLSVEGGIHIKLSEDNPNKLKVDFMDSKGASISRVTERKIENSFAREDFKRCSGDEVSRLNNITDFKNYYVRSILNEVNVEAIKNNPPKLCIVSPSDFVISIVVPMLTDLGCKVASFSSTNVSEVDTIVDEIKDNNASFAAFIDSNGETLVLIDKNGNVVKDDLFLCLTSLITFKSVPNSKVVVPITAPSIIETLAERYNGKVVRTKTSPQAVMEQMLNHNLFKNRENMYQFLLNFDAIAGLVKIIEFLCLQNTTLTETIKEIPDFYVSKKKIFCPWELKGRVMRTLITEKDQEKVELLDGVKFILENGWALVLPDADMPLCRVYSEGVTPEVAETISDKYIDKIKAIINDKK

SEQ ID NO: 3256 - protein, 360 aa, Schizosaccharomyces pombe
MWSSIISFLFFSVALCQPLLFQKRSSNVSDFISFNASLPNVTIFAMGGTIAGYASSSTETVDYAAGSVGIATLVDAVPAIKNFSNIRGVQVTNVGSEELTPANVLNLTQLILAEVAKPDVHGIVVTHGTDSLEETAIFLDMTVNTTKPIVVVGAMRPSTAISADGPMNLLNAVVVAASNRSIGRGTMILLNDRIGSAFYTTKTNGNMLDTFKSYEAGFLGMILDQRPHFFYSPATPTGKVHFDVSNTTELPAVEILYGYQGLNPNLAKAAVDLGAKGLVLAGMGAASWTDPGNEVIDGLISNQSIPVVYSHRTMDGFSDYYYNGIPAYFQNPQKARYMLMLSINAGYSIQNITDIFSLEY

SEQ ID NO: 3257 - protein, 232 aa, Glycine max
DLKSEVKRSLMHPAKVSLLVDIMNEGTIETIMHCAKLIEMFLVEGNNETVSSLSLLVASLRLVRDKKHPNGVVSIGLILLKKAIICSHESVRSSLISLGAIPLLINSARPRAESAREKALYILEVLSTLPEGRMALKECPNIIPNVVKLLMRVSERCTQFALSILWAIYKLAPEECASKAVEAGLAAKLLLVIQSGCNPVLKQMSSEFLKMCSLNYSTSILVSKCMLTTTIQ

SEQ ID NO: 3258 - protein, 190 aa, Glycine max
GLVGFCNNLAVENLAGIKFVVTSNMMLERRFLMAFLVFFVSNLVLTVFACTITALIAPTATGSGIPEVKAYLNGVDAPGIFTVRTLLVQIIGSITAVSSSLLIGKAGPMVHTGACVAALLGQGGSKRYGLTWKWLKFFKNDRDRRDLIICGSAAGIAAAFRAPVGGVLFALEGMSSWLVCHLLNITNFLL

SEQ ID NO: 3259 - protein, 188 aa, Staphylococcus aureus subsp. aureus Mu50
MILVVDNYDSFTYNLVDIVAQHTDVIVQYPDDDNVLNQSVDAVIISPGPGHPLDDQQLMKIISTYQHKPILGICLGAQALTCYYGGEVIKGDKVMHGKVDTLKVISHHQHLLYQDIPEQFSIMRYHSLISNPDNFPEELKITGRTEDCIQSFEHKERPHYGIQYHPESFATDYGVKIITNFINLVKEG

SEQ ID NO: 3260 - protein, 855 aa, Synechocystis sp. PCC 6803
MMSPRLFHQEQSMIDQSTLNTSPQPTITIEDDRTGMSVATLKRAFLDNLFYLQGIDRSQATLYDYYVALAYTIRDRLLHRFIKTVATYKQEKVKVVCYLSAEFLMGRHLGNNLINLGLYDKIDQVMKEFDLDLNEIIEQEPDPGLGNGGLGRLAACFLDSLASLEVPAIGYGIRYEFGIFHQRIQDGWQVEVPDNWLRFGNPWEIPRADESVEVKLGGHTEIIHNEKNQPKVVWIPERTILAIPYDTPVPGYQTNTVNPLRLWKAEASEEFNFEAFNSGLYDRAVAEKMDAETISKVLYPNDNTPAGRELRLAQQYFFVSASLQDLIRIHLRTHPNLDTFYELTAIQLNDTHPAVAIAELMRLFVDRYDYDWDKAWDITQKTFAYTNHTLMPEALERWSVDLFAKLLPRHLEIIYEINHRFLTGLQTWFPNDEALVESLSLIEENHGKKIRMANLACVGSHAINGVAALHTELLKKDTLRDFAKLWPQKFFNKTNGVTPRRWILLSNPELSALVTEKIGDGWLKNLDEMRQIEKFVDDPEFCRRWREIKQNNKRNLAAYLLKYRNVQIDVNSLFDVQVKRIHEYKRQHLAALEIIHLYNRIKQNPHAEIVPRTFIFGGKAAPGYFMAKLIIKLINAVGEVVNNDPDVRGRLKVVFVSNFNVSLGQRIYPAADLSEQISTAGKEASGTGNMKFAMNGALTIGTLDGANIEIREEAGPENFFLFGLTAEQVYAMKENGYHPHTYYDNNFDLKAVIDRIAHGYFSPGNPNLFHPIVESLLHHDPYMLLADYQAYVGCQDEVSKAYADQDRWTKMSILNSARMGKFSSDRTIREYCKEIWDVPPVKISLDEYHPEYADL

SEQ ID NO: 3261 - protein, 401 aa, Rickettsia sibirica
MSIISTRLSSIKPSPTLAIVKKTLELKQAGVDIITLGAGEPDFDTPDNIKEAAIKAIKDGFTKYTNVEGMPLLKQAIKDKFKRENNIDYELDEIIVSTGGKQVIYNLFMASLDQGDEVIIPAPYWVSYPDMVALSTGTPVFVNCGIENNFKLSAEALERSITDKTKWLIINSPSNPTGASYNFEELENIAKVLRKYSHVNIMSDDIYEHITFDDFKFYTLAQIAPDLKKRIFTVNGVSKAYSMTGWRIGYGAGSKTLIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIERTIDVIPA

SEQ ID NO: 3262 - protein, 219 aa, Leymus triticoides
  unsure (1)..(219): unsure at all Xaa locations
GRRRVEMEDRHVAKLALGGDPEVALFAVFDGHGGAAEFAAENMPKFMAEXVRKVDGGGSEEIEGAVKKCYLKTDEEFLKREESGGACCVAALLQKGGLTVSNTGDCRAVLSRAGTAEALASDHRASCEDERERIENLGGFIVNNRGTWRVQDSLAVSRGIGDAHLKQWVVADPDTRTLLVDPQCEFLVLASDGLWDKVDNQEAIDIARPLCIGNDKASR

SEQ ID NO: 3263 - protein, 427 aa, Batrachospermum cayennense
IEAAAAVAGESSTATWTVVWTDLLTACDLYRAKAYKVDAVPNANDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERFLFSIEGVNRAQAGTGEIKGHYLNVTAATMEDMYERAEFAKELGSVICMIDLVIGYTAIQTMAIWARKVDIILHLHRAGNSTYSRQKIHGMNFRVICKWMRMAGVDHIHAGTVVGKLEGDPLMIRGFYNTLLLSHLDINLPQGIFFEQDWASLRKVTPVASGGIHCGQMHQLLDYLGNDVVLQFGGGTIGHPDGIQAGATANRVALECMVLARNEGRDYVNEGPQILREAAKTCGPLQTALDLWKDITFNYTSTDTADFV

SEQ ID NO: 3264 - protein, 352 aa, Staphylococcus aureus subsp. aureus MW2
MKEQLNQLSAYQPGLSPRALKEKYGIEGDLYKLASNENLYGPSPKVKEAISAHLDELYYYPETGSPTLKAAISKHLNVDQSRILFGAGLDEVILMISRAVLTPGDTIVTSEATFGQYYHNAIVESANVIQVPLKDGGFDLEGILKEVNEDTSLVWLCNPNNPTGTYFNHESLDSFLSQVPPHVPVIIDEAYFEFVTEEDYPDTLALQQKYDNAFLLRTFSKAYGLAGLRVGYVVASEHAIEKWNIIRPPFNVTRISEYAAVAALEDQQYLKEVTHKNSVERERFYQLPQSEYFLPSQTNFIFVKTKRVNELYEALLNVGCITRPFPTGVRITIGFKEQNDKMLEVLSNFKYE

SEQ ID NO: 3265 - protein, 480 aa, Triticum aestivum
  unsure (1)..(480): unsure at all Xaa locations
QAVREPRDHAALVAPPVGVVGRRRPPGQGAVGRFGWAAVAGVLVPLAGLAGDAAGRPARAWGWPASLGAGRRGSLPPGDMRXPLVGGMWAFLRAFKSRRPDSFIDSFARRFRRAGLYRAFMFSSPTILVTTPEACKQVLMDDDTFVTGWAQGGPWPRPRAPQTRAAPGWAPSPXDGGGPRTGPSPDRSFVGGAAARTGAELESTYPGVNFGGRAMAIDLPGFAYHKAIRARRRLVAALQCVLDERRARGAKTAGVDMMDRLISAEDEGGRRLQDDEIIDVLVMYLNAGHESSGHITMWATVFLQENPDILAKAKAEQEAIMRSIPPGQKGLTLRDFRKMEYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRVSSSH

SEQ ID NO: 3266 - protein, 498 aa, Acinetobacter sp. SE19
MGGIPHIPFCLTSVICQGCLIMNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 3267 - protein, 250 aa, Chloroflexus aurantiacus
MRIPLIAGNWKMYKTVGEATTLVRDLLAGLGELSDREAIVCPPFTALAAVAALVADSPLGLGAQNLYPEAQGAFTGEVSPPMLVDIGCRYVIIGHSERRQYFGESDAFVNRKLRAALAHGLRPIVCVGESKPQRDAGQAEPIVTAQVRAALLEVPPDQMANVVIAYEPIWAIGTGDTATPADAQAMHAAIRATLAELYGSEIAATVRIQYGGSVKPDNIDELMAQPDIDGALVGGASLQAASFLRIIHYQ

SEQ ID NO: 3268 - protein, 149 aa, Zea mays
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKTQTP

SEQ ID NO: 3269 - protein, 186 aa, Haemophilus somnus 2336
MPEKVLVVLDEAYTEFTDEKERLNSFKLLQKYPNLIVSRSLSKAYGLAGLRIGYAVSNPEIADLLNRVRQPFNCNVLALVSAVAVMQDDAFVEKVAENNRIEMVRYENFCRQQKLDYIPSKGNFITIDFKRPANEIYQALLHKGVIVRPIAGYGMPNHLRVSIGLPKENDKFFDSLVKVLGEVFVG

SEQ ID NO: 3270 - protein, 158 aa, Triticum aestivum
  unsure (1)..(158): unsure at all Xaa locations
MAAGRELVVSFGEMLIDFVPTVAGVSLAEAPAFLKAAGGAPANVAIAVSRLGGGAAFVGKLGDDEFGRMLAAILRDNGVDGGGVVFDAGXARTALAFVTLRADGXXIHFYRNPNAESPHCRXLXXRLIRXGCVFHYXXISLIADLAGNNLRAMXIAKR

SEQ ID NO: 3271 - protein, 203 aa, Zea mays
LRDTALKNIMNHIHYEDESTRYLCVCPVNKALNMICCWVENPNSDAFKRHLPRIYDYIWLAEDGMKLKVYDGTQAWDTAFIVKAYCSTDLVHEFSPTLRKAHEFIKSLQIPENQPDHENYYRHRSKGSWAHSTLDNGWSVSDSTAEAIQALLLLSKFSSNLVGDPIKEERLFDAVDCLLSFMNKDGTFSTYERKRTASLLEVL

SEQ ID NO: 3272 - protein, 570 aa, Emericella nidulans
MSPPSAKSMEEGRTPSVQYGYGDPKTLEGQIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLACEVSTMALLSFLSCWNPDNVGHCLGLIIEYWNPPVSVGLWIAIVLVESEFWFAGLKILAIIGLIILGVVLFFGGGPNHERLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIKTLVLEGSTMSSMLPSGSLPGHPVTHGCYAGSEKLYSLAGEGQAPKIFTRTNRTGVPYVAVLATWTIGLLSFLNLSSSGQTVFYWFTNITTVGGFINWVLIGIAYLVCFPPSLHLNTPDQKQRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 3273 - protein, 644 aa, Odontella sinensis
MNDNKNNTVRNLLIGIALLSGISLTAKKFDLIGVQGSESGKNINQVNPNVISSKMTYGRFLEYLEMGWVNQVDLYDNSRNAIVQASSPELGNRPQTIRVEIPVGASQLIQKLKEYNIDFDAHPAEQKNIFVNILSNILLPIIFITGLVYLFQNSENFGGGSGQSPMSLGKSTARFERRPDTGVSFKDIAGIDEAKTEFEEIVSFLKEPDKYTIVGAKIPKGILLVGPPGTGKTLLAKAIANEADVPFFSVAGSEFVEMFIGIGAARVRDLFKKASENAPCIVFIDEIDAVGRERGAGVGGGNDEREQTLNQLLTEMDGFKENKGVIVVGATNRADILDAALLRPGRFDRQVTVNLPDRLGRVGILKVHARNKPLGEDVSLVQLANRTPGFSGADLANLLNEAAILATRYKKSSITKNEVNEAADRIIGGIAGAPMEDTKNKRLIAYHEVGHAITGSVLKSHDEVEKITLTPRGGAKGLTWFTPEEDQSLLSRSALLARIITTLGGRAAEQVIFGEPEVTTGASSDLQQVTNLARQMVTRFGMSNIGPLALEDESTGQVFLGGNMASGSEYAENIADRIDDEVRKIITYCYEKAIEIVLDNRVVIDLIVEKLLDKETMDGDEFRELLSTYTILPNKNIPYVSKFN

SEQ ID NO: 3274 - protein, 591 aa, Oryza sativa
MAMAMAMRRAAALGARHILAASSTSSSGVLLRRHMSVDAGAAMEKVRAAGLLRTQGLIGGKWVDAYDGKTIEVVNMQFALGNPCEQFVELIYFLQDALYLVQNPATGETLANVSCMGSKETSDAIASAHSTFYSWSKLTANERSKALRKWHDLIISHKEELALLMTLEQGKPMKEALVEVTYGASFIEYFAEEAKRIYGDIIPPTLSDRRLLVLKQPVGVVGAVTPWNFPLAMITRKVGPALACGCTVVVKPSEFTPLTALAAADLALQAGIPAGAINVVMGNAPEIGDALLQSTQVTEITFTGSTAVGKKLMAGSANTVKKVSLELGGNAPCIVFDDADIDVAIKGSLAAKFRNSGQTCVCANRILVQEGIYEKFASAFIKAVQSLKVGNGLEESTSQGPLINEAAVQKVEKFINDATSKGANIMLGGKRHSLGMSFYEPTVVGNVSNDMLLFREEVFGPVAPLVPFKTEEDAIRMANDTNAGLAAYIFTKSIPRSWRVSEALEYGLVGVNEGIISTEVAPFGGVKQSGLGREGSKYGMDEYLEVSIAIRHANCKHLSGFTLILFLITLLGLNMDIEKIGGVKCGMVVIR

SEQ ID NO: 3275 - protein, 375 aa, Kluyveromyces lactis
MFRLARAQTALANKASVSRSFLRLNSSFAIPETQKGVIFYENGGKLEYKDLPVPKPKANEILINVKYSGVCHTDLHAWKGDWPLPVKLPLVGGHEGAGIVVAKGENVKNFEIGDYAGIKWLNGSCMSCELCEQGYESNCLQADLSGYTHDGSFQQYRTADAVQAAQIPKGTDLAEIAPILCAGVTVYKALKTADLKPGQWVAISGAAGGLGSLAVQYRKAMGLRVLGIDGGDGKEELFKQCGGEVFIDFRKSKDMVADIQEATNGGPHGVINVSVSEAAVSMSTEYLRPTGLVVLVGLPADAYVKSEVFSHVVKSISIKGSYVGNRADTREATDLFTRGLVKSPIKIIGLSELPEAYALMEQGKILGRFVVDTYK

SEQ ID NO: 3276 - protein, 424 aa, Batrachospermum theaquum
  unsure (1)..(424): unsure at all Xaa locations
IEASAAVAGESSTATWTVVWTDLLTACDLYRAKAYKVDAVPNTSDQYFAYIAYDIDLFEEGSIANLTASIIGNVFGFKAVKALRLEDMRIPIAYLKTFQGPATGTIVERERMDKFGRPFLGATVKPKLGLSGKNYGRVVYEGLKGGLDFLKDDENINSQPFMRWRERYLFAIEGVNRAQAAAGEIKGHYLNVTAATMEDMYERAAFAKELGSIICMIDLVIGYTAIQTMAIWARKSDMILHLHRAGNSTYSRQKNHGMNFRVICKWMRMAGVDHIHAGTVVGKLEGDPLMIKGFYDTLLLSHLDINLPNGIFFEQNWASLRKVTPVASGGIHCGQMHQLLDYLGDDVVLQFGGGTIGHPDGIQAGATANRVALESMVIARNEGRDYVNEGPQILRDAAKTCGPLQTALDLWKDISFNYXSADTA

SEQ ID NO: 3277 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSKKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 3278 - protein, 410 aa, Thermobifida fusca
MKSVEQHVSDILAVVSRPDPIELDLLRAHGAVLAEPVTAELSLPPFDNSAMDGYAVCAADVATATPQTPVTLPVIADIPAGDVFASAIPVGCCARIMTGAALPKGADAVVPVEWTDAGVAEVAVHRAVEAGHAVRQAGSDVKEGTEVLPAGVRIGPAEVAVLAAVGRRSVSVYPRPRVVVLGTGEELVEPGRPLSPGQIWESNSFMLTAAAIEAGCEGYRYGFVGDDPDQVFEAIQDALVRADIVITSGGVSMGAHDAVKEVLSRLGTVQFDKVAVQPGMPQGYGTVGESSIPIIALPGNPVSSYVSFYLFVLPALRKMSGLPQEQLPSVRARLLAPITSSPRGRRSYLRAVLDYDIESEEVAYTALPVAQQGSHQLSALAKTNALVVVPEQVTELPEGSVVEAIQLPHR

SEQ ID NO: 3279 - protein, 281 aa, Cytophaga hutchinsonii
MSMFFWGLSWPSGKVAASYGSPVTIVLIRYIVVFAGFLPVFFFMKAPLTIHRKGIPSLLAAGLLLSAYTYLFFYGLKNGLAGAGGVLVTTMNPIMAYSIGLVLNRKKPSRNETIGLVLGLVAGATLLKIWGSLDELFASGNIYFLLAAFVWAVMSRITSKASTYGSSMSFSLWMYLATVLIMIPFVNLTDLNNILHNADQYFWWNILFSGIFATSLATSYYFYATTTLGPEKASSFIFLVPVSAAVSSWVFLNETLLLHTIIGGVLGIAAVYMINRKKEIM

SEQ ID NO: 3280 - protein, 457 aa, Escherichia coli O157:H7 EDL933
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 3281 - protein, 192 aa, Vibrio vulnificus CMCP6
MADIVFIDNFDSFTYNLVDQFRSLGHQVKIYRNSIATDTIVDAIEQLERPVVLLSPGPGAPSEAGCMPELIARVKGKVPVIGICLGHQAIVEAYGGTVAGAGEIIHGKVSMMEHQSHAIYQGLPSPLAIARYHSLVATHVPQTLTVTAEVNGLVMSVVNEEDKVCGFQFHPESIMTTQGATLLANAINWALA

SEQ ID NO: 3282 - protein, 798 aa, Aspergillus oryzae
MPGAASIVAVLAALLPTALGQANQSYVDYNSEANPDLFSECLETGGTSFPDCESGPLSKTLVCDTSAKPHDRAAALVSLLTFEELVNNTANTGHGAPRIGLPAYQVWNEALHGVAHADFSDAGDFSWSTSFPQPISTMAALNRTLIHQIATIISTQGRAFMNAGRYGLDVYSPNINTFRHPVWGRGQETPGEDAYCLASTYAYEYITGIQGGVDANPLKLIATAKHYAGYDIENWDNHSRLGNDMQITQQDLAEYYTPQFLVASRDAKVHSVMCSYNAVNGVPSCSNSFFLQTLLRDTFDFVEDGYVSGDCGAVYNVFNPHGYATNESSAAADSIRAGTDIDCGVSYPRHFQESFHDQEVSRQDLERGVIRLYASLIRAGYFDGKTSPYRNITWSDVVSTNAQNLSYEAAAQSIVLLKNDGILPLTSTSSSTKTIALIGPWANATTQMLGNYYGPAPYLISPLQAFQDSEYKITYTIGTNTTTDPDSTSQSTALTTAKEADLIIFAGGIDNTLETEAQDRSNITWPSNQLSLITKLADLGKPLIVLQMGGGQVDSSALKNNKNVNALIWGGYPGQSGGQALADIITGKRAPAARLVTTQYPAEYAEVFPAIDMNLRPNGSNPGQTYMWYTGTPVYEFGHGLFYTNFTASASAGSGTKNRTSFNIDEVLGRPHPGYKLVEQMPLLNFTVDVKNTGDRVSDYTAMAFVNTTAGPAPHPNKWLVGFDRLSAVEPGSAKTMVIPVTVDSLARTDEEGNRVLYPGRYEVALNNEREVVLGFTLTGEKAVLFKWPKEEQLIAPQ

SEQ ID NO: 3283 - protein, 522 aa, Zea mays
  unsure (1)..(522): unsure at all Xaa locations
LVSPGPGLLICSSRGFGPMAAAALAMAEQVVAELRVRCETPPSMLREVAVEMAREMGAGLEKDGGSRVKMLLSYVDKLPTXGREEGLFYGLDLGGTNFRVLKVQLGGNAKHVVDRDSREVGIPPHLMSGSSSELFGFIASELAKFVDDDEKCANISNGKKREIGFTFSFPVKQRSVASGTLVKWTKAFSINDAVGEDVVAELQTAMEKQGLDMHVAALINDAVGTLAGARYYDKDVVAGVIFGTGTNAAYVEKANAIPKWEGELPHSGDMVINMEWGNFFSSHLPITEYDQELDKESLNPGEQIYEKLTSGMYLGEIVRRVLLKISLQSAIFGDIDHTKLQTHFLLRTPHISAMHHDETSDLKIVAENFEENLEITGTSLEARKLVVEICDIVATRAARLAAAGLAGILMKIGRDHSVEDQRSVIAIDGGLFEHYTKFRRCLETTLGELLGDEASKAVAIKHADDGSGIGAALIAASQSQYKNDLVAVKHADDGSGVKYAEDKRADDGSEIGAALIAASQSQ

SEQ ID NO: 3284 - protein, 417 aa, Streptomyces coelicolor A3(2)
MTESTAARKPRRSAGSKAAGTTGTKAAGTTGSKAGTGKRTTRTTSTTRTAAEKGSDTELVQLLTPEGERVEDAAHAEYASYVADITPDELRGLYRDMVLTRRFDAEATALQRQGELGLWASLLGQEAAQIGSGRATREDDYVFPTYREHGVAWCRGVDPTNLLGMFRGVNNGGWDPNSNNFHLYTIVIGSQALHATGYAMGVAKDGADSGVIAYFGDGASSQGDVSEAFNFAAVYNAPVVFFCQNNQWAISESNEKQTRVPLYQRAQGFGFPGVRVDGNDVLASLAVTRWALDRARRGEGPALIEAYTYRMGAHTTSDDPSRYRHDDERAAWEAKDPILRLRRFLESANHADEGFFAELEAESETLGKRVREVVRAMPDPDRFAIFENVYADGHALVDEERAQFAAYQASFADAEGV

SEQ ID NO: 3285 - protein, 412 aa, Zea mays
MAAMPGGAHAAGAADQMQVDQPLPPAAAGTAHAPADAKHAGSMIEGSDPVTGHIISTTIGGKNGEPKKTISYMAERVVGTGSFGIVFQAKCLETGETVAIKKVLQDKRYKNRELQIMRSMDHCNAVSLKHCFFSTTSRDELFLNLVMEFVPESLHRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKVLGTPTREEIRCMNPNYTEFRFPQIKAHPWHKIFHKRMPPEAIDLASRLLQYSPNLRCTALEACAHPFFDELREPHARLPNGRPFPPLFNFKQELANASPELINRLIPDHARRHLGLTLLPTAGP

SEQ ID NO: 3286 - protein, 490 aa, Pseudomonas aeruginosa PAO1
MARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTALKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGKGAYVAPTVFTDCRDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 3287 - protein, 256 aa, Pantoea endophytica
  unsure (1)..(256): unsure at all Xaa locations
GAAGGIGQALALLLKTQLPSGSELSLYDIAPVTPGVAVDLSHIPTAVKIKGFSGEDARPALQGADVVLISAGVARXPGMDRSDLFNVNAGIVKNLVQQIAEVCPKACIGIITNPVNTTVAIAAEVLKKAGVYDKNKLFGVTTLDIIRSNTFVAELKGKQPTEVEVPVIGGHSGVTILPXLSQIPGVSFTEQEVADLTKRIQNAGTEVVEAKAGGGSATLSMGQAAARFGLSLVRXLQGEKGVVECAYVEGDGQYAR

SEQ ID NO: 3288 - protein, 475 aa, Grateloupia livida
QRYESGVIPYAKMGYWDPDYVVKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALESIVIARNEGRDFVAEGPQILQDAAKTCGPLQTALDLWKDISFNYTSTDTADFVETPTANV

SEQ ID NO: 3289 - protein, 401 aa, Glycine max
MEGKLSRAAKKITSSSIQELSQLAQRCNAINLAEGFPDFPSPPHLKNAAVSAINSDFNQYRHVQGVCDLLAKMVKQMHGLDIDPVTDVAICCGQSEAFAAAIFATIDPGDEVILFDPSYETYEGCVAMAGGVPIHVPLDPPQWTLDPSKLLRSFTEKTKAIVLNSPHNPTGKVFTKEELEIIAGECCSRNCLAITDEVYEHITYDNLKHISLASFPGMLERTVITSSLSKSFSVTGWRVGWAIAPAFLASAIRNIHGRVTDSAPAPFQEAALTALRSPPEYFESLRRDYQSKRDYIIKLLDGVGFKIVFIPQGSFFLFAELPDNWLLSDVEFVKKLIIEAGVVAVPGQGFFHTNLSSNEVSSLNYQKRYVRFAFCKSDTTLTTVAERLGKLLDAAGHLALH

SEQ ID NO: 3290 - protein, 309 aa, Escherichia coli
MSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGSAEDAAKRGHLTASTVIQYRGAIIPREAMPA

SEQ ID NO: 3291 - protein, 154 aa, Glycine max; identical to SEQ ID NO: 771
  unsure (1)..(154): unsure at all Xaa locations

SEQ ID NO: 3292 - protein, 420 aa, Enterococcus faecalis V583
MTIADIVMLTATIIIWSLLIVNILLVIFGYVYYLKTDPVAPPPVEDEDAPFVSIMVPAHNEGIVIVRTVEALLNFNYPQDRYEIIVINDNSSDNSAELLANVQKKAVNRNLQIINTDNITGGKGKSNALNIGFKQAKGDVIAIYDADNTPEPNALRYLVGELIASEEYGAVIGKFRTRNRNASLLTRFINIETLAFQWMAQAGRFQLFKLCTIPGTNFIVRRSIIEAIGGWDDKALAEDTEISFRIYMMGYKIKFQPKAVTWEQEPQTLSVWFRQRTRWVKGNIYVIVKNAKLLFNPKASRIRFDILYFLSIYFLLMTSLVLSDIMLVLSMSGYLTTTLQGFSNSLWLLAILLFIFSTFVSITTEKGEMTLENILIIALMYITYSQMWLVVAAYGMVMYIKENVFHKQTQTKWYKTERFK

SEQ ID NO: 3293 - protein, 165 aa, Triticum aestivum
MDVGRAVLVQNEQRTRLDAGTWGTMGVGLGYCVAAAVAEPGRLVVAVEGASGNGFSAMEVETLVRYQLPVVVIVFNNNGVYGGDRRGPDELTGPYKDDPAPTSFVPGAGYHKMMEAFGGKGYLVETPDELKSALSESFRARKPAVINVTIDPYAGAESGRMQHKN

SEQ ID NO: 3294 - protein, 200 aa, Zea mays
QFTGKLTSKTLCVFRRSTNLDSWTPDQLKMMAFGGNNRAHAFFKQHGWTDGGKVEAKYTSRAAELYRQMLTKEVAKSATTDNALPSSPVASEASKPPSDDFPEFKLPDHEPKSPKAAPRSPKAATHPTFATSVKKPIGAKKVGGKTGGLGVRKLTTKPNESLYEQKPEEPKPAVPALAASTKKGGQALHSRFEYVENEPS

SEQ ID NO: 3295 - protein, 266 aa, Escherichia coli
VDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 3296 - protein, 413 aa, Neurospora crassa
MANFPPPPVSTIDWSNVGFKVREVNGHIESSYSVKTGKWSPLKFVSDPYLRMHGMAPALNYGQQAYEGLKAFRLPGNDSIAIFRADKNASRMQHSAEYISIPPVPVDLFIDAVKAAVALNAEFVPPHETGAALYIRPQIFGSSAQLGLSPPEEYLFSVFVIPTGVYHGTHPVKALILEEFDRAAPNGTGSAKVGGNYAPVLRWSDKARKEGYDITLHLDSARHEEVDEFSTSGFIGVLRGDGGEDDVTVVVPSSKAVIDSVTSDSIQEIGRSFGWKVEKRPIKYSELPSFSEVMAAGTAAALVPIRSITRRVKTSSPQSLASSTATQEHARVSFNKEAEEETVTYLPDNQEDAGDLCLKLLSQLKGIQLGKIEDKLGWRFAVTEEDGKKAEGAEKARSSEGQGKEAQTVDQMD

SEQ ID NO: 3297 - protein, 211 aa, Triticum aestivum
HRSIHRRLSRQDVDGEEGEDRKPVIKPGVHVTLKVRNTDGHTVYRTMRRTEQLQSLMDFYYASVPAVQPGTGRFLYDGGRLRGWQTPAELQIEDGDEVDFFTELLGGGGTSALPKAERNMASPLAADLRFVTLKVVDQEQRLVRRTIRMNAELQIVMDAYYDEAGDVVRGTGSFWFENVRLRGARTPAYFKLQDGDAIDFFETQLGGGIPV

SEQ ID NO: 3298 - protein, 495 aa, Oryza sativa (japonica cultivar-group)
MATAGALALVAICSYLAVTSNKQKRRRRPPVVGTVFHQLYNVRRIHDYHTALSREHTTFRMLVPAGGDQIYTCDPAVVEHILKTNFANYGKGPFNHGNAKDLFGDGIFAIDGEKWKQQRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSVVDYKYLRDIILNIVIAGKDTTAGALAWFLYMVCKHPEVQEKICHEAMVATSAGDTASVDEFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVSYRTTLTLAIDQGLHLTATAR

SEQ ID NO: 3299 - protein, 487 aa, Ustilago maydis
MVNASYTPSGDLITYYDDQGTPTELIYNLGNMSWIIVSTALVFIMIPGLGFFYAGLLRKKSALSMIWMSMVILSVASFEWFFWGFSLAFSTSSSNKFIGNLDNFGLINVDIGPSTGGTGLPQLLFCIYQMMFAAITPVIACGAFADRARLGPVLIFAFCWCTIVYNPIAYWTWNVGKGWANVMGGLDFAGGTPVHISSGTAALAISIFLGKRKGYGTEQLAYRPHNVAYVILGTVLLWFGWFGFNGGSALGANLRAVQAMMVTQVATSVGGLTWMFWDWRLERKWSAVGFCSGAISGLVAITPASGYVGTPAAVAFGVLGGTACNFATGLKNLFGYDDALDIFAAHGIGGIVGNLLTGIFADNRVASFDGTAPIPGGWINKNWIQLGYQLADSAAGFGWSFVVTLILLFAIDRIPGCHFRSSEEDESLGIDLTQIGEEVMVMPLLHDFVRPEDGAEIHHATASTDLKFSPAHSEKDLEAARPQPTAV

SEQ ID NO: 3300 - protein, 374 aa, Zea mays
  unsure (1)..(374): unsure at all Xaa locations
METPLSTRRITRSLAAASAQKSAAAGMDSAALFSLSKNAAAGETHAQTRAALHDITNDSPVVGLAAGSLHATDTTPAKTRRRAPRCTPGSGEALLRGQVKALLHKVDEEQGCAPPAPXRPKRIQALLGVSRSPAQLLAPTPANTPQIGPVSAPREGVGLHDGATVVPCVIDEEELLIPKLQVIAGSIPSARXLGECQLNCAVFDDPAIPTSEDSGSSVPSSVSLQEGSAGSYLDKSSSPEEGSSSAWSIQVHASSEKGDEEELGVEELAAEYTDEEEEEEDRDWDEDSDDDCYDDLCEEMSRMTVLEEEEEKKTGLPQFEGKHTRFIYNSDDEIERVEEADAAEATAELRALMLRGLLVPEGRHLRFHDEDADE

SEQ ID NO: 3301 - protein, 620 aa, Zea mays
MEVDRKKNLQIGSKGKEVQSKNPRREEPLASSEVDMDEPDAPESGDMIVDGNNGCSRESPLQPMDSKNSKGCAVKPTSVSSDFGEELDLDLGGEKSETQQERKLSRQDRVELCRSFQLAVSSHDWESAEGLVGMADAQGLNDVLCVAVDAIWFLSDRDELLAIVGLIKRVVSEGAKDFTRAALRTSFLASCVSACRGRSTSLADAVSFMGQKLHERLQESQGDEVLKAEASAKVHRFTEWALKCIGLHSRVRENRGKGNHDTVIEVQLQLSAFKIFLDLADNELTGKDFTEAFDAACFPLTLFSTTFDQGWASGISAAAVQGLLELLVEGGADNVNQCFLEAARYGSTELVRILLQVAQRNSLDIDVDLALGFAAHYGKIETMGCLVEEGNAIGFLGPLMRAAERGCLQVVEWFVNHGCREMELCLALTAATSNSQIAVAAYLLPLVPQHVLAPLSIEIIKAAGERTTGSLQGVDFLLRSDFLNDPAATYAVADSIARCTDEAVDAKLRSFMNEHWSEAAFCAGFESAQQHFVNFMRIMERGESPIRLGDLPLELVIAMAYLPLYKECMNSNGRLLPQRLRGQLVEAASRLEDRQVERDSQSRELLAILEHHIPRFMIQT

SEQ ID NO: 3302 - protein, 219 aa, Zea mays
MAGRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFENISRWLKELRDHADSNTRIMLVGNKTDLRHLRAVATDDARSFAEAEGLSYIETSALEATNVEEAFQLILGDIYRAVSKKPVASDEASAGQGGVKEGKTIDVATGADAAAHKKQCCSA

SEQ ID NO: 3303 - protein, 381 aa, Zea mays
  unsure (1)..(381): unsure at all Xaa locations
MADRANHPSVMQKFGGQFHLASSFSEGVRARNICPSVPSYERRFTTSCYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKAXKGGGDRQFNGLVDVYRKTLKSDGIAGLYRGFNISCVGIIVYRGLYFGLYDSLKPVLLTGTLQDNFFASFAISWLITNGAGFASYPIDTVRRRMMMTSGEAVKYKSSLDAFQQILKKEGPKSLFKGCXGLTILRAIAGAGVLSGYDQLQILFFGKKYGSGGA

SEQ ID NO: 3304 - protein, 354 aa, Brucella suis 1330
MARITLRQLLDHAAEKGYGVPAFNINNMEQALAIMEAANAVDAPVILQASRGARSYANDIMLRHMMDAVTEIYPHIPVCVHLDHGNEAATCMSAIQAGFTSVMMDGSLKADGKTPADWDYNVSVTRQVSEMSHLGGISVEGELGVLGSLETGMGDAEDGHGAEGKLSHDQLLTDPDEAVKFVRETKVDALAIAMGTSHGAYKFSRKPDGSVLAMHVIEEIHRKLPNTHLVMHGSSSVPEELQEIINKYGGQMKPTWGVPVEEIQRGIKHGVRKINIDTDNRMAMTGQIRRILQEEPSEFDPRKYLKPAMAAMTKLCKERFEQFGTAGHAASIRPIPLSEMAKRYRDGSLDPKFS

SEQ ID NO: 3305 - protein, 398 aa, Pseudomonas putida KT2440
MNHALTQLQPYPFEKLRALLGSVKPAADKRAIALSIGEPKHESPAFVAQAMADNLDKLAVYPSTLGLPALRQAIGQWCERRFGVPAGWLDADRHILPVNGTREALFAFTQAVVNRADDGLVISPNPFYQIYEGAALLAGATPHYLPCLENNGFNPDFDAVPAEVWKRCQILFLCSPGNPTGALVPMNTLKKLIALADEHDFVIAADECYSELYFDEDAPPPGLLSACAELGRSDFARCVVFHSLSKRSNLPGLRSGFVAGDAQIIKPFLLYRTYHGCAMPVQTQLASIAAWQDEAHVRENRDQYRAKYDAVLDILQPVLDVQRPDGSFYLWAKVPGDDAEFTRDLFEAQHVTVVPGSYLSREVDGVNPGAGRVRMALVAPLAECIEAAERIRAFLQNR

SEQ ID NO: 3306 - protein, 223 aa, Sorghum bicolor
IENKISRQVTFAKRRNGLLKKAYELSLMCDAEVALIIFSGRGRLFEFSSSSCMYKTLERYRSSNYSSQEVKVPLDSEINYQDYLKLRTRVEFLQTTQRNILGEVLGPLSMKELEQLENQIETSLKQIRSRENQMLLDQLFDLKSKEQELQDLNKDLRKKLQETSPENALHVSSWEEGGHSGASGNVLDPYQGLLQHPESDPSLQIGYHQQAYMDQLNNEDMAG

SEQ ID NO: 3307 - protein, 239 aa, Leuconostoc mesenteroides subsp. mesenteroides ATCC 8293
MDNFNMNARRDVTGVDEGMRAFFKQTYSFMGIAVLLTAVTGFIVQNFFLEQVAKLLVGNVIGLLALLGIQMLIITMIGRATFKNPARAFGLLMAFAVVEGLTLGVLLAVYTGASVVMAFVSASAVFGGMAAYGVFTKRDLTGLGSILFGLLIGLLIASIANMFFYSGIVSLLLSWASVVVFSLFTAYDNQNLKVMYSQFAGQADTTGLAVNGALRLYLDFVNIFFALLRIFGVVSGSRD

SEQ ID NO: 3308 - protein, 858 aa, Coccidioides posadasii
MWLGWLPAVFVLVAGGAAEKEWAFSPPYYPSPWASGQGEWSEAYNKAREFVSQLTLTEKVNLTTGVGWMQEACVGNVGSIPRLGFRSLCMQDGPLGIRFADHVSAFPAGINVGATWSKSLAYLRGKAMGEEHRDKGVDVQLGPAVGPLGRSPDGGRNWEGFSPDPVLSGYLVAETIKGIQDAGVIACVKHFIVNEQERFRQAPEAQGYGFNISESSSSNVDDVTMHELYLWPFADAVRAGVGSVMCSYNQINNSYGCSNSYTQNKLLKGELGFQGFIMSDWQAHHSGVGDDLAGLDMSMPGDTLFLTGKSYWGPNLTIAVTNGTIPQWRLDDMAVRIMAAYYKVRRDQTQVPINFNSWTRDEFGYLHAGGQEGYGRVNQMVNVRGRHAVIARKVASASTVLLKNRGVLPLKGKEKLTAVIGEDAGPNLWGPNGCPDRGCANGTLAMGWGSGTADFPYLVTPAQAIENEVITKGVGEAMSVFDNYATSQIESVVSQATVSLVFVNAGAGEGFISVDGNEGDRKNLTLWKNGDELIKTVASMCNNTVVVMHTAGPVLVNKWYDHPNVTAILWAGLPGQESGNALGDVIYGRVNPGAKSPFTWAATSEDYGVSILKEPNAATKAPQIDFEEGIFIDYRAFDKSNTKPIYEFGFGLSYTTFTFSDLEVQPLRANPYVPTSGFTDSAPVFGNSTDHLQFPAGFDPVHLYIYPWLNSTDLKESSMDRDYGLPTEKYVPPGATDGGPQALLPAGGGPGGNPGLYEELYRVSVTITNTGSVTGDEVPQLYLSLGGPNDAKIVLRGFDRVTLRPGENTVWQTTLTRRDISNWDPVTQNWVVTSHPKMIYVGNSSRNQPLSAPLAPSS

SEQ ID NO: 3309 - protein, 805 aa, Capsicum annuum
MTDQAESSDSKNAKKDFSTAILERKKAANRLVVDEAVNDDNSVVALHPATMEKLQLFRGDTILIKGKKRKDTVVIALADETCDEPKIRMNKVVRSNLRVRLGDVVSVHQCPDVKYGKRVHILPIDDTIEGLTGDLFDAFLKPYFLEAYRPLRKGDNFLVRGGMRSVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLGIHTKNMKLAEEVDLERISKDTHGYVGADLAALCTEAALQCIREKMDVLDLEDDTIDAEVLNSMAVTNEHFQTALGTSNPSALRETVVEVPNVSWEDIGGLENVKRELQETVQYPVEPPEKFEKFGMSPSKGVLFYGPPGCGKTLLAKAIANECQANFISVKGPELLTMWFGESEANVREIFDKARQSAPCVLFFDELDSIATQRGSSSGDAGGAADRVLNQLLTEMDGMNAKKTVFIIGATNRPDIIDPALLRPGRLDQLIYIPLPDEDSRHQIFKACLRKSPLSKDIDLRALAKHTQGFSGADVTEICQRACKYAIRENIEKDIEREKRRQENPDSMDEDVDEVPEIKPAHFEESMKYARRSVSDADIRKYQAFAQTLQQSRGFGTEFRFADTSGGATAAADPFATSNAAADDDDLYS

SEQ ID NO: 3310 - protein, 268 aa, Oryza sativa
MDASSPFSFHELRRQASSYLTDKIRSARLALTDVTPTQLMTEEATSGDASPPNVKTMSLIARQAFEIDEYVRISDILHKRFARFDRRQWREAYKALLLLEHLLTHGPRSVALEFQRDREVIEQMVSFQHIDEKGFNWGMTVKSKSERVLRLLERGPFLEDERERARKIAHEIKGFGSFNLSSAHASGSAAAALRAGAMEHQCYGRSNSRYEGRWRREACVDDGDKENLLVVSMAEAKAEAAAEEPHHYHHPFYGFGQQRPEAMLLLSQ

SEQ ID NO: 3311 - protein, 278 aa, Pseudomonas aeruginosa
MIKKCLFPAAGYGTRFLPATKAMPKEMLPVVNKPLIQYAVEEALEAGLSEIGIVTGRGKPSLEDHFDISYELEHQIRNTDKEKYLVGIRRLIDECTFAYTRQVEMKGLGHAILTGRPLMAATFSVVLADDLCLNLEGAQVLKQMVKLYNQWRCSIVAIQEVPPEETNKYGVIAAEMIRDDIFRVNTMVEKPKPEEAPSNLAIIGRYILTPDIFDLIEQTEPGKGGEIRVTDALMKQAQDGCVLAYKFKGKRFDCGTAEGYIEATNFCYENLYKTGKAH

SEQ ID NO: 3312 - protein, 435 aa, Pyrococcus furiosus DSM 3638
MARITEEQRRKLAQDALEYHRNNFPGNGKIEVIPKVPLRDFYDLSLAYTPGVAEPCKVIAKKGNYEDYTIIPNTVAVVTDGSAILGLGNIGVLAGMPVMEGKCVLFKALAGIDAFPILIDTQDVEKIVETIKLISKGFGGINLEDISAPRCFEIEMRLKRELDIPVFHDDQHGTAVVTLAGLINALKLVGKKFNEIKVAISGAGAAGIAIAKLLHHVGVKEILLVDRAGIIYEGRKENMNPYKEEVARFNIHGVQGDLAKAMEGADVFIGVSVGGIVKPWMIKKMADDPIVFAMANPIPEIMPEDAKKAGAKIVATGRSDYPNQINNVLGFPGIFRGALDVRATDITLNMNIAAAEAIASVVSDEELSEDYIIPSPLHPDVYPKEARAVAEQAIRDGVARRKLSGEWVEEHTRKLREFYAALIEPLNERRKQYIT

SEQ ID NO: 3313 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPEVSQLRQIVRLISESKRPVLYVGGGSLNSSEELGXFVELTGIPVASTLMGLGSYPCNDELSLQMLGMHGTVYANYSVEHSDLLLAFGVRFDDRVTGKLEAXASRAKIVHIDIDSAEIGKNKTPHVSVCGDVKLALQGMNKILENRAEELKLDFGVWRSELSEQKQKFPLSFKTFGEAIPPQYAXQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEGDGRTKY

SEQ ID NO: 3314 - protein, 314 aa, Pseudomonas syringae pv. syringae B728a
MGGNIARRLMLNGHTTVVYDRDEASRNALANDGSTAVADLKELVGALARPRAVWVMLPAGAPTEETIQTLSQLLDADDVIIDGGNTFYKDDIRRAQELTEKGLHYVDVGTSGGVWGLERGYCMMIGGEAAVVERLDPLFATLAPGLGSIERTRDRTSTDDRAERGYIHSGPAGSGHFVKMIHNGIEYGMMQAFAEGFDLLKQKNSELLPPEQRFDLNTADIAEVWRRGSVVSSWLLDLTADALATDPHLDAFSGSVADSGEGRWTIEAAIEQAVPVPVLSSALFARFRSRQTSSYADKMLSAMRFGFGGHKEPK

SEQ ID NO: 3315 - protein, 553 aa, Zea mays
MFLQTQLAVTTEQRREPHRISAPKPLANATSPPPPDPTKRHDDLYLYLAATVTVARRHISKPSPRPPPRLATLRLRHMAHPHLVLPSPKSLLPAAATPSRRAVAIRAALSTALSPAKAAAGAEAVRSIRARQIVDSRGNPTVEVDLVAGDGRLHRSAVPSGASTGIYEALELRDGDKAVYGGKGVLQAVRNINEVIAPKLIGVDVRNQSDVDAVMLDIDGTQNKSKLGANAILGVSLSVCRAGAGAKGVPLYKHIQELAGIKELVMPVPAFNVINGGSHAGNNLAMQEFMILPVGATTFAEALRMGSEVYHVLKSIIKSKYGQDACNVGDEGGFAPNVQDNREGLILLMDAIEKAGYTGKIKIGMDVAASEFLTKDGNYDLNFKNQPNDGAHILSAQHLGDLYRDFVKDFPIVSIEDPFDQDDWSSWASLQSSVDIQIVGDDLLVTNPKRIADAIDKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 3316 - protein, 363 aa, Yersinia pestis
MTKTYHIAVLPGDGIGPEVMAQASKVLDAVRQRFGLKISTSVYDVGGAAIDRHGSPLPAATVAGCEQADAILFGSVGGPKWEHLPPAEQPERGALLPLRKHFKLFSNLRPARLYQGLEDFCPLRSDIAARGFDILCVRELTGGIYFGQPKGREGQGMHERAFDTEVYHRFEIERIARIAFESARKRRSKVTSIDKANVLQSSILWREVVNGIAADYPDVALSHMYIDNATMQLIKDPSQFDVLLCSNLFGDILSDECAMITGSMGMLPSASLNEQGFGLYEPAGGSAPDIAGKNIANPIAQILSLTLLLRFSLGKDDAADAIERAINQALEQGYRTADLAGDGHAIGTHEMGDIIAKFVVEGV

SEQ ID NO: 3317 - protein, 210 aa, Oryza sativa (japonica cultivar-group)
MVMVTAAAARRRPSLGRQKIEIRRIESEEARQVCFSKRRAGFFKKASELSILCSADVAAVVFSPAGKAYSFGHPSVEFLLDRFLSSSLPATAGKEEGSSVSVVAELNRQYGELRAMVDAHKARRERAEKTMEKQRQRQPAAWMDPEAEVGRMAPEELMALGTKLVAVQGGVAARADQMLRDALLLGRRPNTTTTTTTRAPPGFFHLHPHF

SEQ ID NO: 3318 - protein, 335 aa, Saccharomyces cerevisiae
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKMYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 3319 - protein, 475 aa, Rickettsia montanensis
MNLLKNITGKNYINGEFIEFGKQISVINPATLKEIATVPNLGLSEINSAINNTVTSFSSWSQSSFEARIAILRRWYNLVIENIEELSHILTLEQGKVLAESKKEILYGVSFIDWYTYAIHNIHSTIKPGNSKAHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGSTNVGKILYQNAANTLKRLSLELGGNAPFIITADNNLEKVVSDLITAKTRNSGQSCISPNRIFIEESIYEKFIEILKAKFTKLKAGDGFDKESDVGPLINSAAIEKIQKLLADAQSKGAKLICGGKAVDNFIEPTIIIDCLDNMDIFRTEIFGPVVACYKFKDLDEVIERANNTEYGLQGYVYSNNISVVQMIASKLDFGMVSINDPLPANAKAPFAGRKASGFGVEGSFEGIFEYLNTKYINLQH

SEQ ID NO: 3320 - protein, 267 aa, Glycine max
  unsure (1)..(267): unsure at all Xaa locations
MEGSVNERLDFGKMGYGCNHYRRRCRIRAPCCNEIYSCRHCHNDAASLLKNPFDRHELVRQDVKQVVCSVCDTEQPVAQVCTNCGVKMGEYFCNICKFFDDDVEKEQFHCDDCGICTVGGRNNFFHCKNXGSCYATALRSNHSYIDNSMQPHLPISYQYLFDSLKDVIVMKCGHTMHHECYLEMIKNDKYCCPICSKSVIDMSKTWKRIDEEIEATVMPQDYRNRKVWILCNDCNDTTEVYFHILGQKCGHCRSYNTRTVAPPVLPQ

SEQ ID NO: 3321 - protein, 541 aa, Oryza sativa (japonica cultivar-group)
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFFSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSMAQVHEDITDGLTEGDDEVVRSRRGVRWWMLWRRRRLGRNGIAVGRKEIK

SEQ ID NO: 3322 - protein, 359 aa, Microbulbifer degradans 2-40
MNSIRNTVPAGVVFGEQTHTLFAYAKANGFAYPAVNVVGTNSLNATLEAAKANESPVIVQLSHGGSAFFLGKGLSLEGQQNSILGAIAAAKFTHTVAEAYGVPVILHTDHAAKKLLPWIDGLLDAGEEFYEQTGKPLFSSHMLDLSEEPLEENIEICAKYLARMSRIGMTLEIELGCTGGEEDGVDNSGLDDEDLYTRPEDVAYAYKVLSAISPNFTIAASFGNVHGVYKPGNVKLRPKILRDAQSLVSETFNLPANSLDFVFHGGSGSELSDIRESIGYGVIKMNIDTDTQWAAWQGVKDYYEANHAYLQGKIGNPDGDDKPNKKYYDPRVWLRKLEESMVSRLEQSFIDLNCVNRYR

SEQ ID NO: 3323 - protein, 419 aa, Triticum aestivum
AAASFTAAKFLAPAAARSGGDRAPFPAPSAFSMRSLRHRPARRLSSVLAVSSDVLKAAPAAAAYPAVTREEALELYDDMILGRNFEDMCAQMYYRGKMFGFVHLYNGQEAVSTGFIKQLNQPDCVVSTYRDHVHALSKGVPARAVMAELFGKATGCCRGQGGSMHMFSEPHNLLGGFAFIGEGIPVATGAAFAAKYRHEVLKQSSPDGLDVTLAFFGDGTCNNGQFFDCLVGAQLWKLPIIFVVENNLWAIGMSHLRSTSDPEIWKKGPAFGMPGVHVDGMDVLKVREVAKEAIDRARRGEGPTLVECETYRFRGHSLADPDELRRPDEKSHYAARDPITSLKKYIIEQNLASEAELKSIEKKIDDVVEEAVEFADASPLPPRSQLLENVFADPKGFGIGPDGKYRCEDPKFTQGTAQV

SEQ ID NO: 3324 - protein, 214 aa, Oryza sativa
QPGRRKRRRRARSCKSREDAESQRMTHIAVERNRRRQMNEYLAVLRSLMPESYVHRGDQASIVGGAIDFVKELEQLLQSLEAQKRTLETPAAAAAAAAADGPPFARFFTYPQYGGGGGGAAAENRAGVADIEVSLVETHASIRVMAARRPGQLLKMVAGLQALRLTVLHLNVTALGSLALYSISVKVEEGCGMATVDDIAAAVHHVLCIIDAEA

SEQ ID NO: 3325 - protein, 157 aa, Magnetospirillum magnetotacticum
  unsure (1)..(157): unsure at all Xaa locations
MADQSPRLTTAFGNPVSDNQNSLTAGPRGPVLMQDYHLIEKMAHFNRERIPERVVHAKGYGAYGTFRLTKSLGEYTRAKVLTEVGKEVPMVARFSTVGGESGSADTARDPRGFALKFYTEEGNWDLVGNNTPIFFVRDAIKFSDFIRTQKRDPRTXI

SEQ ID NO: 3326 - protein, 532 aa, Adiantum capillus-veneris
MSEQGCYTDCWGAIWWIWESGIKAMAGLEGEIQTRRLRGREIPVLPPVTRSAAASAANVGYNENTRKTKVSTKRAAADDTSSRVASNVPVQHAKKRAALANLTNQSNSAITRNSSLPSKSHASAVNGKTRAAAGQVKEVQQVAQQVVEPLQEVGREPNTGRSSLANSSITFDNDENACPERATSSVGMKSRTLDVLQLVGNENKTVASLERKTQHSLYISKDTKPRARQGGLFEDCKDDNEEGGWSSKNYMDIDNHKDPQMCSAYAAEIYHHLRMAELKRRPSLNFMDTVQQDINASMRGILVDWLVEVAEEYKLVPDTLYLTISYIDRFLSGNLVTRQRLQLLGVASMLIASKYEEICAPQVDEFCYITDNTYNREEVLEMERSVLNHLHFELTGPTTKSFLRRFVRAAQAGQKSPTLQLEFLGNYLAELTLLEYGFLHFLPSMIAGAAVLVARVTLNPTWRPWNSTLQHYSGYKASELKECAKAILELQKNTKNCTLPAIREKYRQHKFKCVATLHPPASIPAEYFDDIE

SEQ ID NO: 3327 - protein, 412 aa, Escherichia coli O157:H7 EDL933
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAILESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 3328 - protein, 195 aa, Geobacter metallireducens
MQGSRQGDHHRRYLPPLQGGREKRHLAAGGTGMRAAILTLSDKGSRGERADASGPALSAWLAERGVETAHTEIIPDEADLITATLSQWADSGLYDLILTTGGTGVSPRDVTPDATMKVLDRVIPGFGEVMRMRSLEKTPHAMISRAVAGIRKQALIINLPGSPRGAIENLEAVWPAVPHAVEKIQGDTRDCAPST

SEQ ID NO: 3329 - protein, 277 aa, Triticum aestivum
  unsure (1)..(277): unsure at all Xaa locations
MGMDRTLYLWRSSEERAADMSTRRTEDGAVKCALRHFRRELVTRGLRFMAAAWGGLSPLPGAAAARVLRRPRVRPRVRGRVGKLYTYIVQPWAPTVMASSATSVAPFQGLKSTAXGLPVSRRSNXASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFXPPGCEESGKGLNSSLTTGHI

SEQ ID NO: 3330 - protein, 448 aa, Lactobacillus plantarum WCFS1
MAKQSYSKDDIRRIVKEENVNFLRLMFTDLFGTIKNVEVPVSQLDKLLDNKLMFDGSSIDGFVRIEESDMYLYPDLSTWLIMPWNTEHGKIARIICEVYTSDRKPFEGDPRNNLIRVLNDMREAGYTSFNCGTEPEFFLFKMNEKGEPTTELNDKGSYFDLSPMDLGENCRRDIALELERLGFNVEASHHEVAPGQHEIDFKYADALSAADHIQTFKLVVKTIARKYNLWATFMPKPLNGVNGSGMHVNMSLFHDQGNAFYDANDKNGLELSSDAYHFLGGLMKHARSYTAVTNPTVNSYKRLVPGYEAPVYVAWSASNRSPMIRIPSARGLSTRLELRSVDASTNPYLAFAAVLEAGLDGIKNGIEPPKSVDRNIYVMDEDERAAAGIADLPSTLHNALKEFQTDPTMKKALGPHIYQSFLEAKRLEWASYRQQVSEWERDQYMELY

SEQ ID NO: 3331 - protein, 322 aa, Staphylococcus epidermidis ATCC 12228
MKRLLIIHTGGTISMSQDQTNKVITNEENPISQHQNIISQYAEVDEINLLNIPSPHMTISNVVRLRDEIITYSKENIYDGFVITHGTDTLEETAFLIDLLIDIQEPIVITGAMRSSNEIGSDGLYNFISAIRVASSSEANHKGVMVVFNDEIHTARNVTKTHTSNINTFQSPNQGPLGVLTKNRVQFYHHPYRQTTYQYIDVNLRVPLVKAYMGMEDDVLSFYSQQHVDGIVIEALGQGNLPKSCLNGLQQCLKKNIPLVLVSRSFNGIVSPVYAYEGGGADLKNNGVIFSNGLNGPKARLKLLVGLSQDMTQNQLERYFEE

SEQ ID NO: 3332 - protein, 469 aa, Shewanella oneidensis MR-1
MSVESVLKQLEELEVKFVDLRFTDTKGKEQHVSIPSHQVDADFFEDGKMFDGSSIAGWKGINESDMVLMPDPTTFVLDPFTEETTALIRCDVLEPGTMTGYDRDPRSIAKKAEEYLRSTGIADTVLVGPEPEFFLFDDVRFGTDMSGCFVKIDAKEAAWNSGTSYEGGNTGHRPFVKGGYFPVAPVDSSQDLRSAMCLVLEEMGQVVEAHHHEVATAGQNEIATRFNTLTKKADEIQILKYVVHNMAHAYGKTATFMPKPIVGDNGSGMHVHQSLSKDGVNLFAGDKYAGLSETALYYIGGIIKHARALNAFTNPSTNSYKRLVPHFEAPVMLAYSARNRSASIRIPVVPSPKGRRIETRFPDPHANPYLGFAALLMAGIDGIQNKIHPGEAMDKDLYDLPAEEAAEIPQVATSLENALENLQADHEFLTRGGVFSEDFIQSYIALKSAEAERVARTTHPLEFEMYYSL

SEQ ID NO: 3333 - protein, 178 aa, Glycine max
  unsure (1)..(178): unsure at all Xaa locations
MASSMISSPAVTTVNRAGPGMVAPFTGLKSMAGFPTRKTNNDITSIASDGGRVQCMQVWPPVGKKKFETLSYLPDLDDAQLAKEVEYLLKXGWIPYLEFXLKHNFVYHKHNKSPIYYNKRYXTICKRAIFICTNTSHILNKRARTNTTXGNNCIRMITCGRHRQLQYISCISYERPSY

SEQ ID NO: 3334 - protein, 341 aa, Nicotiana tabacum
LLSSPNSSIYGRTSGGGGGGDCYDQSQAVVHPIVKTEGGSSISHHHHTFQYPSIIRSGYHHQTVQNHHESESSGSEVDALKAKIIAHPQCSNLLDAYMDCQKVGAPPEVVARLSAVRQEFEVRQRDSSTDRDVSKDPELDQFMEAYYDMLVKYREELTRPLHEAMDFMRKIETQLNMLGNGPVRIFNSEDKCEGVGSSEEEQDNSGGETEIPEIDPRAEDRELKNHLLRKYSGYLSSLKQELSKKKKKGKLPKDARQKLLSWWELHYKWPYPSESEKVALAETTGLDQKQINNWFINQRKRHWKPSEDMQFMVMVGLHPQNAAALYMEGHYMGEGPFRLGQ

SEQ ID NO: 3335 - protein, 310 aa, Glycine max
  unsure (1)..(310): unsure at all Xaa locations
LVPREREREREREREREREREREREREREREREREREREREREREREREREREREREREREREREQRETGKNWFQGTADAVRLFTWVFEDAKHTHIENVLILAGDHLYRMDYMDLVQSHVDRNADITVSCAAVGESRASXYGLVKADGRGRIIQFSEKPKGADLKAMQADTSLLGLPPHDALGSPYIASMGVYVFNTDVLLNLLKWRYPTSNDFGSEIIPAASYFFXDYWEDIGTIKSFYDANLALTEENPMFKFYDPKTPIYTSPRFLPPTKIDKCRIVDAIISHGCFLRECTVQHSKFLGTPNFGLWC

SEQ ID NO: 3336 - protein, 477 aa, Arabidopsis thaliana
MALTTKPHHLQRSFLSPSRVSGERYLESAPSCLRFRRSGVQCSVVAKECRVKGVKARQIIDSRGNPTVEVDLITDDLYRSAVPSGASTGIYEALELRDGDKSVYGGKGVLQAIKNINELVAPKLIGVDVRNQADVDALMLELDGTPNKSKLGANAILGVSLSVCRAGAGAKGVPLYKHIQETSGTKELVMPVPAFNVINGGSHAGNSLAMQEFMILPVGATSFSEAFQMGSEVYHTLKGIIKTKYGQDACNVGDEGGFAPNVQDNREGLVLLIDAIEKAGYTGKIKIGMDVAASEFFMKDGRYDLNFKKQPNDGAHVLSAESLADLYREFIKDFPIVSIEDPFDQDDWSSWASLQSSVDIQLVGDDLLVTNPKRIAEAIKKQSCNALLLKVNQIGTVTESIQAALDSKAAGWGVMVSHRSGETEDNFIADLSVGLASGQIKTGAPCRSERLSKYNQLLRIEEELGNVRYAGEAFRSP

SEQ ID NO: 3337 - protein, 67 aa, Oryza sativa
  unsure (1)..(67): unsure at all Xaa locations
EKEEKEQKLKVKXAIEKGNMDXARIYXENXICKRTEHMNYFCXXSXXDAVVXARXXXQXKMQVIXKS

SEQ ID NO: 3338 - protein, 336 aa, Ferroplasma acidarmanus
MQAGFLNKLNSEIILEDYEPPEPGDNEVTIEQKYTGVCFRDILTQQGFFPRVSLPVIPGHEIGGTIIKKGKNVKDFNIGDRVSSLIYVPCGKCEFCLSGNENLCPNKVAYGEGRNGGYSRYVNADERSLVKVPPEVPEETVPIAACVIAMLYHAIGRVGKIKKGDYVLITGAGGGVGVHAVQMVKALGGHPIAETGSKWKEEELYKLGAEYVVSPEREYNKDVKEITGQGADIVLEDVGIATFSKSLRSLKTGGRLVVIGNLKPEPVELPLGLIILKGNSIKGSISSTRDDLKKALELSKSQISPVIGNKIELQDINDGYANMLDRKVLGRLLIKF

SEQ ID NO: 3339 - protein, 204 aa, Pichia pastoris
MASRGTSRQQYDLTMKLLLVGDSGVGKSCLLLRFVDDSFNPSFITTIGIDFKIRTVEINGKKVKLQIWDTAGQERFRTITTAYYRGAMGIILVYDVTDERSFNSVHNWYQTLNQHANEDAQLFLVGNKCDDEESRQVTKEQGEQLASELGVPFLEASAKSNKNVDAIFLELAKRFEEKMRNTQQGPGSAGIDVNSSNDTKSSCC

SEQ ID NO: 3340 - protein, 242 aa, Neisseria meningitidis Z2491
MTTYRIAPSILSADFARLGEEVESVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYLLENVLDRLDMVLLMSVNPGFGGQSFIPYTLEKIRQVRAMLDRYEEKSGRRIAIEVDGGIKTDNIAAAAQAGADTFVAGSAIFGKPDYKAVIDAMRAELEKSGRLNLAPMIEIEMPSEN

SEQ ID NO: 3341 - protein, 68 aa, Zea mays
  unsure (1)..(68): unsure at all Xaa locations
FFLLPFSHFARPFTSQYEAKLLPGLIYRMKQPKIALLIFVSGKIVLTRAKMRDEXVAFEIIYPVLIKS

SEQ ID NO: 3342 - protein, 345 aa, Glycine max
MSGLIERLPDAVAIRCLARVPFYFHPVLELVSRSWQAAIRSPELFKARQEVGSTEDLLCVCAFDPENLWQLYDPMRDLWITLPVLPSKIRHLSNFGAVSTAGKLFVIGGGSDAVDPLTGDQDGCFATDEVWSYDPVVRQWAPRASMLVPRSMFACCVLNGKIVVAGGFTSCRKSISQAEMYDPDKDVWIPMPDLHRTHNSACSGVVIGGKVHVLHKDLSTVQVLDNAGPGWTVEECVWLQGQMAVVGDALYVMSHGLIFKQDKEVRKVVGSASEFRKRIGFAMTGLGDDLYVIGGFIGPDRWNWDIKPLSEVDVLTLGSERPTWRQAAPMTRCHGPILGCTLLRI

SEQ ID NO: 3343 - protein, 333 aa, Streptomyces coelicolor A3(2)
MTRPVVEGGPAVVCLGETMAQIVPIDGLRLHEASACAFGVAGAESNVAISLSRLGTAAFWAGFVGDDPMGLRVLGELRRHGVVTKLARTMPGRRTGVYFKDPAPEGSDIYYYRSGSAATLMDGEYAERIAAVRPRWIHLTGVTPALSENCREAVISLIELAGDTGASVSFDVNYRPSLWPARDAAAQSLMAIADRCNVVFVGLDEAQTLWKSCTAGAVRDHLPSPDVVVVKDGGREAVAFRGGRRTAVPALPVDVVEPVGAGDAFAAGWIHGALVGLDEAGCLRLGHLLAGAAMTSLSDVADLPTAPAALVARAKHGNEWPGHGSPAEASPHP

SEQ ID NO: 3344 - protein, 255 aa, Glycine max
  unsure (1)..(255): unsure at all Xaa locations
DIFFQCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKXGKIYSVNEGNAKNWDRPTATYVEKCKFPEDGSSPKSLRYIGSMVADVHRTLLYGGIFLYPADKKXPNGKLRVLYEVFPMSFLMEQAGGQSFTGKERALDLVPTKLHERSPIFLGSYDDVEEIKALYAAAEGEQE

SEQ ID NO: 3345 - protein, 399 aa, Streptomyces coelicolor A3(2)
MLGIVLAGGEGKRLMPLTADRAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSFGVITPGSDGQTVTGFLEKPADPPGLADDPGCVFASMGNYVFTTKALVEALHRDAEDPDSVHDMGGSILPQLTDRGEAALYDFSANHVPGETTRDQGYWRDVGTLDAYYDAHMDLIAERPAFNLYNRDWPVYTHSTQLSPARFNAGGIASESIISAGCLIRGQVTRSVLSPGVVVDPGAVVQGSVLHDNVHIGRGAVVRGAVLDKNVQVPPGATIGVNPQRDGELYTVSKGGVIALGKGQRVP

SEQ ID NO: 3346 - protein, 838 aa, Streptomyces narbonensis
MHQAQREKSTVTGKTRIPRVRRSRTTPRAFTLAVVGTLLAGTTVAAAAPGAAGTGHVQYTSKAAELVAQMTLDEKISFVHWALDPDRQNVGYLPGVPRLGIPELRAADGPNGIRLVGRTATALPAPVALASTFDDSMADSYGRVMGRDGRALGQDMVLGPMMNNIRVPHGGRNYETFSEDPLVSSRTAVAQIKGIQGAGLMTTAKHFAANNQENNRFSVNATVDEQTLREIEFPAFEASSKAGAASFMCAYNGVNGKPSCGNDELLNNVLRTQWGFQGWVMSDWLATPGTDAITKGLDQEMGVELPGDIPPGEPSPPAKFFGDALKQAVLNGTVPEAAVTRSAERIVNQMDKFGLLLATPAPRPERDKAGAQAVSRKVAENGAVLLRNEGQALPLAGDAGKSIAVIGPTAVDPKVTGLGSAHVVPDSAAAPLDTIKARAGAGATVTYETGEETFGTRIPAAQLSPAFNQGHQLEPGKAGALYDGTLTVPADGEYRISVKATGGYATVQLGSHTIEAGQVYGKVSSPLLKLTKGTHKLTISGFAMSATPLSLELGWVTPEAADATIAKAVESARKARTAIVFAYDDGTEGVDRPNLSLPGTQDKLISAVADANPNTIVVLNTGSSVLMPWLSKTRAVLDMWYPGQAGAEATAALLYGDVNPSGKLTQSFPAAENQHAVAGDPNRYPGVDNQQTYSEGIHVGYRWFDKENVKPLFPFGHGLSYTSFTQSAPTVVRTSTGGLKVTVTVRNSGQRAGQEVVQAYLGASPKVTAPQAEKKLVGYTKVALAAGESKTVTVNVDRRQLQYWDAASDSWRTGTGSRLLQTGSSSADLKNSSQVTVW

SEQ ID NO: 3347 - protein, 457 aa, Sphacelaria caespitula
  unsure (1)..(457): unsure at all Xaa locations
DYNVKDTDILALFRITPQPGVDPVEAAAAVAGESSTATWTVXWTDLLTACDIYRAKAYRVDPVPGTSDQFFAYIAYECDLFEEGSLANLTASIIGNVFGFKAVKALRLEDMRIPFAYLKTFQGPATGLIVERERLDKFGRPFLGATVKPKLGLSGKNYGRVVYEGLRGGLDFLKDDENINSQPFMRWKERFLYCMEGVNRAAAATGEVKGSYLNVTAATMEQIYERAEYAESVGTVIVMIDLVIGYTAIQTMAIWARKAQMILHLHRAGNSTYARQKNHGINFRVICKWMRMSGVDHIHAGTVVGKLEGDPLMVRGFYNSLLLTELKVNLAEGLFFDMDWASLRKCVPVASGGIHCGQMHQLLYYLGDDVVLQFGGGTIGHPDGIQSGATANRVALEAMVLARNEERDYVAEGPEILRAAARTCGPLKAALDLWKDITFEYTSTDTPDFVEVATESN

SEQ ID NO: 3348 - protein, 187 aa, Oryza sativa
  unsure (1)..(187): unsure at all Xaa locations
MASPSSSSSLCSTFASPRAASLGRRLAFSSPRKAFRVRASSRVDILLAFHCEQSXSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQKPVAVPA

SEQ ID NO: 3349 - protein, 336 aa, Streptomyces coelicolor A3(2)
MTIRVGINGFGRIGRNYFRALLEQGADIEIVAVNDLGDTATTAHLLKYDTILGRLKAEVSHTEDTITVDGKTIKVLSERNPADIPWGELGVDIVIESTGIFTKKADAEKHIAGGAKKVLISAPAKDEDITIVMGVNQDKYDPANHHVISNASCTTNCVAPMAKVLDENFGIVKGLMTTVHAYTNDQRILDFPHKDLRRARAAAENIIPTTTGAAKATALVLPQLKGKLDGIAMRVPVPTGSATDLVVELQREVTKDEVNAAFKKAADDGDLKGILFYTEDAIVSSDITGDPASCTFDSSLTMVQEGKSVKILGWYDNEWGYSNRLVDLTVFVGNQL

SEQ ID NO: 3350 - protein, 182 aa, Triticum aestivum
MYLHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRNWTMWKLPMFGCTDATQVINEVEEVKKEYPDAYVRIIGFDNMRQVQCVSFIAFKPPGCEEFGKA

SEQ ID NO: 3351 - protein, 500 aa, Triticum aestivum
RASPPSESRAPLRAPQRSATRQHQARQGPRRMCNGGRGPPYWTAGVTSAPARQTPLFSGRPSGGLSDPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAWRKIIWVLEDYYKNKSIEHILILSGDQLYRMDYMELVQKHVDDNADITLSCAPVGESRASEYGLVKFDSSGRVVQFSEQPKGDDLEAMKVDTSFLNFAIDDPAKYPYIASMGVYVFKRDVLLNLLKSRYAELHDFGSEILPRALHDHNVQAYVFTDYWEDIGTIRSFFDANRALCEQPPKFEFYDPKTPFFTSPRYLPPTKSDKCRIKEAIILHGCFLRECKIEHTAFSRLNSGSELKNAMMMGADSYETEDEMSRLMSEGKVPIGVGENTKISNCIIDMNARIGRDVVISNKEGVQEADRPEEGYYIRSGIVVIQKNATIKDGTVV

SEQ ID NO: 3352 - protein, 444 aa, Zea mays
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 3353 - protein, 235 aa, Tradescantia virginiana
VQLKRMENKINRQVTFSKRRTGLLKKAHEISVLCDAEVGLIIFSTKGKLYEYSTDNSMAKILERYDRYATAERAVLEANLNLEVGSHYEYRKIKAKVDALQKSQRHLMGEQLDTMTNKELQQLEQQLETALKHIRSRKNQMMLESVAALQKKEKALREQKSILEKKLIEKQKDMEISQIHQYQAHEDNTSPTSLVLTNSLPTTLNTNGCITHAIEEEHAPTLPHTNNNNLPPWMV

SEQ ID NO: 3354 - protein, 365 aa, Bradyrhizobium japonicum USDA 110
MIAPALQFWGNVMQLIVLPGDGIGPEITTATSGVLRAASERFQLNLRLEEHAVGHASLKQFGTTVRPELLDIVRGADGLILGPTATFDFKDEAHGEINPSRHFRKNLDLYANVRPARTYAGRPGRLGDFDLVVVRENTEGFYADRNMEQGNGEMLVTPDVAISLRRITRACCERIAHAACRLAMKRRRHLTIVHKANVLKIGDGMFLDICRAAAKGYAGLEVDDILVDAMMAHVVRNPDRFDVIVATNMFGDILSDLTAELSGSLGLGGSLNVGDRYAMAQAAHGSAPDIAGQDVANPVSLILSTALLLAWHGERSGAVRYEEAARAIEAAVAKAIGEGRATRDVGGRLGTIAAGAAIAEILQGA

SEQ ID NO: 3355 - protein, 549 aa, Ferroplasma acidarmanus
MPTVADVIIKTLVNFGVKRIYAIPGDSLNPIIDAIRRNKDIKYVQVRHEEGGALSASYESKYTGNLAACMGTSGPGSIHLLNGLYDAKTQHVPVIALTGQVETELLHHDYFQEVNLVKLFDDVSVFNARIITPDNAHYLIWKACREAITKKGVGHIDMPVDILMESCKEEDLSYYINPVNYNPGGLDEAVNLINNRNKPVIMIGGGSRNYRGEIDEFAEKIGAPIIYSLNGKGVFNDTDKKVMGGIGLLGTKPSIKAIEKSDLIIFLGTIFPYTQFLKNVDNIQVNTNIDDLNKIMKANYSYLCDIKYFLDNINVNEKDKKFYQEMQDEKAKWSEDMVRLASNHKNPIRAELLTDKISKKIEDDAIIITDTGNVTLWSNRFLNAGNNNKFYFSSWLGTMGSGIPGSVGLAFASGKKICGLIGDGSFAMTVMELITIKKYNLPVKLIVYDNSILGMIKLEEEVMGYPEYGVDLYNPDFAKLAESIGITGIRVDTVEALDAGIDKFFKCDGPAVLDVVTETNETPMPPKLNFKVAEKYVTSILKEKLETKD

SEQ ID NO: 3356 - protein, 148 aa, Zea mays
  unsure (1)..(148): unsure at all Xaa locations
MSVCVTGGRQGQVVLAMVFDDARLGGIASSIRVIPDFSKSGIMFXDITTLLLDPKAVRDIIDLFDERHQEQGITVGAGVQARGFSFGHPIGXANDAKFVVLLKSKNLPSVAIFEEYALEYGREQIEVHASVVRATQRALVLDELIATA

SEQ ID NO: 3357 - protein, 551 aa, Methanosarcina acetivorans C2A
MLGKTKRYLEVIKVLLKYNLIPELYRELRTDYISNTDCTCAFDVENRKTAVKLRQAFEELGPTFIKMGQTMSKRPDLVPQPYVIEMANLQDRVKPLLFEEMAESLDLACICEYISPEDRNRKKTEEELKASKERRAKAFIEIFDSFDTNPIASGSIAQVYRGVIEGKPVAVKILRPNLIDTINIDLSILDDFKPVIKKVLGVGKKFDFDAFLREIREMLTREVDLRIEAVSMRRFEDNFKNVKNVAVPKICPEYCSVNVLTMEFIQGTQIKDIIDMPVPQSKKSEYTRTITKSYLKQVYIDGFYHADPHGGNMLVEEDDTIAFIDFGAVDSIDDELKKNMLEFYYAINNRDVEGATQGFLRIGGADPRDVDVCRLRKDMDDLIANQNYGLEGRQSDNYAKLGLKYDIRLPGEFSTLQRAILLIEGVCLELDPRYNIKTIAIPVLMDAYKKLDSSRGTALHIEFSTEPVDEKAELRATIRELADKMEDMGDRFLEGKQKESKRSVFSREFFLSVLLVVSAYILLYGDTFSWIGLLGFGVTVLIALITSLHRE

SEQ ID NO: 3358 - protein, 502 aa, Solanum tuberosum
MQFLSLASIFLFLSFLFLLRKWKNSNSQSKKLPPGPWKLPLLGSMLHMAGGLPHHVLRDLAKKYGPLMHLQLGEVSAVVVTSPDMAKEVLKTHDIAFASRPKLLAPEIVCYNRSDIAFCPYGDYWRQMRKICVLELLSAKNVRSYGSIRRDEVDRLVNFIRSSSGEPVNFTERLFLFTSSMTCRSAFGKVFKEQDKFIQLIKEVIGLAGGFDVADIFPSLKFLHVLSGMKGKIMNAHHKVDAIVEDVINEHKKKFAIGKTNGALGGEDLIDVLIRLMNDGGLQFPITNDNIKAIIFDMFAAGTETSSSTLVWAMVQMMKNPSVIAKAQAEVREAFKDKETFDENDVEELKYLKLVIKETLRLHPPVPLLVPRECREETDINGYTIPVKTKVMVNVWALGRDPKYWDDAESFKPERFEQRSVDFVGNNFEYLPFGGGRRICPGISFGLANVYLPLAHLLYHFDWKLPIGMEPKDLNLTELVGVTAARKDDLILVATPYEPPRQ

SEQ ID NO: 3359 - protein, 375 aa, Oryza sativa (japonica cultivar-group)
MPASDPAPAAAAAAYDRTAELRALDATLSGVRGLVASGATHLPRIFHNVVHGDQEPPEATAPSSAATTTTTVPVIDISGSRAAVVDAVRRAAAEWGFFQVTGHGVPLAAMDAAAGAARAFHESGGGEGSDKARLYSREPGRAVKYHCNFDLYQSPVANWRDTLYLRMAPDPPPAADLPEICRDALFEYAKQVKNLGNTLFELLSEGLGLKPSYLTDIECNQGQIILCHYYPPCPQPELAIGTSRHSDSGFLTILLQDDIGGLQILHEDRWVDVTPTPGAFIVNVADLLQLISNDNYKSVEHRVVAKNTEPRVSIACFFSTHFHPISTRMYGPIKELLSDENPPLYREALVRDYTARYYSVGLDGKFKTTLSEFRL

SEQ ID NO: 3360 - protein, 429 aa, Pseudomonas putida KT2440
MTSVPSSIEQPSRPLTRSDYKTLSLSALGGALEFYDFIIFVFFATVVGKLFFPADMPEWLRLMQTFGIFAAGYLARPLGGIIMAHFGDLLGRKKMFTLSIFMMALPTLIMGLLPTYAQIGMWAPILLLLMRVIQGAAIGGEVPGAWVFVSEHVPARNTGYACGTLTAGLTAGILLGSLVATLINSVYSAEEVADYAWRIPFLLGGVFGLFSVYLRRWLHETPVFAEMQQRKALAEELPLRAVLRDHRGPIILSMLLTWMLSAGIVVVILMTPALLQSIYHISPTDSLKANSLAIVLLSFGCIGAGSLADRYGAGRVFVIGSLLLLVSSWVFYHSLPTRPELLFPLYAVTGLCVGVIGAVPYVMVKAFPAVVRFSGLSFSYNVAYAIFGGLTPMVVTALLKVSPMAPAYYVAGLCAVGLAVGLYLLANKR

SEQ ID NO: 3361 - protein, 336 aa, Pseudomonas putida KT2440
MKAAVVAPGRRVDVIEKSLRPLEHGEALLKMQCCGVCHTDLHVKNGDFGDKTGVVLGHEGIGVVQEVGPGVTSLKPGDRASVAWFYQGCGHCEYCNSGNETLCRDVKNSGYTVDGGMAEACIVKADYSVKVPDGLDSAAASSITCAGVTTYKAVKISNVRPGQWIAIYGLGGLGNLALQYAKNVFNAKVIAIDVNEEQLRFASEMGADLVVNPLNEDAAKVIQAKTGGAHAAVVTAVAKGAFNSAVDALRAGGRLVAVGLPSESMDLNIPRLVLDGIEVVGSLVGTRQDLQEAFQFAAEGKVVPKVTLRPIEDINQIFDEMLEGKIKGRMVIQFEG

SEQ ID NO: 3362 - protein, 113 aa, Triticum aestivum
  unsure (1)..(113): unsure at all Xaa locations
AARILQRDHGINVNLTLMFSQVQAIAAAEAGTFLISPFVGRILDWYKAKTGKTYSKEEDPGVELLRKYSDYYKKLGYKTIRHGCLIQEILGEITELAXGCDYLTSLPNLLEEF

SEQ ID NO: 3363 - protein, 159 aa, Frankia sp. FE19
ITKEQYSRDPRNIAKKAETYLRGTGIADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRFDTLLKTADNLMLYKYVIRNVARIRGKTV

SEQ ID NO: 3364 - protein, 533 aa, Corynebacterium efficiens YS-314
MKVMAQIAMIMNLDKCIGCHTCSVTCKQAWTNREGTEYIWFNNVETRPGVGYPRGWEDQDKWEGGWVRTNSGKLKPKAGGRLKKLATIFHNPKLPTIDDYYVPWSYDYDKLLSAPAGQATQPTARPISQLDGRPIDKIEWSSNWDDNLGGSHATMDEDPVLEKMNLQVAKEIEDSFMFYLPRICEHCLNPTCVSSCPSGAMYKRAEDGIVLVDQDHCRGWRMCVSGCPYKKVYFNHKSGKAEKCTLCYPRLEVGQPTVCSETCVGRLRYLGVLLYDADRVAEVAATPNEQDLFEAQKTLFLDPHDPEIIAAAEREGIPHTWIEAAQQSPIYDLIFTYELALPLHPEYRTLPMVWYIPPLSPIVDEVTASGNDGEDHRILLTALSTMRIPLEYLAGLFTAGDTRPVEKSLRRLAAMRSYMRDINLGNEPQEEIAQAVGMDGKKMQQMYRLLAIAKYDDRYVIPTASPETPRGIQGLDPFGNVDPIGAAESLNVGLGEGAPEACESGVPAAAGRVSLASWNPGERPDSMFPNRQG

SEQ ID NO: 3365 - protein, 462 aa, Zea mays
DLYQQSIAAVCNLDWPKSNFLVQVLDDSDDPLTQTLIREEVAKWQQQGARIVYRHRVLRDGYKAGNLKSAMSCSYVKEYEFVAIFDADFQPHPDFLKRTVPHFKDNDELGLVQARWSFVNKDENLLTRLQYINLCFHFEVEQQVNGVFLNFFGFNGTAGVWRIKALEDSGGWLERTTVEDMDIAVRAHLHGWKFIFLNDVECQCELPESYEAYRKQQHRWHSGPMQLFRLCLPDIIKCKIAFWKKANLIFLFFLLRKLILPFYSFTLFCIILPMTMFVPEAELPDWVVCYVPALMSLLNILPSPKSFPFIIPYLLFENTMSVTKFNAMISGLFQLGSAYEWVVTKKSGRSSEGDLIALAPPKEPVKLHATRTGSAPNLDAVAKEEHLAAASRKDAAAAAATVKKKKEKHNRIYKKELALSMLLLTAAARGLLSKQGIHFYFLLVQGVSFLLVVLDLIGEQVE

SEQ ID NO: 3366 - protein, 605 aa, GIBBERELLA ZEAE PH-1
MVLEAYTYVFAIGSCFALLEAYNNGANDVANAWATSVSSRSVTYRGAMVLCCIFEMLGALTVGARTASTIKNGIIPMEAFRDNAGVQLLAFACASAGASTWVMWCTKHNAHVSSTYSLISSLAGVGIATVGASQVQWGWNGGQGLGAIFAGLGMAPTIAGVFASVIFLLVKYVVHVRKNPVQWAVWTSPFFFLIAGTVCTLSIVYKGSPRLGLTEKPAWYIAALTLGVGWGLFFMSAIFFVPFVHAVVIKKDYTLRWWDAWRGPLLFSRPAPPDAENARVPNYAVVQHGSDMEVVSHETEEHNPKKASDDEIAPATAASSENNEKRHLNLSESTQEDYQRMVKDAEEIHHSNLRKGKGPLGWAMRTLHANPIGAGSIHETHNLIAVLKRIPAQIVVAFLYGAHYDIHTAQMGIEATPEGRRMARVYEHAPKYPNEVEYLYSFVQIITACTASFAHGANDVGNAVGVWAGMYAAWSTSRPAEKKAEVPLWQIGVVAAMICIGFITYGYNIMKVMGNKITYHSPSRGSSMEMGAAITVLVFSQYKLPVSTSMCITGATVGVGLCNGSIKAVNWKRVFLLVFSWIMTIPIAGLIGGCLMALALNAPHF

SEQ ID NO: 3367 - protein, 357 aa, Helianthus tuberosus
MAILSPYSSSFLDTLFCNEQQDHEYHEYEYEDEFTQTTLTDSSDLHLPPLDQLDLSWEHEELVSLFTKEQEQQKQTPCTLSFGKTSPSVFAARKEAVDWILKVKSCYGFTPLTAILAINYLDRFLSSLHFQEDKPWMIQLVAVSCLSLAAKVEETQVPLLLDLQVEDTKYLFEAKNIQKMELLVMSTLKWRMNPVTPISFLDHIVRRLGLTDHVHWDFFKKCEAMILCLVSDSRFVCYKPSVLATATMLHVVDEIDPPNCIDYKSQLLDLLKTTKDDINECYELIVELAYDHHNKRKHDANETTTNPVSPAGVIDFTCDESSNESWELNAHHFREPSFKKTRMDSTIRVRVWFTYKL

SEQ ID NO: 3368 - protein, 295 aa, Bacillus cereus ATCC 14579
MTNVTGTERVKRGMAEMQKGGVIMDVVNAEQAKIAEEAGAVAVMALERVPADIRAAGGVSRMADPTIVEEVMGAVSIPVMAKCRIGHLVEARVLESLGVDYIDESEVLTPADEVYHLNKRDYTVPFVCGCRDIGEAARRIAEGASMLRTKGEPGTGNIVEAVRHMRQVNAEIRQVASLREDELMTYAKNTGAPYEVLLEIKRLGRLPVVNFAAGGVATPADAALMMQLGADGVFVGSGIFKSENPEKFARAIVEATTHYEDYELIASLSKGLGNAMKGVEISTLLPEQRMQERGW

SEQ ID NO: 3369 - protein, 506 aa, Azotobacter vinelandii
MRYAHPGSEGAIVSYKVRYGNYIAGQFVPPVKGQYFTNSSPVTGEEFTEFPRSTAEDIEKALDAAHAAAGAWGRTSVQERAAVLLKIADRIEQNLEVLAVTETWDNGKPVRETLNADVPLSADHFRYYAGCIRAQEGSAGEINENTVAYHFHEPLGVVGQIIPWNFPLLMAAWKLAPALAAGNCIVLKPAEQTPLSITVLVELIGDLLPPGVLNIVQGFGREAGEALATSKRIAKIAFTGSTPVGAHILKCAAENIIPSTVELGGKSPNIFFEDIMQAEPAFIEKAAEGLVLAFFNQGEVCTCPSRALIQESIYDDFMKVVMKKVGQIKRGHPLDTDTMVGAQASSQQFEKILSYLEIARGEGAEVLTGGAAERLEGSLASGYYIQPTLLKGHNKMRVFQEEIFGPVVGVTTFKDEAEALAIANDTEFGLGAGLWTRDINRAYRMGRGIQAGRVWTNCYHLYPAHAAFGGYKKSGVGRETHKMMLDHYQQTKNLLVSYDINPLGFF

SEQ ID NO: 3370 - protein, 169 aa, Oryza sativa
  unsure (1)..(169): unsure at all Xaa locations
SGGARRERRTTKRGERXEAGAGRAQTRDNEKXGXSSRXARDRRGEEEQGEXAKRGGGTKHFXLPXDTLAAPPEDGEETRPPXNKPAXRKXNGGPGTTRGGTGPKPATEGRNGXTGRDXTATQSEAXNTKXGSKGPPPPRNAPNTQEDTXKTAEKDTKPNKEXQTRKQSQ

SEQ ID NO: 3371 - protein, 623 aa, Amaranthus hypochondriacus
MLVLCSRSRLTSSLIRRLKDQIANVSNHRSFATSEGHRLAIVNKRSLDILQDPWFNKGTAFSMTERDRLDLRGLLPPNVMTTEQQIERFTADLRVLELTTKDGPSDTYDLAKWRILNRLHDRNETMFFKVLIENIEEYAPIVSTPTVGLVCQKFSGLYRRPRGMYFSSDDRGEMMSMVYNWPAEQVDMIVVTDGSRILGLGDLGVHGIGVAIGKLDLYVAAAGINPQRVLPVMIDVGTNNEDLLKNPLYLGLQKKRLDGEEYLAVMDEFMEAVFTRWPNVIVQFEDIQNKWALTLLQRYRHKYRTFNVDVQGTSGVAIAGLLGAVRAQGRPMIDFPKQKIVVAGAGSSGVGVLNAARKTMARMLGNDESAFDRARSQFWVVDDKGLITEKRANLDPEVQPFAWKENEISLQGLNEGAKLVEVVRQVKPDVLLGLSAYGGLFSKEVLEALKDSTSTRPAIFAMSNPTKNAECTPEEAFSIVGDHVVYASGSPFKDVDLGNGKIGHVNQGNNMYLFPGIGLGVLLSGSRIISDSMFQAAAERLAGYMTDEEVINGVIYPSISRIRDITKEVAAAVIKEAVEEDLAEGYRDMDARELQKLNEEQILEYIEKNMWNPEYPTLVYKKR

SEQ ID NO: 3372 - protein, 361 aa, Xanthomonas axonopodis pv. citri str. 306
MSVSFASTRSPSPRSADELSVILAAPGFGLHFTDHMVAISWNNEQGWHDAQVRAYGPLQLDPAASVLHYGQEIFEGIKAYRHADGSIWTFRPQANGERLQRSARRLALPELPVDLFVESLRQLVAVDGGWVPSAPETSLYFRPFMIADEAFLGVRAAHKASYYVIASPAGPYFAKGVAPVSIWLSTEYARAAKGGTGAAKCGGNYAASLLPQQKAYAQGCSQVLFLDPVEGKYIEELGGMNVFLVYKDGTLVTPELSGSILEGITRDSILQLARDRGMQVIERKVAIDEWKQGVASGEITEVFACGTAAVVTPIGELKGEGFAVGDLSAPAGQVTMSLRQELTDIQYGRVPDRHGWLVRLS

SEQ ID NO: 3373 - protein, 166 aa, Glycine max
DGYVEVLAATQTPGEAGKKWFQGTADAVRQFHWLFEDPRSKDIEDVLILSGDHLYRMDYMDFVQNHRESGAYITLSCLPMDDSRASDFGLMRIDNKGRILLFSGNPKGDELDSMHVDSTVFAPSKMCLYDTIIRSLEVPSSRGNTFNLYYGISHGIVSDHSSSSSV

SEQ ID NO: 3374 - protein, 90 aa, Salmonella enterica
SLAKNGTNLFSGDKYAGLSEQALYYIGGVIKHAKAINALANPTTNSYKRLVPGYEAPVMLAYSARNRSASIRIPVVASPKARRIEVRFPD

SEQ ID NO: 3375 - protein, 463 aa, Variovorax paradoxus
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFIAMSLPESIKYLVLSGQKPEAVARVVNAIDPSIRASSQTRFVLGTAEEGARIAGWKDSVKALFGGQLSKITPALWGAFVCSSVTVFFLASWIPVLTVGTGRSASLAAVGLALFSAGGAFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 3376 - protein, 757 aa, Arabidopsis thaliana [sequence omitted]

SEQ ID NO: 3377 - protein, 307 aa, Petunia x hybrida
MDQYEKVEKIGEGTYGVVYKARDRVTNETIALKKIRLEQEDEGVPSTAIREISLLKEMQHANIVRLQDVVHTVKSDCILSFEYLDLDLKKHMDSSPEFSKDPRLVKMFLYQILRGIAYCHSHRVLHRVLHRDLKPQNLLIGRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSALPKWPSKDLATIVPNLDGAGLDLLDKTVRLDPSKRITARNALEHEYFKDIGYVFRSKGSSRV

SEQ ID NO: 3378 - protein, 289 aa, ASPERGILLUS NIDULANS FGSC A4
MRVLVNKHVFMQPQPGHYAHTRMSMLLLKPKTKDLLSHRLDDVFRSASREADALAAARYREPERGAPTGFNLAFNTDKNFWEYITNDDPQRGERFARAMHAVNINSLDVIPRLYPFDSLVVDGGLIVDVGGGQGQVAKRILEYFPSSGLRCIVQDRYVVNASSPGPAVVEMQQHDFFEAQPVKGAAAYFFRHIFHDWPDKACAAILKQTARAMDKDRSRILICDQVLQDDVPAEASLLYDIDMMSLFGGKERSLAEWKYLIASAEESLHIVNVIFSTESEAAILDVRIK

SEQ ID NO: 3379 - protein, 118 aa, Triticum aestivum
  unsure (1)..(118): unsure at all Xaa locations
MVARRWAVAVAAAALAAGAGWLGGVSEKDRPLNTHSTPSTEASLSRVCFAQSPRDRAGSAAQDPPLRRSXHARLIIDAPDLHIRYLKSGPENLKKEIERRSSYALSRQDIEIAILGGP

SEQ ID NO: 3380 - protein, 344 aa, Escherichia coli
TPDCYQAADWRHRGYHAVELPGGDDYPQSRSGAGSRLHHGAEARQSDAVLCLALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 3381 - protein, 333 aa, Ascophyllum nodosum
MVNVAINGFGRIGRLVLRAAKHNKHINVVAVNDPFVPPDYMNYMFKYDTVHGVYDGTVENDDSSIIVDGKKIKVFGEMDAANVKFGDVGADYVVESTGLFTTTESAAVHLKGGAKKVVISAPSQDAPMFVMGVNQDKYTPDMDVVSNASCTTNCLAPIAKVINDSFGLKEGLMTTVHAVTATQKTVDGPSKKDWRGGRAAGFNIIPSSTGAAKAVGKVIPELNGKLTGMSFRIPTANVSVVDLTCRLEKPASYEEIKAAMKAASEGPMHGILGYTEDSVVSSDFIGDSRSSILDANAGIALSDTFVKLVSWYDNEWGYSCRVLDLITHMDKSS

SEQ ID NO: 3382 - protein, 192 aa, Lolium perenne
SRSAEKMYKIDSHLACAVAGIMSDANILINTARLHAQRYSLSYQEPIPVEQLVQSLCDTKQGYTQFGGLRPFGVSFLFAGWDKKHGFQLYMSDPSGNYSGWKASAVGANSQAAQSMLKQDYRDGMTREEAVALALKVLSKTMDSTSLTAEKLELAEVFLHPGTGEVQYQVCTPDAMGKLLAKAGLTQPAPEA

SEQ ID NO: 3383 - protein, 206 aa, Oryza sativa
MSVVAAAAAAVAVAPPSSPYGMCGGGGGGGGARKRKDVVQQLEDLAGGVVGDDGGGGGGGGDVVHGLFVLETVEEKAEEEEEERSSIGADSEDEQDDGEEEVESKASSAAVAAETCRRKTKTKRGLSNFFSGKSRSFANLQDVAAAGATTASLAKPENPFNKRRRILRCSSIRRVSSTSLTALPPFLPPHHHPPPPDDGGGGGGNG

SEQ ID NO: 3384 - protein, 123 aa, Zea mays
  unsure (1)..(123): unsure at all Xaa locations
MSGAGEEDKKPAEGGAHINLKVKGQDGNAVFFRIKRSTQLKKLMNAYCDRQSVDMNAIAFLFDGRRLRGEQTPDEVIQFGFRSQHXSGILDRXDLLPVQLEMEDGDEIDAMLHQTGGSVPSTT

SEQ ID NO: 3385 - protein, 303 aa, Streptomyces avermitilis MA-4680
MAAPPKHPNTSSRRDHDKLARTQPLTGRVIAVTGAGRGIGRAVAARLAAAGAAVAIGDLDTRLATEAAGALSTRPGGRLLGLPLDVTDTPSFEDFLRTVETRLGPIDVLINNAGIMWVGPFAEEPEEAALRQFDVNVHGVLRGMKLVIPGMRKRGRGHVVNIASAASKVAPAGEATYAATKHALHGYSTAVRAELRGTGVHMSLVMPGVVDTELAVGTATGPTRRLTTDQVADAVLDVVLRPRFEVFVPRQVAALTRLAALLPGRARDALHHLLVPNQLAALSDRSVRAAYEQRTRTARHPES

SEQ ID NO: 3386 - protein, 110 aa, Glycine max
LISCPAATTVNRAEAGMVAPFTVLKTMAGFPTRKTNNDITSIASNGGREQCMQVWPPGGKTKSETLCYLPDLDDAQLATVVEHLLRQGRIPCLEFESEHGFAHREHSRSP

SEQ ID NO: 3387 - protein, 200 aa, Phaseolus vulgaris
MADQVLEGNQPVDLQKHPSGIVPTLQNIVSTVNLDCKLDLKTIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 3388 - protein, 370 aa, Mycoplasma capricolum
MTYLGKFDPLKNEKVCVLDKDGKVINPKLMPKISDQEILEAYKIMNLSRRQDIYQNTMQRQGRLLSFLSSTGQEACEVAYINALNKKTDHFVSGYRNNAAWLAMGQLVRNIMLYWIGNEAGGKAPEGVNCLPPNIVIGSQYSQATGIAFADKYRKTGGVVVTTTGDGGSSEGETYEAMNFAKLHEVPCIFVIENNKWAISTARSEQTKSINFAVKGIATGIPSIIVDGNDYLACIGVFKEVVEYVRKGNGPVLVECDTYRLGAHSSSDNPDAYRPKGEFEEMAKFDPLIRLKQYLIDKKIWSDEQQAQLEAEQDKFVADEFAWVEKNKNYDLIDIFKYQYDKMDIFLEEQYKEAKEFFEKYPESKEGGHH

SEQ ID NO: 3389 - protein, 343 aa, Oryza sativa; identical to SEQ ID NO: 1154

SEQ ID NO: 3390 - protein, 438 aa, Gracilaria cervicornis
IRYAKMGYWDPNYVVKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIIMIDLVIGYTAIQTMAIWARRNDMILHLHRAGNSTYSRQKIHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPL

SEQ ID NO: 3391 - protein, 398 aa, Azotobacter vinelandii
MNDALNLLQPYPFEKLRALLAGVQPPAGKKPIALSIGEPKHRSPSFVVEALAANLEQLAVYPTTLGLPALREAIARWCERRFRVPADRLDPARHVLPVNGTREALFAFAQTVVKRTGNGLVVSPNPFYQIYEGAALLAGATPHYLPCLPENGFNPDFDAVPADVWRRCQLLFLCSPGNPTGALVPLATLKKLIALADEHDFVIAADECYSELYFDEQNPPPGLLTACAELGRDDFRRCVVFHSLSKRSNLPGLRSGFVAGDAEILKSFLLYRTYHGCAMPVPTQLASIAAWSDEVHVRANRVLYREKFDAVLGILQPVLDVERPDGSFYLWPRTPVDDQVFTRDLFAREHVTVVPGAYLSRSVDGLNPGADRVRMALVAPLNECVEAAGRIRDFVRAG

SEQ ID NO: 3392 - protein, 160 aa, Streptococcus pneumoniae
MTQGKITASAAMLNVLKTWGVDTIYGIPSGTLSSLMDALAEDKDIRFLQVRHEETGALAAVMQAKFGGSIGVAVGSGGPGATHLINGVYDAAMDNTPFLAILGSRPVNELNMDAFQELNQNPMYNGIAVYNKRVAYAEQLPKVIDEACRAAVSKKRSSCC

SEQ ID NO: 3393 - protein, 75 aa, Zea mays
  unsure (1)..(75): unsure at all Xaa locations
CKQKLVANALLAVSLAVCKALAMVKMITVXQHIGNLAGNKNMVLPVPALNAINGRSHAGNKLAMQEFMILPTGSL

SEQ ID NO: 3394 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGHNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 3395 - protein, 486 aa, Pseudomonas putida
MKEIKHFINGEYVESASGKLFDNVNPANGQVIAKIHEAGEAEVDAAVKAARAALKGPWGRMTVAERTEILHRVAAGISARFDEFLEAECLDTGKPKSLASHIDIPRGAANFSVFADLVKNVPTEAFEMATPDGTGALNYGVRRPKGVIGVISPWNLPLLLMTWKVGPALACGNTVVVKPSEETPTTTALLGEVMNAAGVPAGVYNVVHGFGGNSAGAFLTAHPDVDAYTFTGETGTGETIMRAAAKGLRQVSLELGGKNAGIVFADCDLDKAIEGTLRSAFANCGQVCLGTERVYVERSIFDEFVARLKAGAEALVIGPPDDASSNFGPLVSLKHREKVLSYYQQAVDDGATVVTGGGVPEMPAHLAGGAWVQPTIWTGLADNSVVVTEEIFGPCCHIRPFDREEEAIELANSLPYGLASAIWTENASRAHRVAGQIEAGIVWVNSWFLRDLRTAFGGSKQSGIGREGGVHSLEFYTELKNICVKL

SEQ ID NO: 3396 - protein, 421 aa, GIBBERELLA ZEAE PH-1
MGDVAVENPANQVAPHKRAAHSAIPTIDNFEGVSTDGGDDYANLKKLQRQLEYIQLQEEYIKDEQRSLKRELVRAQEEIKRIQSVPLVIGQFMEAIDQNTGIVQSSTGSNYVVRILSTLDREKLKASSSVALHRHSNALVDILPPEADSSIAMLGTDEKPDVTYADVGGLDMQKQEIREAVELPLTHFDLYKQIGIDPPRGVLLYGPPGTGKTMLVKAVANSTTANFIRVVGSEFVQKYLGEGPRMVRDVFRMARENSPAIIFIDEIDAIATKRFDAQTGADREVQRILLELLNQMDGFDQTANVKVIMATNRADTLDPALLRPGRLDRKIEFPSLRDRRERRLIFSTIASKMSLAPEVDLDSLIVRNDPLSGAVIAAIMQEAGLRAVRKNRYNIIQTDLEDAYSSQVKGTGEENKFDFYK

SEQ ID NO: 3397 - protein, 340 aa, Chlamydia muridarum
MHPLTYNIASEETTEAQVSFVIENFGNDFCINLLKKMLLIREFEIRGEEAYLEGLVGGFYHSYIGQESVATAALACTGTDHWFFSSYRCHGVAILLDIPLRQLAAELLGKETGCALGRGGSMHMCGDRLPGGFGIVGGQIPLAAGAAFSMKYQKLPSISLCFIGDGAVAQGVFHETLNFASLHTLPLMLIIENNGWGMGTALHRAIAKQPIAESQASSYGLSSITLNGFDLFNSLIGFKEAYQHMQKTGAPVVVEALCSRFRGHSISDPNLYRSKEEMQCLLKRDPILFAKEWLIRANVLSEDDFKDLRQTSKEAVLEAFSQARLDPEPAVATLEEGIYA

SEQ ID NO: 3398 - protein, 102 aa, Lavatera thuringiaca
MAISKALIASLLISLLIIQIVEADHQLVTSAGKGNSSPKKIDCGGACAARCQLSSRPHLCKRACGTCCARCACVPPGTAGNQEMCPKCYASLTTHGGKRKCP

SEQ ID NO: 3399 - protein, 547 aa, Bacillus subtilis subsp. subtilis str. 168
MKDDHQNKQHQSNAQGSEEAFSHKTSGKNESEDTLTNRQGHPVTDNQNVRTVGNRGPTTLENYDFLEKISHFDRERIPERVVHARGAGAHGYFEAYGSFGDEPISTYTRAKLFQEKGKKTPAFVRFSTVNHGKHSPETLRDPRGFAVKLYTEDGNWDLVGNNLKIFFIRDPLKFPDLVHAFQPDPVTNIQDGERIFDFISQSPEATHMITFLFSPWGIPANYRQMQGSGVHAYKWVNEEGKAVLVKYHFEPKQGIRNLTQKEAEEIQGKNFNHATQDLYDAIENGDYPEWEVYAQIMSDDEHPELDFDPLDPTKLWYKDDFPWKPIGKLVLNKNPENYHAEVEQASFGTGVLVDGLDFSDDKLLQGRTFAYSDTQRYRVGANYLQLPINSPKKHVATNQEGGQMQYRVDRAEGQNPHVNYEPSIMGGLKEAKQDGKDHTPHVEGDVKREAIDRTNNFGQAGETYRRFTEFERNELITNLVNTLSTCRKEIQDQMIENFTKADPDYGKRVAEGLKKVSENNSNGPIGTTETEQAAKQAEQESHPSDPY

SEQ ID NO: 3400 - protein, 377 aa, Zymomonas mobilis
MTAIVSIHGRQVVDSRGNPTVEVDVTLEDGSFGRAAVPSGASTGVHEAVELRDGDKTRWGGKGVTKAVHAVNNEIANAIIGLEAEDQELIDQTMIKLDGTPNKGKFGANAILGVSLAVAKAAAEARGLPLYRYVGGTAAHVLPVPMMNIVNGGMHADNPIDFQEFMIAPVGASSINEAVRIGTEVSHTLKKELSAKGMNTNVGDEGGFAPSLDSASSALDFIVDSISKAGYKPGEDVFIALDAASSEFYNKDQNIYDLKGEGRKLTSAQLVDYYVELCGKYPIYSIEDLAEDDFEFWKILTEKLGDKVQLVGDDLFVTNVKRLSDGIERGIANSLLVKFNQIGSLSETLAAVNMANDASYTPVMSHRSGGNRRHHDC

SEQ ID NO: 3401 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHHKEALTTKDLKKLIWNEIFS

SEQ ID NO: 3402 - protein, 520 aa, Gossypium hirsutum
MVGNSLAGLQDHLKLAREYALEGLYDTSIIFFDGAIAQINKHLNTLDDPLIRSKWMNVKKALSEETEVVKQLDAERRSFKEAPNGRRPSSPPIHAKSSFVFQPLDEYPTSSGAPMDDPDVWRPPSRDTSTRRPARGGQAGMRKSPQDGISGRGNTRTAATGRGAKAGASSRTNTGVRGSTTGKKGTGSGKSSKGDSANGDAEDGKLKRSQYEGPDPDLAEMLERDVLETTPGVRWDDVAGLTEAKRLLEEAVVLPLWMPEYFQGIRRPWKGVLMFDPPGTGKTLLAKAVATECGTTFFNVSSATLASKWRGESKRMVRCLFDLARAYAPSTIFIDEIDSLCNARGASGEHESSRRVKSELLVQVDGVNNTGTNEDGSRKIVVVLAATNFPWDIDEALRRRLEKRIYIPLPNFESRKELIRINLKTVEVAADVDIDEVARRTEGYSGDDLTNVCRDASLNGMRRKIAGKTRDEIKNMSKDEISKDPVAMCDFEEALAKVQRSVSQADIEKHEKWFSEFGSA

SEQ ID NO: 3403 - protein, 384 aa, Fusobacterium nucleatum subsp. nucleatum ATCC 25586
MVMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDEKGWYKGTANAIYQNIKFIEEYDPEYVLILSGDHIYKMNYDKMLQFHIQKDADATIGVFKVPLVDAPSFGIMNTKDDMSIYEFEEKPKEPKSDLASMGIYIFNWKLLKKYLDEDEKDPNSSNDFGKNIIPNMLNDGKKMFAYPFKGYWRDVGTIQSFWDAHMDLLSEDNELDLFDKSWRVNTRQGIYTPSYFTKESKIKNTLIDKGCIVEGEIEHSVIFSGVKIGKNSKIIDSIIMADTEIGDNVTIQKAIIANDVKIVDNIVIGDGKKIAVVGEKKIIDSQSLVK

SEQ ID NO: 3404 - protein, 112 aa, Petunia x hybrida
MAGKLSIVLFVLLVVLLAQNQVSMAKKVLDSKVQRRGNDQIYGVSQGSLHPQDCQPKCTYRCSKTSFKKPCMFFCQKCCAKCLCVPAGTYGNKQTCPCYNNWKTKEGGPKCP

SEQ ID NO: 3405 - protein, 417 aa, Arabidopsis thaliana
MAASAATTTSSHLLLSSSRHVASSSQPSILSPRSLFSNNGKRAPTGVRNHQYASGVRCMAVAADASETKTAARKKSGYELQTLTGWLLRQEMKGEIDAELTIVMSSISLACKQIASLVQRAGISNLTGVQGAINIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 3406 - protein, 506 aa, Corynebacterium glutamicum ATCC 13032
MTVYANPGTEGSIVNYEKRYENYIGGKWVPPVEGQYLENISPVTGEVFCEVARGTAADVELALDAAHAAADAWGKTSVAERALILHRIADRMEEHLEEIAVAETWENGKAVRETLAADIPLAIDHFRYFAGAIRAQEDRSSQIDHNTVAYHFNEPIGVVGQIIPWNFPILMATWKLAPALAAGNAIVMKPAEQTPASILYLINIIGDLIPEGVLNIVNGLGGEAGAALSGSNRIGKIAFTGSTEVGKLINRAASDKIIPVTLELGGKSPSIFFSDVLSQDDAFAEKAVEGFAMFALNQGEVCTCPSRALVHESIADEFLELGVKRVQNIKLGNPLDTETMMGAQASQEQMDKISSYLKIGPEEGAQTLTGGKVNKVDGMENGYYIEPTVFRGTNDMRIFREEIFGPVLSVATFSDFDEAIRIANDTNYGLGAGVWSRDQNTIYRAGRAIQAGRVWVNQYHNYPAHSAFGGYKESGIGRENHLMMLNHYQQTKNLLVSYDPNPTGLF

SEQ ID NO: 3407 - protein, 88 aa, Buchnera aphidicola
FGLYEPAGGSAPDIVGKNIANPIAQILSIAMLVRYTMKLPMISDHIESAVIDTLKKGYRTLDIANDKEKYVSTNDIGDIIADILKKRI

SEQ ID NO: 3408 - protein, 66 aa, Medicago truncatula
LQEFGTSVDSQVTELPFFASKVRLGRNGVEEFLPLGPLSDYERASLEKAKKELATSVEKGVSFIRK

SEQ ID NO: 3409 - protein, 512 aa, Debaryomyces occidentalis
MRFSTEGFTSKVVAAILAFSRLVSAQPIIFDKRDVSSSADKWKDQSIYQIVTDRFARSDGSTTADCLVSDRKICGGSYKGIIDKLDYIQGMGFTAIWISPVVEQIPDNTAYGYAYHGYWMKNIDELNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQNYMKGVTNYPLYYPVYRFFSDTSATSSELTSMISTLQSSCSDVSLLGNFIENHDQVRFPSVTSDTSLIKNAMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNSVSAGDSGSLSVSISGGMPQVYAPSSVLSGSGICNQ

SEQ ID NO: 3410 - protein, 443 aa, Gymnogongrus antarcticus
  unsure (1)..(443): unsure at all Xaa locations
VXPQPGVDPVEASAAVAGESSTATWTVVWTDLLTACDLYRAKAYKVDAVPNTSDQYFAYIAYDIDLFEEGSIANLTASIIGXVFGFKAVKALRLEDMRLPVAYLKTFQGPATGIVSERERMDKFGRPFLGATVKPKLGLSGKNYGRVVYEGLKGGLDFLKDDENINSQPFMRWKERXLHSMEGVXRSVAASGEVKGHYLNVTAATMEHMYERAEFAKXLGSIIIMVDLVIGYTAIQTMAXWARANDMILHLHRAGNSTYSRQKIHGMNFRVXCKWMRMAGVDHIHAGTVVGKLEGDPXMIXGFXXXXXXXXXXVNLPQGIFFEQDWASLRKVTPLASGGIHCGQMHQLLDYLGIDVVLQFGGGTIGHPDGIQAGATANRVALESMVXAXXXXXXXXAEGPQILRDAAKTCGPLQTALDLWKDITFNYTSTDTPDFVETPTANV

SEQ ID NO: 3411 - protein, 457 aa, Dictyota dichotoma
  unsure (1)..(457): unsure at all Xaa locations
DYNVKETDILALFRITPQPGVDPIEAAAAVAXESSTATWTVVWTDLLTACDIYRAKAYRVDPVPGXNXQFFAYIAYECDLFEEGSLANLXASIIGNVFGFKAVKALRLEDMRXPYAYLKTFQGPATGVIVERERLDTFGRPLLGATVKPKLGLSGKNYGRVVYEGLRGGLDFLKDDENINSQPFMRWKERFLYCMEGVNRAAAATGEVKGSYLNVTAATMENMYERAEYAESIGTVIVMIDLVIGYTAIQTMAIWARKAQMILHLHRAGNSTYARQKNHGINFRVICKWMRMSGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGGTANRVALEAMVXARNEGRDYVGEGPEILRTAAATCGPLKTALDLWKDITFEYTSTDTPDFVETATTNP

SEQ ID NO: 3412 - protein, 192 aa, Arabidopsis thaliana
MFAVENGLQGDPRLKAISDAIRVIPHFPKTGIMFQDITTMLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQFDELTL

SEQ ID NO: 3413 - protein, 492 aa, Oryza sativa
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 3414 - protein, 175 aa, Triticum aestivum
MAPAVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 3415 - protein, 482 aa, Pseudomonas aeruginosa PAO1
MSLEQTGHAPATSGIDFESVDADYFQHRQLKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIACFIGAYCESLFGVGGWLIYLVFYIVFIGIHILGAGEALKLMFVITAVAAIALGVFIVAMVPHFDSANLFNIPQTAATGASSFLPFGYVGVWAAIPYAIWFFLAVEGVPLAAEETKNPKRDLPRGLIGAMLVLLAFAALILVVGPGAAGAKELMGSGNPLVEALESAYKGSTWMSQFVNLVGLAGLIASFFSIIYAYSRQIFALSRAGYLPRSLSLTNRKKAPVLALVVPGVIGFGLSLTGQGDLLILVAVFGATISYVLMMAAHITLRIRRPDMQRPYRTPGGILTSGVALALACVAVVAGFLVDPRVVVGAVAIYAVLIGYFALYSRHHLVSGTPEEEFAAIQAAEQDLR

SEQ ID NO: 3416 - protein, 410 aa, Geobacter metallireducens
MAKINDNYLKLKAGYLFPEIGRRVREFSAANPEAKVIRLGIGDVTRPLAPAIIKAFHDAVDDLATIDNFAGYGPEQGYDWLINAIIEKSYKPLGVSLKTEEMFISDGSKCDCANILDIFALDNVVAIGDPVYPVYNDTNVMIGRTGDADEKGYYKGIVYMPCTEANGFIPSLPTEKVDIIYLCFPNNPTGTVATKAELKKWVDYANANDAVIFFDAAYEAFITDPAIPHSIYEIEGAKKCAIEFRSFSKTAGFTGVRCGLVVVPEEVMGTTPTGEKYSFNKLWLRRTTTKFNGASYPVQKAAAAVYSDEGWKQNKEIIDYYMENARIIREGLAAAGLTVYGGVNAPYIWLKTPGGMSSWDFFDKLLTECNVVGTPGSGFGPSGEGFFRLSAFGHRENVIEAVERIKKNLK

SEQ ID NO: 3417 - protein, 492 aa, Oryza sativa
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFFSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 3418 - protein, 370 aa, Zea mays
  unsure (1)..(370): unsure at all Xaa locations
IAKLCADAKYDCILCITWFRRSEQNPEEVREGGKGVASVEGELKELRIGETFEGLTGTSSLSTTNDDDASSTTTEAMLPISPNGKFKRKIKSWMRGALLGSGSFGMVYEGISDEGAFFAVKEVSLLDQGSNAQQSIVALEQEIALLSQFEHENIVQYYGTDKEESKLYIFIELVTQGSLSSLYQKYKLRESQVSAYTRQILCGLVXLSAKIVILPVIKCTKILVHAKRSLDRPSLVPFDLLFIISTYVIMSKNMLRSCKGSVYWMAPVVINPKKMYGPSADIWSLGCTVLEMLTRQIPFPNVEWTNAFFMIGRGEQPTIPSYLSKEAQDFIGQCVRVDPESRPSASQLLEHPFVNRPLRASFESSSPPAI

SEQ ID NO: 3419 - protein, 52 aa, Glycine max
MASAPVEKLKSLWNSQVMDEEQWAVNYRVLKAAGIFAGSIFLMRAFGDMMVV

SEQ ID NO: 3420 - protein, 488 aa, Chordaria flagelliformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGPPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 3421 - protein, 408 aa, Zea mays
MASAPGEVPSHFLCPISLQLMREPVTLPTGISYDRAAISRWLATPAPAGGRTCPVTRVPLPPQPQLTPNHTLRRLIHAWLASLSPEAEVNEDVAALRGPVPGAEAVVALLSDAAGAQVEALKRLRELVAECEDSRTVLESQDGVFDALSRVVSSADACSTAREEAVGLLASLRIPEPELAGVVARHSNLGDALTAVLRSSNLKSRANAALLVRSLSEVAWPAWVIGLSQELLAEVVRVVRDRVSTQATKAALHALAALCPYGRTRVKIVGVGAVPAIVDLLLDDPERRVNELALVALDRLCTCAEGRAELVAHAAGLAVVGKKVLRVSETASERAVRVLRSVARHAATPAVLQEMVESGVVAKLCAALWSQQCGLRTKQKAHEVLKLHSRTWRSSPCLSPKFLGLYPS

SEQ ID NO: 3422 - protein, 439 aa, Staphylococcus xylosus
FLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAHG

SEQ ID NO: 3423 - protein, 61 aa, Gossypium barbadense
LGANAILAVSLAVCKAGAEVKKLPLYKHIANLAGNSKLVLPVPAFNVINGGSHAQKQIGYA

SEQ ID NO: 3424 - protein, 178 aa, Oryza sativa
  unsure (1)..(178): unsure at all Xaa locations
SVILGSDLVKRGMAQMQKGGVIMDVVNAEQARIAEAAGAVAVMALERVPSDIRAAGGVARMANPRIVKEVMEAVSIPVMXKARIGHITEARVLEAMGVDYIDESEVLTPADEEFHLLKSEYTVPFVCGCRDLGEALRRIGEGASMLRTKGDPGTGNIVEAVRHMRKVNSQVRKVVNMS

SEQ ID NO: 3425 - protein, 421 aa, Dianthus caryophyllus
AKLSASICTAEGIDEFQDTAIFQDYHGLPQFRKAVAKFVEKVRGEKVKYDESRIVMSGGATGAHELMTFCLADPGDAFLVPTPYYPGFDRDLRWRTGVQLVPVLCHSSDNFRITTSALQDAYERAQEAKIKVKGLLITNPSNPLGTVLDKETLINILEFTNEKNIHLICDEIYGATVFGEQKFISISEVIIDQPHNPDLVHIVYSLSKDLGFPGFRVGIVYSYNDNVVNCARKMSSFGLVSTQTQRLIACMLSDEEFVERFLEESRKRLENRHRVFTWGLSQVGIKCLRSNAGLFVWMDLRHPLQDPTIEGELALWRVIINEVKINVSPGSSFHCSEPGWFRVCIANMNDETMEVALRRIRSFVLQKKDAATCVTSSKRKCWQTNLQLRLSNRRLEDFIGISQIGSPSSPLPQSPLVLART

SEQ ID NO: 3426 - protein, 583 aa, Mesembryanthemum crystallinum
MTSSYILSSARNTTTTTTYFPKQYQYHHSNHELKRDVVFLKPQSSHPILRLRNSSFVYPSASLSSFAESDGQEHGEIMAAHHNHHQVNVDEHDDQVEEKKSDDHLPGMAQAFNISSNTATAIAICIAFAALTFPFFMTSLGPGMALKTKLLSYATLLFGFYMAWNIGANDVANAMGTSVGSGALTIRQAVLTAAVLEFSGALLMGRHVTSTMQNGILVANVFQGKNTLLFAGLLSSLASAGTWLQVASYYGWPVSTTHCIVGSMVGFGLAYGGVNAVFWSSLARVASSWVISPVMGAAVSFIVYKCIRRFVYSATNPGQAAATAAPVAVFVGVSGISFAAFPLSKILPLALVQALACGTVGAVIVDRMIRKQLGHLLAKSTSSEDEHEEDHPQQKNIGFLSDIAGPKGTQLKIVYGVFGYMQVLSACFMSFAHGGNDVSNAIGPLAAALSILQGGASGAEIIIPMDVLAWGGFGIVAGLMMWGYRVIATIGKKITELTPTRGFAAEFAAASVVLFASKLGLPISATHTLVGAVMGVGFARGLNSVRAETVREIVTSWAVTIPVGAALAAFYTTILTKILSYVL

SEQ ID NO: 3427 - protein, 253 aa, Hordeum vulgare
MGRKFFVGGNWKCNGTVEQVEAIVQTLNAGQIVSPDVVEVVVSPPYVFLPIVKAKLRPEIQVAAQNCWVKKGGAFTGEVSAEMLANLGVPWVILGHSERRSLLGESSEFVGEKVAYALAQGLKVIACVGETLEQREAGSTMEVVAEQTKAIAGKIKDWSNGVVAYEPVWAIGTGKVATPAQAQEVHANLRDWLKTNVSPEVAESTRIIYGGSVTGASCKELAAQADVDGFLVGGASLKPEFIDIINAAAVKSA

SEQ ID NO: 3428 - protein, 277 aa, Escherichia coli
EIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDN

SEQ ID NO: 3429 - protein, 297 aa, Aquifex aeolicus VF5
MREIRKVVLPVAGWGTRFLPATKAMPKEMLPIIDKPIIQFIVESFINIGIENIIFVTGRHKKAIEDHFDHNHELEEHLKKAGKEKLLREVVKISSLINPIYVRQKEQLGLGHAVLMAEPAVSQEPFFVALGDIIVENEEEELKKMIHLFRKFGNSIVALMEVPKEEVSKYGIAKVKKLDEETYIIVDLVEKPSPEEAPSNLAIVGRYIFTPTIFEKLKVTKPGKGGEIQLTDAMRLLLEEEAIYACKVNNTVYDTGNPKDYLKTVISFALRREDINGELIEFIRGLIKEEPKKEKAK

SEQ ID NO: 3430 - protein, 530 aa, Triticum aestivum
KKKKKKLETSCRIRHEVGSHIQPDSRKEKANAGSLFLSKFPYSQAILDLALQDLDRVHDKSKEMSKGMRHLTKIFPNKVTIQPPQDEVELSRWNQMLDQDIEILKANDNTSKIRSFLTRIDLECSDLETIYVKDRTLTNECIDTIVGFALSHQLKHLTATNPDPSIDLQFSLSSESLKHGVDMLESIQSGPKTSNKRKSLKDIATENEFEKRLLADVIPPDEIGVTFEDIGALESVKETLKELVMLPLQRPELFSKGQLMKPCKGILLFSPPGTGKTMLAKSVATEAGANFINISMSSISSKWFGEGEKYVKAVFSLASKIAPSVIFVDEVDGMLGRRENPGEHEAMRKMKNEFMVNWDGLRTKDKERVLVLAATNRPFDLDEAVIRRLPRRLMVNLPDASNRRKIISLILAKEDLADDLDLEAIANLTEGYSGSDLKNLCVTAAHLPIRELLEKEKKERALAEAENRPLPQSCSSSDVRALRISDFKHAHEQVCASVSSDSTNMNELVQWNDLYGEGGSRKTTTLSYFM

SEQ ID NO: 3431 - protein, 631 aa, Cryptococcus sp.
MAPVRSLAGALLASLGLVAGLSPAEWRSQSIYQVVTDRFALDNGGNSPSCSGQSELNLYCNGTFAGIIDKLDYIQNMGFTAIWISPVVKNIDGGSPNGYTPDGSAYHGYWAQDIYEINPHFGGASGLTDLSNALHSRGMYLMVDVVVNHMAYYCGTDGGCGPGNSVNYGSFTPFNSESYFHPFCEIDYNNRTSILDCWEGDEIVPLVDLRTEDSDVQSIFNSWISNLIQTYNIDGLRIDSLQQSGSFFFPGFNQAAGGMYMVGEVFNGSPSYVCPYQQAGMPGVLNYPMFFYITNAFQTSSGSMSQLAQGISAMQSDCSDTTLLGSFLENQDNPRFPSQTSDLTRAQNAIAFTMLQDGIPITYYGQEQHLSGSGVPLNREALWTSGGYDTSSPLYEMITTVNQLRTLAIKQNGGFVTYKIQVPYTDSNHIVTRKGNSGYQIVGVYTNVGSAGSSSTLSISSSETGFQASEPVMDVLSCTLYHTGTDGSLSFTMTGGLPRVFYNATALAESSLCTTYTTASPPPGGCSAGTVVFDVYVQTQYGQSVVIAGNIPQLGNWSPANGLNLNANQYTASSPKWTGTITGVAPGTTFQWKPIVVTNGNDNWYPGNNQQATTGSACSSPAADIEFTWSS

SEQ ID NO: 3432 - protein, 474 aa, Chattonella subsalsa
  unsure (1)..(474): unsure at all Xaa locations
RYESGVVPYAKMGYWDADYTVKETDLLALFRITPQPGVDPVEAAAAVAGESSTATWTVVWTDLLTACDVYRAKAYRVDPVPSAADQYFAYIAYECDLFEEGSLANMTASIIGNVFGFKAVAALRLEDMRIPYAYLKTFQGPATGIIVERERHDXFGRPLLGATVKPKAGLSGKNYGRVVYEGLRGGLDFLKDDENINSQPFMRWRERFLYCMEGINRASAASGEVKGSYLNCTAATMEEMYERAEYAKSVGSVIIMIDLVIGYTAIQSMAIWSRKNDMILHLHRAGNSTYARQKNHGINFRVICKWMRMAGVDHIHAGTVVGKLEGDPLMVKGFYDTLRECELSINLPQGIFFEMDWASLRKCCPVASGGIHCGQMHQLLYYLGXXXXXXXGGGTIGHPDGIQAGATANRVALEAMVLARNEGRDYVAEGPEILKDIAKLCGPLKTALDLWKGITFNYTSTDTADFVETATQNK

SEQ ID NO: 3433 - protein, 92 aa, Zea mays; identical to SEQ ID NO: 505

SEQ ID NO: 3434 - protein, 394 aa, Zea mays subsp. mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 3435 - protein, 205 aa, Oryza sativa
MGNPEKLMTQIFDLKFTSKSLQRQARKCEKEEKEQKLKVKKAIEKGNMDGARIYAENAIRKRTEHMNYLRLASRLDAVVARLDTQAKMQVIGKSMANIVKSLDSALATGNLQKMSETMDNFERQFVNMEVQAEFMEGAMAGSTSLSTPETEVNSLMQQVADDYGLEVSVGLPQAAAHAIPAAKEKEKAVDEDDLSRRLAELKARG

SEQ ID NO: 3436 - protein, 338 aa, Agrobacterium tumefaciens
MAKTMKAAVVRAFGKPLTIEEVAIPDPGPAEILINYKATGICHTDLHAATGDWPVKPNPPFIPGHEGVGYVAKIGAGVTGIKEGDRAGTPWLYTACGCCIPCRTGWETLCPSQKNSGYSVNGSFAEYGLADPKFVGRLPDNLEFGPAAPVLCAGVTVYKGLKETEVRPGEWVVISGIGGLGHMAVQYAKAMGMHVVAADIYDDKLELAKKLGADFTVNGRAPDAVEQVQKATGGVHGALVTAVSPKAMEQAYGFLRSKGTMALVGLPPGFISIPVFETVLKRITVRGSIVGTRQDLEEALSFAGEGKVAAHFSWDKLENINDIFRRMEEGKIDGRIVL

SEQ ID NO: 3437 - protein, 364 aa, Shewanella oneidensis MR-1
MSYQIAVLAGDGIGPEVMAEARKVLKAVEARFGLNIEYTEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREISRIARIAFEAARGRRKKVTSVDKANVLACSVLWRQVVEEVAVDFPDVELEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVTKALNSGYLTGELLSSDQRHKAKTTVQMGDFIADAVKAGV

SEQ ID NO: 3438 - protein, 213 aa, Thermosynechococcus elongatus BP-1
MNDQLLRYLPLTTGVLGGTLLFINRLFTPMLTPAQARADVVGVLLAAVLILTTLIWQRVQPRPPEAVILEGEEGFELAADLSPALKTELAWLSYTLLKNTPTKSIVIWRHDRPLLRRGILGPQPMTTPGAIVQRALQTQRPIYLVNLALYPGRIEFEYLPPNTQGVICQPVDEQTVMILGTNAPRSYTQQDERWVAALAAKFAQVLAQQYNKT

SEQ ID NO: 3439 - protein, 75 aa, Zea mays
  unsure (1)..(75): unsure at all Xaa locations
IHKHSPDLIMXRKQAGILIGLPCHKRQGHRHACDSEHHPCNLDRVLDQXQYVSVQRRRVICGGVRICTLSSTRSE

SEQ ID NO: 3440 - protein, 515 aa, Brassica napus
MLDSLVSKLPSLSTSDHASVVALNLFVALLCACIVLGHLLEENRWMNESITALLIGLGTSVTILLISKGKSSHLLVFSEDLFFIYLLPPIIFNAGFQVKKKQFFRNFVTIMLFGAIGTVVSCTVITLGVTQFFKKLDIGTFDLGDYLAIGAIFAATDSVCTLQVLNQDETPLLYSLVFGEGVVNDATSVVVFNAIQSFDLTHLNHEAAFQLLGNFMYLFLLSTLLGVATGLISAYVIKKLYFGRHSTDREEVALMMLMAYLSYMLAELFALSGILTVFFCGIVMSHYTWHNVTESSGVTTKHTFATLSFLAEAFIFLYVGMDALDIEKWRFVSDSPGTSVAVSSILMGLVMLGRAAFVFPLSFLSNLSKKNQSEKIDIKQQVVIWWAGLMRGAVSMALAYNKFTRSGHTELRGNAIMITSTITVCLFSTMVFGMLTKPLIRHLMPHQSTTTSMLSDDNTPKSLHMPLLDGEQQDSFVEFSGSHHDVPRPDSLRGFLMRPARTVHHYWRQFDDSNH

SEQ ID NO: 3441 - protein, 231 aa, Chlamydophila caviae GPIC
MNKKQRQKTLIAPSIMGGDLACIGAEAKKIEESGADLIHIDVMDGHFVPNLTFGPGVIAAINRSTDLFLEVHAMIYTPFDFIEAFVKAGADRVIVHFEASEDLKELLAYIKKCGIQAGLAFSPETSIEFIPPFLPFCDVLLLMSVHPGFCGQGFIPDVPDKIRFTRQALKTMGLEDSCLIEVDGGINEASAKECREAGADILVAASYMFQKDALTMEEKVLLLRGENHGIK

SEQ ID NO: 3442 - protein, 524 aa, Eremothecium gossypii
MRVSRLGFSCLALAGWASAMIMQNPFSAIMRGEGDAGSTTWLDGLESWPVLGQDGKLAKWYAQGMSEPRNMLQKIALRGSDFEVMRHKSNPDYALRVKKQDPAKLGVDTVKQWSGYLDYKDEKHFFYWFFESRNDPANDPVMLWLNGGPGCSSFTGLLFELGPASIGKDLKPVHNPHSWNNNASVIFLEQPVGVGFSYGDSVDSTAVAGADVYAFLRLFFQKFPHLAKNDFHIAGESYAGHYIPQIAHEIITSKEENSEEIPNFNLTSVLIGNGFTDPRTQYKYYEPMACGKGGVPAVLNEDQCSRMNASSSRCDRLMNLCYLTNRAIPCLAATVYCERYITQVYEETGLNYYDMRRKCESPDSDLCYRGLDYVQQYMNQKEVQEALGSEVELYEGCNKRVGARFALSGDHGKPFQQYVSQLLDRAIPVLIYAGDKDYICNWLGNKAWSDEVGWRHTYKYRTLPLKPWVNKNTGKTAGEVKSFGALTFLRVYDAGHMVPYDQPESSAYMIESWLNKNYNLDYKV

SEQ ID NO: 3443 - protein, 424 aa, Glycine max
  unsure (1)..(424): unsure at all Xaa locations
HASADAWAVGATRISVLPIIPCSGQLFSFLPSPPFVHSPTPHSDQIHHSFFFPFLQQAQWRRRSLPLLKHLLLSRRIPARSVTYMHRPGDGSPRPVTLIPGDGIGPMVTGAVEQVMEAMHAPVYFEKFEVHGHMKAVPPEVLDSIRKNKVCLKGGLVTPMGGGVSSLNVQLRKELDLYASLVNCFNLPGLPTRHDNVDIVVIRENTXEGEYSGLEHEVVPGVVESLKVITKFCSERIAKYAFEYAYLNNRKKVTAVHKANIMKLADGLFLESCREVATKYPGIKYNEIIVDNCCMQLVSKPEQFDVMVTPNLYGNLVANTAAGIAGGTGVMPGGNVGAEHAVFEQGASAGNVGSDKIREQKKANPVALLLSSAMMLRHLQFPAFADRLETAVEKVILEGKCRTKDLGGTSTTQEVVDAVIDALD

SEQ ID NO: 3444 - protein, 337 aa, Thermosynechococcus elongatus BP-1
MVRVAINGFGRIGRNFMRCWLQRKANSKLEIVGINDTSDPRTNAHLLKYDSMLGIFQDAEITADDDCIYAGGHAVKCVSDRNPENLPWSAWGIDLVIEATGVFTSREGASKHLSAGAKKVLITAPGKGNIPTYVVGVNHHTYDPSEDIVSNASCTTNCLAPIVKVLHEAFGIQQGMMTTTHSYTGDQRLLDASHRDLRRARAAAMNIVPTSTGAAKAVGLVIPELQGKLNGIALRVPTPNVSVVDFVAQVEKPTIAEQVNQVIKEASETTMKGIIHYSELELVSSDYRGHNASSILDASLTMVLGGNLVKVVAWYDNEWGYSQRVLDLAEHMAAHWA

SEQ ID NO: 3445 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGRKEAADLVVQGIEGAIESKTVTYDFARLMTGAKEVSTSQFGKAIIKHIL

SEQ ID NO: 3446 - protein, 342 aa, Physcomitrella patens
MVGSAKIKVGINGFGRIGRLVARVALERDDIELVAINDPFITPEYMTYMFKYDSTHGQWKKTEVTLHSEGHLTFGGNPVAVYACRDPSEIPWGKHGADFVVESTGVFTDKDKAAAHLKGGAKKVVISAPSKDAPMFVMGVNENKYSDEDIVSNASCTTNCLAPLAKVINDKFGILEGLMTTVHATTATQKTVDGPSSKDWRGGRSAATNIIPSATGAAKAVGKVLPELNGKLTGMAFRVPTTDVSVVDLTVRLEKPASYDAIKTAIKEASEGQMKGILGYTEDDVVSTDFITDSRSSIFDAKAGIALSDTFVKLVAWYDNEWGYSNRVVDLIVHMAKQGTSQ

SEQ ID NO: 3447 - protein, 318 aa, Oryza sativa (japonica cultivar-group)
MTRRCSHCSHNGHNSRTCPNRGVKIFGVRLTDGSIRKSASMGNLSLLSSAAGSTSGGASPADGPDAAPTAADGYASDDFVQGSSSATRDRKKGVPWTEEEHRRFLLGLQKLGKGDWRGISRNFVVSRTPTQVASHAQKYFIRQSNMTRRKRRSSLFDMVPDESMDLPPLPGGQEPETQVLNQPALPPPREEEEVDSMESDTSAVAESSSASAIMPDNLQSTYPVIVPAYFSPFLQFSVPFWQNQKDEDGPVQETHEIVKPVPVHSKSPINVDELVGMSKLSIGESNQETVSTSLSLNLVGGQNRQSAFHANPPTRAQA

SEQ ID NO: 3448 - protein, 186 aa, Zea mays
MAPSAALAPVAFRSAFSTPLASNPTRNRINIEGTFCLPCSARKRASYRSFRVYSLFGGKKDKDENGDEAPSKAGIFGNMQNLYETVKKAQMVVQVEAVRVQKELAATEIDGYCEGELIKVTLSGNQQPIRVEITEAAMELGAEKLSELVNDAYKDAHQRSVQAMKERMSDLAQSLGMPAGLGDGLK

SEQ ID NO: 3449 - protein, 385 aa, Populus tomentosa
MAIDCIKTMPSITTPQHHPKDQDQCKDDGKSFVFDAQILRHQTNIPQQFVWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYTAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNGQTPRKSLAFFLCPKNDKMVTPPHELVDTCNPRIYPDFTWPMLLEFTQKHYRADMKTLEVFTNWLHQRSFT

SEQ ID NO: 3450 - protein, 273 aa, Zea mays
MAGMSLQHPRAFAFGLLGNVISFMTFLAPLPTFYRIYKNKSTEGFQSVPYVVALFSAMLWIYYALLKSNELLLITINSAGCVIETLYIAMYLLYAPKKAKLFTAKILLLLNVGVFGLILLLTLLLSAGQRRVVVLGWVCVAFSVSVFVAPLSIIRQVVRTRSVEFMPFSLSLSLTVSAVVWFLYGLLIKDKYVALPNVIGFSFGVVQMGLYALYRNATPRVPFKDVADDGKDQARRRARPRQHRQAQPSPPGEELRGAPSHPDGGSSRQELRC

SEQ ID NO: 3451 - protein, 314 aa, Capsicum chinense
MGSKYSKATNSINDALNSSYLVPFESYRFPLVDLEEATNNFDGKGGFGKVYRGVLRDGTKVALKRHNRDSGQSIEPFRTEFEILSRRSHPHLVSLIGFCDERNEMILIYDYMENGNLKSHLYGSDLPTMSWEQRLEICIGAARGLHYLHTSAAIHRDVKSTNILLDENFVAKITDFGISKKGTDLDHTHVSTHVKGAFGYLDPEYFIKGRLTEKSDVYSFGVVLFEVLCARSAIVQSLPREMVNLAAWAVESHNNGQLEQIIDPNLVAKIRPESLGKFGETAVKCLAPSSEDRPSMGDVLWKLEYALRLQESVI

SEQ ID NO: 3452 - protein, 407 aa, Spinacia oleracea
KIAILLPKDSTYTIPTTTHLGSSFNQNNKQVFFNYKRSSSSNNTLFTTRPSYVITCSQQQTIVIGLAADSGCGKSTFMRRLTSVFGGAAEPPKGGNPDSNTLISDTTTVICLDDFHSLDRNGRKVEKVTALDPKANDFDLMYEQVKALKEGKAVDKPIYNHVSGLLDPPELIQPPKILVIEGLHPMYDARVRELLDFSIYLDISNEVKFAWKIQRDMKERGHSLESIKASIESRKPDFDAYIDPQKQHADVVIEVLPTELIPDDDEGKVLRVRMIQKEGVKFFNPVYLFDEGSTISWIPCGRKLTCSYPGIKFSYGPDTFYGNEVTVVEMDGMFDRLDELIYVESHLSNLSTKFYGEVTQQMLKHQNFPGSNNGTGFFQTIIGLKIRDLFEQLVASRSTATATAAKA

SEQ ID NO: 3453 - protein, 563 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVIRLIELKLPVFDAPESLIKQAQLTAATNAKQ

SEQ ID NO: 3454 - protein, 477 aa, Corynebacterium glutamicum
MAFETPEEIVKFIKFIKVEFVDVRFTDLPGTEQHFSIPAASFDADTIEEGLAFDGSSIRGFTRIDESDMNLLPDLGTATLDPFRKAKTLNVKFFFHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDYPHRSDVFTEDLIEAYIQYKYDNEISPVRLRPTPQEFELYFDC

SEQ ID NO: 3455 - protein, 486 aa, Pseudomonas putida
MRQIENFIAGEFVAAASGKRFDKRSPVDNRIICSISEAGRSEVDAAVSAARSALHGEWGSLSTDQRIELLLCVANEITRRFDDFVEAEMSDTGQPEHVMKHVFIPRGAANFKVFADVIKSVASESFKMDTPDGRGALNYSIRRPKGVIGVVCPWNAPFMLMTWKVGPALACGNTVVVKPSEESAQTAALLGEVMNAVGIPKGVYNVVHGFGPDSAGEFVTRHPQVDAITFTGETRTGTAIMKAASEGMRDVSFELGGKNAGIVFADADFEAAVESFSRSVFLNTGQVCLGTERVYVERPIFERFVQALKVKAEAVKYGRPDDHQANYGPLISQEHKQKVLSYYRKAVEEGATLVTGGGVPQMPGELAEGAWVQPTIWTGLPETAAVVQEEIFGPCCHISPFDSEDEVVEKANATDYGLSTTIWTSNLARAHRMAGRIDVGITWINSWFLRDLRTPFGGSKQSGIGREGGVHSLEFYTETRNVCVKL

SEQ ID NO: 3456 - protein, 181 aa, Zea mays
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 3457 - protein, 298 aa, Zea mays
MATSSRRVPLLLLCLGVLVSCSFAAGSLDQELDITWGDGRGKVLDNGRLLTLSLDRTSGSGFQSRHEYLFGKIDMQLRLVPGNSAGTVTAYYLSSQGGAHDEIDFEFLGNVSGEPYTLHTNVFTRGQGQREQQFRLWFDPTADFHTYSILWNPKHVIFMVDDMPIRDFRNLESKGVAFPKSQPMRLYSSLWNADDWATQGGRVKTDWSHAPFSASYRGFKADACVAVAGGRTRCGATVGTEGTGAPASAAGAGDWYNQELDLTLQQRMRWVQRKYMIYNYCTDPKRYQQGLPAECSMQ

SEQ ID NO: 3458 - protein, 165 aa, Aegilops speltoides
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 3459 - protein, 357 aa, Xylella fastidiosa 9a5c
MSKQILILPGDGIGHEIVAEAVKVLEHVNVRHTLNLRLSFDALGGAAYEKYGSPLADETLARARDADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRHPKQFDVIVTENMFGDILSDQASMLTGSIGMLPSASLDANNKGMYEPCHGSAPDIAGQGVANPLATILSVAMLLRYSMGHIKTADAIEHAVGVVLDSGLRTADIWSEGMTKVGTVAMGDAVVAAL

SEQ ID NO: 3460 - protein, 262 aa, Glycine max
MPNTNTPPTRKRNNLSRYNLNLCFSNPMQPFTPKSHPTIPTATSSPVHHNHNHPSPPATSSTPDFDHDRSTVTPQNPFPSLGPEPKPADLATAFASQRFFFTSPGRSNSIIESANTTDADCFTTSSSSLSPVPADESATIDKIQDQLKSLILGLSSSDESEAKALLDRSVAVRKYSPDPYADFRQSMEQMVAARPELMDVAAKWRELHELLLCYLALNPKSTHKFILRAFSDFLLSLISRSYLPPQDPGSGDIAGDGGGCLS

SEQ ID NO: 3461 - protein, 492 aa, Burkholderia fungorum
MNEATARKPHPLDKLKDPSLLRTQAYVDGRSQGGAQEFAVFDPATGAEIARVPNLAAAEARQAIDAANAALPAWRALTGKQRAAMLRRWYELIVAHAADLAAIMTAEQGKPLAEARAEALYGASFVEWFAEEAKRVSGDVLASPADDRKIVVIRQPIGVCVSITPWNFPLAMITRKVAPALAAGCTIVVKPAEQTPLSALALAELAHRAGLPAGVLNVLTGDAANAIEIGKVFCESEIVRHLSFTGSTPVGRLLMQQCAPTVKKVALELGGHAPFIVFDDADVDAAVQGAMVSKYRNAGQTCVCANRFYVHDAVYERFVRQFAEASRGVKVGNGFLEGVDQGPLIDDDAVAKVRQHVDDALAKGARQVMGGRIEGRFVEPVLLAEVTHDMLIAREETFGPVAAVFRFRDEAEVTRLANDTQFGLASYFYSRDIGRVWRVAEALEYGMVGINTGLISNEVAPFGGVKQSGLGREGSKYGIEEYLQIKYLCMGV

SEQ ID NO: 3462 - protein, 176 aa, Streptococcus pneumoniae R6
MKERKKMNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELDELNGREKIGDYDYKVLMHY

SEQ ID NO: 3463 - protein, 310 aa, Burkholderia fungorum
MGMPTMLKVTKAVFPVAGLGTRFLPATKASPKEMLPIVDKPLIQYAVEEAIAAGITEMIFVTGRSKRAIEDHFDKSYEIEAELEARNKQKLLDLVRSIKPANVDCFYVRQAEALGLGHAVLCAEKLVGDSPFAVILADDLLHSSKPVMSQLVDTFNHYHSSVIGVETIAREDSRSYGVVDGREWEDNVIKLSGIVEKPAPDKAPSNLGVVGRYVLMPTIFKHIRALKPGAGGELQLTDAVQSLLTEEQVLAYRYFGTRFDCGSKLGYLKATVEFALRHPEVKAEFEAYLQAYMQTNMQEGVPAQYAAEAA

SEQ ID NO: 3464 - protein, 423 aa, Oryza sativa
  unsure (1)..(423): unsure at all Xaa locations
MECLAEMPRAPLADRRPRKRQRLGWDVGPEIHQVQIGLCGQEVANVISAVTLGLSSQEIPRFASPPLREDDKDGHFVFAVGDNLTPRYRINAKMGEGTFGQVLECWDRERKEMVAIKIIRGIKKYRDAAMIEIGMLEQLGKYEKSRSSCVQIRNWFDYRNHICIVCEKLGPSLYDFLRKNSYRSFPIALVREVAKQLLECIAFMHELRLIHTDLKPENILLVSPEYIKVPDYKVSSRSPKEGSYFKQLPKSSAIKVIDFGSTTYDQQDQTYVVSTRHYRAPEVILGLGWSYPCDIWSVGCILVELCTGEALXXDHXNLEHPAMMERVFGPLPCHMLQKXDRHSEKYVRKGRLNWPEGCASRDSMKAVMKLPRLQNLVMQNXDHSGGEFIDLLQGLLRYDPASRLTAQEALRHPFLREQSERRR

SEQ ID NO: 3465 - protein, 410 aa, ASPERGILLUS NIDULANS FGSC A4
MASARSPRWQQIQDLIMIAGTSATAYFLVRHLLSRLDFDPDRQKKEEQQRKSAAILRKLDGNLDENSSGESGGKTRKGDLVLNQYEQAIAMDVVAPEDIPVSFKDIGGLEDIIEELKESVIYPLTMPHLFSSTSSLLTAPSGVLLYGPPGCGKTMLAKALAHESGASFINLHISTLTEKWYGDSNKLVNAVFSLARKLQPSIVFIDEIDAVLGTRRSGEHEASGMVKAEFMTHWDGLTSANSLGEPQRVVVLGATNRMQDIDEAILRRMPKKFPVELPPAAQRLGILSLVLKDTKIDRQNFDLHYLVKAMAGMSGSDIKEACRDAAMVPVREFIRQKTAQGLKITSVDPSEVRGLRTEDFFASAGGAQRFIPVATQNIPPETSSEKEWSTEDEAASENGTQQSRTTQAEA

SEQ ID NO: 3466 - protein, 136 aa, Triticum aestivum
MTMMKAPTSTSYSYLILAPVAILLLIFLLSSLSRTGAGAGSDGLGVLCARRAGAGHSVSARAEAAEPELSLLVGILTMPKRRERRDIVRLAYALQPPAAGARVDVRFVFCNVTDPVEAALVALEIMHHGDIIVLDC

SEQ ID NO: 3467 - protein, 454 aa, Neurospora crassa
MADLVGRKIFKVFNQDFIVDERYTVTKELGQGAYGIVWYVHLLLLPFLLSRLCFWAAAHLHVSCHILMIQADLPFLLNSAAVNTQTNEGVAIKKVTNVFSKKILAKRALREIKLLQHFRGHRNITCLYDMDIPRPEMFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQNYTKAIDVWSVGCILAELLGGRPFFKGRDYVDQLNQILHILGTPNEETLSRIGSPRAQEYVRNLPPMPKKSFQQLFPQANPDALDLLDRMLAFDPTSRISVEDALKHPYLAIWHDASDEPDCPTPFNFDFEVVDDVGEMRKMILDEVFRFRQLVRTVPGGQGQGGAQPQAPAQVPMPTDVHSQQWTAEDPRPHEYGAYNGGLEAELGGM

SEQ ID NO: 3468 - protein, 362 aa, Xanthomonas campestris pv. campestris str. ATCC 33913
MSTASVMDLVRDDLRAFAGYASARTSALQGDVWLNANESAWGNPADPDASTRRYPDPQPKGLRAALAQLYGCATEQLLIGRGSDEAIDLLVRGLCVPERDAVVVTPPVFGMYAVCARLQSAPLVEVPLVDGADGLHADVPAIVQAALDAKAKLVFLCSPSNPAGSAIPLAEIEAALQALQGKAVVVVDEAYGEFSDVPSAIGLLARYDNLAVLRTLSKAHALAAARIGSLIANAELIALLRRCQAPYPVPTPCAVMAEQALSAPALAVTQRRVTEIRAERARLHAALVQVAGVRQVYPSQGNFLLVRFDDAEAAFQALLEAGVVVRDQRAVPRLSDALRITIGTPDQNDRVLGALQRKQEAA

SEQ ID NO: 3469 - protein, 483 aa, Burkholderia fungorum
MMERGGDMQRSTETTELKAGLKQRHMTMIALGGVIGAGLFVGSGVVVQQAGPAAVLSFLITGALVVLVMRMLGEMACAMPAVGSFYEYARLAFGGKRACGNLAGFLTGWMYWYFWVIVVAVEAVAGAKLVQFWLPDVPAWAISLVLLVTLTATNLVSVGSYGEFEFWFASIKVAAIMVFLFLGSMYVLGLWPASKHVTEVLPTLFSHGGLMPKGIGPVLSGAVAATGFYFGAEIVTIAAAEAQEPAKAVARATNSVITRVLVFYVGSILLVVALVPWNSPKMATPYVSALDAMGIPAAASVMNAIVLTAVLSALNSGLYAASRMIFALTRHGDAPAALARVNRRGVPVRAILIGTVFGYASVVMSYVSPDTVFAFLVNSYGTVAIFVYVLIAISQLKLRARIERDAPQTLRVRMWCYPYLTWVSIIGMVGILVAMAFIPEQRQPLWFGVASLGVLLLAYPLRGRRSDAMPGEPETVEYRHHHR

SEQ ID NO: 3470 - protein, 566 aa, Microbulbifer degradans 2-40
MYRYVLGVKPSFLLFWLLMAAPSFAAKPDGKQKAIDPFWNNAIVYFLLTDRFANGDTSNDRNFDRAQDGAVLRNFMGGDIKGITQKIRSGYFTALGVEVLWMTPVVEQIHGYWDEDWGRSYPFHGYWPKDWTSVDPNFGTETDLKEMIATAHAYGIRVLADVIINHTGLKTKVDVAWPQDWIRTEPTCEWHSYIHNVTCALAPSLTDVRTESNKPVALPEFLLEKWRNEGREKQELAELDAFFERTNLPRAPQNYIVKWLTDWVREYGIDGFRVDTAKHVEAEIWQVLKVEASTAFNEWKAKNPNALPDEKDFFMIGEVMHFGVNGFKNTPAGTRNYDYGDKQVDFFNYGFDSLINMGFATHASDSMETIFSTYSKELHQGPLQGVGILNYVVSHDDPEPHDKEHTKPYETALKLMLAPGAVQIYYGDELARNLIVEGAVGDATWRSFMNWQDIATVETQLLLQHWQKLGTFRKHHMAVGAGIHKIRSNKPYIFSRVLHDATHADKVLVGIELNKGEKVLPTYSIFNNGDVVKDYYSNTLVTVEGGKVVLNTPYEIVLLGEYHAIN

SEQ ID NO: 3471 - protein, 120 aa, Glycine max
  unsure (1)..(120): unsure at all Xaa locations
AASMISSPAVTTVNRAGAGMVAPFTGLKSMAGFPTKKTNNNITSITSNSGRVQFIQVXPPIGKNKFKTLSYLPDRNNTQLSKKVQYLXKKDXIPYYKFELKHDFLYPEHNRSPRYYNKRY

SEQ ID NO: 3472 - protein, 524 aa, Neisseria meningitidis MC58
MAQIQMSANVKTINAVFAAMLVGTVGYFIYWGLGYTHYNYAALFIIATMFGVFMAFNIGGNDVANSFGTSVGAGTLTIPQALLIAAVFEVSGAVIAGGEVTNTIRKGIVDLKGVDFEPIQFVFIMMSALLAAALWLLFASKKGLPVSTTHSIIGGIVGSAVCMAVMNDAASGDLIRWGKLGGIGVSWVLSPVLGGAVSYFLFSRVKKNVLDYNAWAEGTLKGIKQEKKAYKERHRLFFEGLSEAEKVEYATKMAHDAQIYDEPEFDPQELQSEYYRGLYAFDNRKNNVDSYKALHSWIPFIASFGAMMISAMLIFKGLKNLHLGMSNVNSFLTIFMIGAAVWMGTFVFAKSLKRKDLGKSTFQMFSWMQVFTACGFAFSHGANDIANAIGPFAAIMDVLRTNSVAAQNVVPPIAMLTFGIALIVGLWFVGKEVIKTVGTSLAEMHPASGFTAELSAASVVMGASLMGLPVSSTHILVGAVLGIGLVNRNANWKLMKPIGLAWVITLPAAAVLSVVCYLVLQAVF

SEQ ID NO: 3473 - protein, 277 aa, Salmonella enterica
QLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQVAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTL

SEQ ID NO: 3474 - protein, 370 aa, Tropheryma whipplei str. Twist
MKDKGYPVVQFLRPDGSFCPSETAEPFLSHAQSLDVEDIQRFYRDIILVRQIDHEAALLQRRGELALWPPVYGQEASQIGATYACSENDMIFPSYRDHAVMHARGIDLVHIAKLFRGASNNDWDVRQHKVWGYTLCIGAQVLHSTGYAIGIVLERQMSCTDDNSGYPEAVMVWFGDGASSQGDVSESMVFAARYQTPQVFMLQNNQYAISVPASVPSAACPLYKRGYGFGIPGIRIDGNDVIAAYAVVREYMDRARSGKGPHLIEAFTYRLGAHTTSDDPTRYRSEDEHREWLALDPIIRLERYLFSLGVEKTWFDRIRADIQLSVIGFRNAVLSIPQPDTKKIFDNVYSAYHPLVSSQSAHLLGLTESR

SEQ ID NO: 3475 - protein, 363 aa, Shewanella oneidensis MR-1
MEIKYDLKPASERRTEQFKPEGNVGFGSLRTDHMFLMDYHDGEWRDPRIVPYGPFEMAPGAMALHYGQSIFEGAKAFMHEDGEIYTFRINKNAERMNRSADIVCIPNIDEQMQIDAINALIDVDRLWFPMQEGACLYIRPFIFATEDRLSVSPSSRYTFCVVLSPSGAYYAAGVNKGIRLLISKTYHRAVSGGTGASKAAGNYAASLRAGKAAAQFGASQVLYLDANNQQIEEAGAMNHFHILKDGTVIIPTFTDTILKSITSQSIMELSELLGCEVRQETVMLDKFIADIESGEIIEAGGFGTAAVVSAVGSYIFEDGRVVTVGNGEVGEHIQRIYKLYTDIQKGHVQGPEGWVKRVERVAP

SEQ ID NO: 3476 - protein, 225 aa, Elaeis guineensis
WTAEENRHGDLLNKYLYLSGRVDMKQIEKTIQYLIGSGMDPRTENSPYLGFIYTSFQERATFISHGNTARHAKEHGDVKLAQICGTIASDEKRHETAYTKIVEKLFEIDPDGTVLSFADMMKKKISMPAHLMYDGQDDNLFEHFSAVAQRLGVDTAKDYADILEFLINRWKVGELTGFSGEGKRAQDFVCTLAPRIRRIEERAQERAKQAPRIPCSWIYGREVQL

SEQ ID NO: 3477 - protein, 498 aa, Nicotiana tabacum
METPTWTAYAAACLATLSLFLLSKFLRQRKLNLPPGPKPWPIVGNFNLIAPLAHRSVHELSLKYGPIMQLRFGSFPVVVGSSVEMAKVFLKSMDINFVDRPKMAAGKYTTYNYSNITWSAYGPYWRQARKMCLMELFTAKRLESLEYIRTEELQSLLHDLYNLTGKPILLKDYLMTLSLNVISRMVLGKRYLDESKNSIVTPEEFKKMLDELFLLNGVLNIGDYIPWIDFMDLQGYVKRMKVLSNKFDRFLEYVLDEHNARRNAEENYVAKDMVDVLLQFADDPTLEVKLERHGVKAFTQDLLAGGTESTAVIVEWAISELLKKPEIFNKATEELDRVIGQNRWVQEKDIPNFPYIEAIVKETMRLHPVAPMLTPRLCGEDCKVAGYDILKGTRVLVSVWTIARDPTLWDEPEAFKPERFLGNSIDVKGHNFELLPFGAGRRMCPGYNLGLKVIQASLANLLHGFKWSLPDNMTPEDLNMEEIFCLSIPKKIPLAACD

SEQ ID NO: 3478 - protein, 545 aa, Haemophilus somnus 129PT
MMKLNDIKRLYKIVRVFLSYGIDEILPHNKYTRSIRCWRMLFFWLKNKHKNKAFGLCLRLALQELGPVWIKLGQMLSTRRDLFPAEIADELALLQDNVEAFSGKIARQQIEQALGSSLENWFTDFDENALASASIAQVHTAKLKLGEEQEKEVVIKVLRPNIQPQIEADLSWMYKLAGLLPKLFREGYRLRAVEVIQEYEKTLRDELDLRVEMANAIKLRENFLDSPMLYIPKMYEAFCHKNVIVMERIYGIPVSDVETLQRNGTDMKLLAERGVQVFFTQVFRDSFFHADMHPGNIFVNPHYPENPQYIGIDCGIVGKLNESDKRYLAESFVAFFNRDYRRVAQMHVDAGWTPQDTNIDDFEQAFREVCEPIFAKPLSEISFAQVLLNLFNVAREFNMQVQPQLVLLQKTLLYIEGLGRQLYPQLDLWDTAKPFLQNWLNEQIGMKVTFKKLKAKLPYLQEHLPDFPETLMDALKQQKFISQQLVEINKKLAKQQRWQKKMFVLIVGIVIFSVTLWQFAALPLAISAGLFLVGFLVWLIGFLLP

SEQ ID NO: 3479 - protein, 812 aa, ASPERGILLUS NIDULANS FGSC A4
MSGRTPVTIVVEHLDPELGTWSALEYGCIARESHAAGSRFLLSSVPKSLQMPDDLAATKGLEVEHRSVEEVFSDRQSKICLLDPSAKVELSPADGDTFEVFLFGGILDRTSELRKKGYEGRRLGPVQMTTDTAVRVTRMVVHDRVPLEEIQYIDNPEIVINEHERTEMPFRYVKDSKGKPIMPEGMVELIKKDAEKTSSLLSLKCGKPTDPDIPFLAQSAADYYVESLPGAPEGPLLKMHAGHIEVDPEHNGHLFFWHYQNRHIANRQRTIIWLNGGPGCSSMDGALMEIGPYRLKDNETLEYNEGSWDEFANLLFVDQPVGTGFSFANTNSYLHELDEMAAQFITFLEKWFAVFPEYERDDIYIAGESYAGQYIPYIAKAIQDRNKDIHEKQSSSARWNLRGLLIGNGWISPAEQYPAYLSFAYEEGLVEEGSKLGKELETLLSICKSKMETGPKISITDCEAVLNKLLDKTVDSNNQCINMYDIRLRDGSCGTTWPPDLVDVKPYLHTYEVIQALNISPEKESGWDECDGNVGAAFRPQKSEPSVKLLPGLLESGIEILLFSGDKDLICNHVGTEQLISNMKWAGGTGFETSPGVWAPRHDWTFEDEPAGYYQYARNLTYVLLYNASHMAPFDLPRRTRDMVDRFMHVDIASIGGAPADSRIDGEPLPQTSVGGQPNSTVHQEEEQQKIKETEWNAYAKSGEAVLVVVIIGVLVWGFLIWRSRRRHNGYSGIAIKSPSRTSIMGRFHNNHSNGADVEAGDFDEAELDDLHSPGLDRENYAVGEDSDDEAHRQDLPRAQESSSKSENNLVT

SEQ ID NO: 3480 - protein, 505 aa, Alteromonas sp.
MIYAKPGSEGSVVSFKESYGNFINGEWVAPVKGEYFTATSPVDGSDIAQVPRSTSEDVELALDAAHAAKKGWAEKSVAERSNVLLKIADRIEENLELLAVAETWDNGKAVRETLNADIPLCADHFRYYAGCIRSQEGTIGEIDKNTVAYHFHEPYGVVGQIIPWNFPLLMAAWKLAPALVTGNVVVLKPAEQTPVSILLFAELIQDLLPPGVLNIVNGFGAEAGQALATSTRIAKIAFTGSTPVGGHILRCAAENLIPSTVELGGKSPNLFFADIMDHEPEFIDKCAEGLVLGYFNQGEVCTCPSRAIIQEDIYDAFMEKVLEKIQKIKRGNPLDTETMVGAQASNEQFEKILKYIDIGKSEGAQVVTGGEKEQLPGFDDGYYIQPTILKGENHMRVFQEEIFGPVIAVQTFKTEEEAIEIANNTSFGLGAGVWSRDANVAFRVGRAIEAGRVWTNCYHLYPAHAAFGGYKKSGIGRETHKMMLDHYQQTKNLLVSYDINPLGFF

SEQ ID NO: 3481 - protein, 530 aa, Blumeria graminis f. sp. tritici
MGIPESFMSPYLQPLLQFGFSIALASGIISLLLLLTFLNVLKQLLFKNPNEPPIVFHWIPIIGSTISYGMNPYKFFHESQAKYGNIFTFILLGKKTTVYLGRQGNNFILNGKLRDVNAEEVYSVLTTPVFGTDVVYDCPNSKLMEQKKFMKAALTTEAFRSYVPIIQNEVESFINKCDDFRKSEGIINIAAVMAEITIYTASHTLQGKEVRDRFDSSLAVLYHDLDMGFTPINFMLHWAPLPHNRARDHAQRTVAKIYMEIINSRRTQKETDNSNLDIMWQLMRSSYKDGTPVPDKEIAHMMIALLMAGQHSSSSSSTWIMLWLAARPDITEELYQEQLEILGSELPPVKYEDLSKLTLHQNVVKEVLRLHAPIHSILRKVKNPMPVPGTSYVIPKTHSLLAAPGWTSRDASYFPNPLKWDPHRWDTGSGGVIGTDMEDEKFDYGYGLISTGAASPYLPFGAGRHRCIGEQFATVQLVTIMATMVRSFKFHNLDGRNSVAETDYSSMFSRPMAPATIAWEKRDKKDKTEC

SEQ ID NO: 3482 - protein, 489 aa, Ralstonia metallidurans
MQPEDFAMQLKDPSLFKQLAYVDGQWISADSGATFDVTDPATGEVIARVADLGAAETTRAVAAAEVAQKAWAAKTGKERANILRRWFDLMLANTDDLAYLMTREQGKPLAEAKGEIAYAASFIEWFAEEAKRVDGEVLATPAADKRLVTLRQPVGVCAAITPWNFPAAMITRKVAPALAAGCAIVIKPAELTPLSAFALAELAHRAGVPAGVLQVVTGDARNIGGVLTASPIVRKLSFTGSTEVGRILMAQSAPTIKRLSLELGGNAPFIVFDDADVDAAVEGAIVAKYRNGGQTCVCANRFYIQDGIYDAFAAKFAERTAQLRVGNGLEAGVVIGPLIEDAAIEKVNSLVEDATSKGGKVLAGGGKHPLGGTYYTPTVIGNATADMRMAREEIFGPVAPLFRFKQDDEAVAAANATEYGLAAYLYTRDISRAWRTAEALEYGMVGLNTGLISNEVAPFGGIKQSGVGREGSRHGIEEYLEIKYLCLQM

SEQ ID NO: 3483 - protein, 460 aa, Schizoseris condensata
WDPEYVIKETDVLALFRVSPQPGVDPVEASAAVAGESSTATWTVVWTDLLTACDLYRAKAYKVDPVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEEMYERAEFAKQLGTVIIMIDLVIGYTAIQSMGVWARRNDMILHLHRAGNSTYSRQKIHGMNFRVICKWMRMAGVDHIHAGTVVGKLEGDPKMIKGFYDTLLQPFLAVNLPEGIFFTQDWASLRKVTPVASGGIHCGQMHQLLDYLGNDVVLQFGGGTIGHPDGIQAGATANRVALESMVIARNEGIDYVKEGPQILLDAAKTCGPLQTALDLWKDITFNYTSTDTADFVETPTANV

SEQ ID NO: 3484 - protein, 649 aa, Vibrio vulnificus CMCP6
MTQIFLQAFIYLIAAVIAVPLAKRFGLGSVLGYLIAGVVIGPIVGLVGEETTTIQHFAEFGVVMMLFLVGLELEPKMLWAMRNRLLGLGGLQVAGTAGIIVAIAVYFGQVWTTALAIGLIFALSSTAIVLQTFNEKRLSKTEGGKNAFSVLLFQDIAVIPMLAFIPLLALPELVEQAQQSIQSASEHHEQLSLVAGLPGWAYGIVITLSIGVVIVGGHYLSRPIFRYVADSGLREIFTAAALMLVIGIAALMSLVGLSPALGTFLAGVMLANSEFRHELESNIEPFKGLLLGLFFITVGAGIDFTILFNKFGTIIGLTLAVMLLKALVLLALSFIFRIKGSDRWLFALSLAQAGEFGFVLLSFSVQNHVISTPLSQQLSLVVAISMFLTPGLFILFDRVILPKFATKFNERADDDIDEKGTVIIAGIGRFGQIVNRLLLSNGIKTVALDYQANQVDVMRQIGTQAYFGDVTRPDILHTAGIEEAAAIVVAIDNRDASVELVKQVKHAYPSVKVIARAFDRGHGYRLRQAGADVIESETYHSALEVGGQTMKLLGVHPFFVEQQKMRYKRVENRKSDSLYSAWLDDSEGERFDNNYRKLFMQLEEKMMLEMQKDRHTNLSRSERGWTPPPKDYADDLQELNNEVNDLNFK

SEQ ID NO: 3485 - protein, 475 aa, Pseudomonas aeruginosa PAO1
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQASGQPIEFRMWLYPWLTWAVILFIVAALSIMLIMPEHRHEVFATALLTIFTVCLGLLNARRKPRLGEDYAGKTARV

SEQ ID NO: 3486 - protein, 775 aa, Glycine max
MQQGDPTVLSLRPGGGRGGGSRLFAHSSSSSSLSADLPLSRPHASFSLKTGDSRFEGHERVRYTRDQLLQLKEAVEVPDDILKIKQDIEAELFGEDPSWGRAESNLPHQLQNRYSEPDNRDWRGRSGQPPASTDERSWENLRDNREFGNRQQDASQVNRHDQLNSQFARTQISSMQGGGPTPTLVKAEVPWSARRGSLSEKDRVLKTVKGILNKLTPEKFDVLKGQLIDSGITSADILKDVISLIFDKAVLEPTFCPMYAHLCSDLNEKLPPFPSEEPGGKEITFKRVLLNNCQEAFEGAENLREELKRMTVPEREMERTDKGRLLKLRTLGNIRLIGELLKQKMVPEKIVHHIVQELLGSPDSKSCPVEENVEAICQFFNTIGKQLDESPKSRRINDIYFSRLKELSSNLQLVPRLRFMIRDVIELRASNWVPRREEVKAKTITEIHSEAEKNLGLRPGATASMRNSRGGVQGNASSGGFHIARPGAGGLMPGMPGTRKRPGFDNDNWEMPKTRSMPRGDSSGVQAAGCSNSALLSKSTTLNSKLLPQGSGGIISGRNSALVHGGGTFSTSSTNFCLGPEAAPQLSSPAPVPVSSEKPQPPAARLNTDDLCRRTVSLLEEYFSVRLLEEALQCVEELKSPSYHPEVVKEAIYLALDKSPPCVETVANLIEYLYIKKILTPLDIGTGCLLFGSLLDDIGIDLPKAPSNFGEIIGKLILAGGLDFKVVGEILKKVDDDMFRRAIFDSVVGAIRSASEQAILDAQTSDIEVCQSQLK

SEQ ID NO: 3487 - protein, 821 aa, Debaryomyces occidentalis
MSDSQSNKQNQGEDDNNVSSSIESNENYPFRLNDEESEPQSSTTESMLKAKKQSWRQVLMLGFSSLGAIYGDIGTSPLYVLNSIKYPNSSPTEEDIYGAISIIFYLFTFIVIFKYILIVLFLGTNDGEGGQVAIYAKIARSLKIGPKGVHIPGSPEKTDLELLARAETSSSFKSSNLFLNKASGFKTNPKLIKFISKFILFGCFFGCSLVMSDGLLTPTTSVLSAIAGIQIANPSFNDVLAVSEVVLIVLFLIQQFGSNKISFTFAPIIFLWLIGLIISGIYNIVKFHPAVFKSLSPYYAIQLLKHSGIDVFSGAMLSITGTEAMFADVGHFGRLPIQLTLTLFVYPALIICYLGQGAYIIKHPEALSNPFFYSIPGGLNSWIYWVMFVLATLSTIIASQALILGVFSITSQLINLDCFPNFKIIHVSKKYAGKVYIPAINWLLMIGVCATTAGFKNSNNVTAAYGLGITLDFLVTSSLIMVCMTYVYNWNILIPITYALIFLPLEVIMVISNLKKITHGAWFPLMMSGIFMMFLSFWRWARSRKVNQDFKTRIRIGDLYPELKKQPPQSETVDLNDRGRPMSIVNSSNEELVEYGVTLPKILKTNNNQLKVQSKFGLMNLKKYDGIAIMYNDSSVHTLNSPNTVPQVYGKLVSSFSSIPSVFIFCSIRVLSIPTVPNDERVLIGSMKIPGHYRCIIRYGFMEEILIDKELNNHILNSIPDINELAIKFNLNNKCILTKPCTIPILHIFENNLIRSHDYSSEEHETKNPLVKCKRFIRKILINHIFSPIYSDFQSNGKFLKISDEDEESEKKMFLGGVVRI

SEQ ID NO: 3488 - protein, 527 aa, ASPERGILLUS NIDULANS FGSC A4
MADAVIAGQRVEAPVTWKAYLMCVFAAFGGIFFGYDSGYINGVMGMDYFIQEFTGKVKSETPAAQFVISSSNKSLITSILSAGTFFGAIIAGDLADWYGRRITIINGCGVFMAGVAFQIASTTVPMLVVGRLIAGVGVGFVSAIIILYMSEISPRRFRGAIVSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQWTGVNFVFYFGTTFFQNLGTIDDPFLISMITTIVNVFSTPISFYTMEKLGRRPLLLWGALGMVVCQFIVAIAGTVDGDNSKTVSAQISFICIYIFFFASTWGPGAWVVIGEIFPLPIRSRGVALSTASNWLWNCIIAVITPYMVDIDKGNLKSRVFFIWGSLCACAFVYVYFLIPETKGLTLEQVDKMMEETTPRTSAKWKPHSTFATEMGMTEKNASTTVESAA

SEQ ID NO: 3489 - protein, 350 aa, Pseudomonas fluorescens PfO-1
MSKFWSPFVKDLVPYVPGEQPKLTRLVKLNTNENPYGPSPKALAAMQAELNDNLRLYPDPNSDLLKNAVAKYYGVQNNQVFLGNGSDEVLAHIFHGLLQHDQPILFPDISYSFYPVYCGLYGITFDAVPLDAQFRINPADYAKPNGGIIFPNPNAPTGCLLALEAVEQILKGSPDSVVVVDEAYIDFGGETAISLVDRYPNLLVTQTLSKSRSLAGLRVGLAVGHPDLIEALERIKNSFNSYPIDRMANVGAAAAFEDREYFDKTCALVIESREWVVAQLQAKGFEVLPSAANFIFARHPQHDAAGLAAKLREQGVIVRHFKQERIAQFLRISIGTPEQNQALIDGLGEL

SEQ ID NO: 3490 - protein, 471 aa, Mastocarpus papillatus
  unsure (1)..(471): unsure at all Xaa locations
SGVIPYAKMGYWDPDYXXXETDVLALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYAMXXXXXXXXXXXXXXXXXXXXXXXXXXXXXXXXXXXXXXXXXXXXXXXXXGYTAIQSMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMIIARNEGRDYVAEGPQILQDAAKTCGPLQTALDLWKDITFNYTSTDTADFVETPTANV

SEQ ID NO: 3491 - protein, 389 aa, Oryza rufipogon
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPAADAAATAQVEAAS

SEQ ID NO: 3492 - protein, 92 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDP

SEQ ID NO: 3493 - protein, 352 aa, Chlorobium tepidum TLS
MMYKIVSIPGDGIGPEVVAGALDVLNAVAKKHGFEVSVEEHLFGGASYDVHGSMLTDETLEACKNCDAVLLGAVGGYKWENLPHDKKPEAALLKIRKELGLFANLRPARVYDALVASSTLKTEVVQGTDFMVFRELTGGIYFGQPRGYDETRGWNTMVYERYEVERIARLAFEYAQKRGNAKVTSIDKANVLEVSQFWRNIVHEVHQDFPEIELVDMYVDNAAMQVVRNPKQFEVIVTSNLFGDILSDISGMITGSLGMLPSASIGSEHALYEPIHGSAPDIAGQNKANPIATIASVAMMFENSFNRPEVAADIYAAIEGALAAGFRTGDIAAAGEAISSTTEMTAAIVARI

SEQ ID NO: 3494 - protein, 468 aa, Haplospora globosa
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPATGVVVERERLDKFGRPLLGATVKPKLGLSGKNYGRVVYEGLAGGLDFLKDDENINSQPFMRWKERFLYCMEGVNRAAAATGEVKGSYLNVTAATMENMYERAEYSHAIGSVICMIDLVVGYTAIQSMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFDYTSTDTPDFVEVATESN

SEQ ID NO: 3495 - protein, 197 aa, Glycine max; identical to SEQ ID NO: 1760

SEQ ID NO: 3496 - protein, 102 aa, Salmonella enterica
AAATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPK

SEQ ID NO: 3497 - protein, 379 aa, Cucumis melo
MPSLTAPHGLPLFLFLLLFLFSSVSAQFQPAPDPRSDPYQYRLSGSMAVIIVILIAALFFMAFFSVYIRHCNDSPSNTVRPITAAAGRSRRATRGLDPAVIETFPTLIYSDVKEHKIGKSALECAVCLNEFEDDETLRLIPKCDHVFHPECIDAWLASHSTCPVCRANLSPQPTDSVHRADDSNAVVNSDTDGGDIEAQSNDVVSETTAPPTVQIQTESELSTTTSNKALNRTRTRGSRSNRLRWLFPRSHSTGHSLVQPGEDTERFTLRLPVEIRKQVVNRKLHRATSMVVLARQSSSMRGYRFGSGEGSSRGKYYRRLERLDRTSKSDRWVLSMTPPFFTRMSSMKTPRGGSNRAEPGSGRELGQGNTAVDSSRLPV

SEQ ID NO: 3498 - protein, 294 aa, Thermobifida fusca
MQLGMIGLGKMGGNMAARLRDKGHEVIGYDVNPELRDVDSIAELVERLSAPRTVWLMVPAGEPTRNTIRELADLLDEGDLVIEGGNSHYRDDRVHADELARRGIEYLDAGVSGGIWGRENGYGIMVGGSAENVARAKPIFDALTPEAGSGFVHAGEIGAGHFVKMVHNGIEYGMMQAFAEGYELMAASGIVKDVPGTLASWRQGTVVRSWLLDLLVRALEEDPELEQLRGYAEDSGEGRWTVQAAVDHAVPAPVITAALYARFASRQEDSPAMKVIAALRNQFGGHAVVKKNTD

SEQ ID NO: 3499 - protein, 484 aa, Geobacter metallireducens
MDVRAQLVMVFNLDKCIGCHACSLSCKNIWTDRKGAEYMWWNNVETKPGVGYPKKWEDQEEFKGGWVADGHNLRLKAMGKGPTLLNMFFQPNMPKLEDYYEPFDFDYGNLYGAKGGDDQPVAEAFSQITGEKMAHIKAGPNWDDDLSGSQVYASADVNLEDKKIIEQYSTMFMQYLPRICNHCANPACVASCPSRAIYKRGEDGVVLVDQEVCKGWRFCTSACPYKKVYFNWNSGKAEKCIFCFPRTETGQCNACAHSCVGRIRYVGVLLYDAEKVEQALLKPDNQLVEAHRGVILDPRDEAVREGARKNGVPEQWLEAAEKSPVYALIKEFELALPLHPEFRTMPMAYYIPSLSPVLTSGGELHELVEHGTIPTREALRAPIGYLASLFGGGNRDVVAAALEKLIALRIHMRAKNLNQPTDEASLGKAGLDEAGAKRLYRLFTIGGYNERNIIPPQQREELDSHTRKGASGFGILKKTGRGKR

SEQ ID NO: 3500 - protein, 438 aa, Desulfovibrio desulfuricans G20
MALFTKEEALHYHEAPRHGKVEVIPVKPCRNQKDLSMAYSPGVAEACKAIKEDPSKAEIYTGRSNLVAVVSDGTAVLGLGNIGPLAGKPVMEGKGVLFKTFADIDVFDINLDVSSADQLIGVVKALEPTFGGINLEDIKAPECFYIEDTLKKEMNIPVFHDDQHGTAVISGAGLLNALEITNRKAENMKVVVVGAGAAGIACAKFYVSLGVDPANIYMFDSRGLIHKGRKDLNEYKALFAQPSDAGTLAEVMKGADMFLGLSTKNLVSQDMVRSMAKDPVLFAMANPDPEITYPDAKQASPNCIMGTGRSDFPNQVNNVSGFPYIFRGALDVGATEINEEMKVAAARSLAALAKEPVPSEICDMYGVKELTFGVDYVIPKPLDPRVLVWETPAVAKAAMDSGVARKPIADMEAYKKQLTTRFDESRKRIARVVDSYGL

SEQ ID NO: 3501 - protein, 253 aa, Zea mays
  unsure (1)..(253): unsure at all Xaa locations
MAPSAVDSTHHSADGNRPGDIHRDYLDDRNAKAQDTLYTTSNGVPMPHPYETQRVGENGPLLLQDHHLIDLLSHFDRERIPERVVHAKGGGAHGIYRTTDALDDLCLADIFQQGHECPITVRFSTVGGESGTPDLARDPRGFSVKFRTAEGNWDMVANNTPVFFLRDPAKFPHFIHTHKPPPXTHLTHSDDSTVFWDYPSQNPEPAHQVLXISWRDRRLPHRWRKMHGYAGHTLKLVNKNGDWVYXQMHMKSK

SEQ ID NO: 3502 - protein, 430 aa, Synechococcus sp. PCC 7942
MKNVLAIILGGGAGSRLYPLTKQRAKPAVPLAGKYRLIDIPVSNCINADINKIYVLTQFNSASLNRHLSQTYNLSSGFGNGFVEVLAAQITPENPNWFQGTADAVRQYLWLIKEWDVDEYLILSGDHLYRMDYSQFIQRHRDTNADITLSVLPIDEKRASDFGLMKLDGSGRVVEFSEKPKGDELRAMQVDTTILGLDPVAAAAQPFIASMGIYVFKRDVLIDLLSHHPEQTDFGKEVIPAAATRYNTQAFLFNDYWEDIGTIASFYEANLALTQQPSPPFSFYDEQAPIYTRARYLPPTKLLDCQVTQSIIGEGCILKQCTVQNSVLGIRSRIEADCVIQDALLMGADFYETSELRHQNRANGKVPMGIGSGSTIRRAIVDKNAHIGQNVQIVNKDHVEEADREDLGFMIRSGIVVVVKGAVIPDNTVI

SEQ ID NO: 3503 - protein, 693 aa, Nicotiana tabacum
MATSSVCIAGNSLSTHRRQKVFRKDIYGRKILFSSNLPSSSKTSRIAVKASLQQRPDEGRRGFLKLLLGNVGLGVPALLGDGKAYADEQGVSNSRMSYSRFLEYLDKDRVQKVDLFENGTIAIVEAISPELGNRVQRVRVQLPGLSQELLQKLREKNIDFAAHNAQEDSGSFLFNLIGNLAFPLILIGGLFLLSRRSPGGMGGPGGPGNPLAFGQSKAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVVAATNRADILDSALLRPGRFDRQVSVDVPDIKGRTEILKVHAGNKKFDSDVSLEVIAMRTPGFSGADLANLLNEAAILAGRRGKTAIASKEIDDSIDRIVAGMEGTVMTDGKSKSLVAYHEVGHAICGTLTPGHDAVQKVTLIPRGQAKGLTWFIPADDPTLISKQQLFARIVGGLGGRAAEEVIFGEPEVTTGAAGDLQQITGLAKQMVVTFGMSELGPWSLMDSSAQSGDVIMRMMARNSMSEKLAEDIDGAVKRLSDSAYEIALTHIRNNREAIDKIVEVLLEKETMTGDEFRAILSEFVEIPAENRVAPVVPTPATV

SEQ ID NO: 3504 - protein, 188 aa, Yersinia intermedia
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYK

SEQ ID NO: 3505 - protein, 364 aa, Thermococcus kodakaraensis
MFNVYEFFNRINEVRPESRLDAGQPDIPVRREIIEEAVESLRRGETGYTSTGGIRELRERIAEFEGVSADEVIVAPGAKILIAAEIASAKKVAVVSPRWNAYSLIARQFWREVEVIKTTLDERWIPRVEEIKADLIIINYPNNPTGRVLSGKEIRGLLDVAEENGVKVLSDEVYAELSFTRFTPARELYENVVTVKGFSKLYSMTGFRLGYAIGERNEIRRIQRFIESTVTCVPPFVQRAGVKALELRDELIKEVRRAYLERVRMASKMLRGFDFVEPEGAFYIFLRTPQDGMAFAERLLSRGVAVFPGMAFGDYPNFIRISLSGKGLERGLRVIREELECALESRATEGWEGSSRGVSAEGSR

SEQ ID NO: 3506 - protein, 76 aa, Chlamydia trachomatis
IPGTWEGICAAEVLESQGIACNVTLIFNSVQAIAAAKAKVTLVSPFVGRIYDWWIAAYGAEGYLSKPILELLPSKY

SEQ ID NO: 3507 - protein, 134 aa, Salmonella enterica
RPLCQNRCSAITVPVCTATCRWRKTAPTCVSGDKYAGLFEQALYYIGGVIKHAKAINALANPTTNSYKRLVPGYEAPVMLAYSARNRSASIRIPVVASPKARRIKVRFPDPAANPYLCFAALLMAGLDGIKNKI

SEQ ID NO: 3508 - protein, 427 aa, Batrachospermum pseudogelatinosum
IEASAAVAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAGTMEDMYERAAFAKELGSIICMIDLVIGYTAIQSMAVWARKTDMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILKDAAKTCGPLQTALDLWKDISFNYTSTDTADFV

SEQ ID NO: 3509 - protein, 740 aa, Cochliobolus heterostrophus
MASEILGNVTEKAKDLAGSKSTKMAQLAEVTKDVHDDKWRITSDYGVKQNNTDDWLKVATDDQTGPMLLEDQFAREKIHRFDHERIPERVVHARGSGAFGKFTLFESASDVTSAGILTDTSRETPVFLRFSTVLGSRGSADTVRDVRGFAVKFYTEEGNWDIVGNNIPVFFIQDSMKFPDVIHAGKPEPDCEVPQAQSAHNNFWDFQYMHPEATHMFMWAMSDRTIPRSYRMMQGFGVNTYTLINAKGERHFVKFHFTPELGVHSFVWDEALKIAGQDPDFHRKDLWMAIDSGAYPKWKFGIQVIPEAKEHDFEFDILDATKVWPEELVPVRYIGELELNKNPDEFFTQTEQVAFCTSHIVPGIGFSNDPLLQGRNFSYQDTQLSRLGINWEELPINKPVCPVMNFNRDGAMRHTITKGKVNYWPNRFQTVPPATEKEGGYVEFPEKTAGIKVRMQSKKFREHKSQAELFYNSMSENEKMHMKAAFAFELDHCDDPVVYERLCERLCEIDLELAQSVAEMVGGEQPTKQTRPKHNKTAKGLSQMDFQPEKPTIATRMVAILIADGYDKAAYTGMKAALTAAGALPFTISPRRNKIFADGEDRSGSGVVADHHLEGQRSTMYDSVFVPGGARSIETLSKNGRAVHWVREAFGHLKAIGGTGEAVSFIKQAVDLPGMEFSTSGDVVNSYGVVTATAVQPESFKEAVNMVKEAKDFASAYMYAISQHKNFERETAGLNAMVAY

SEQ ID NO: 3510 - protein, 131 aa, Oryza sativa
  unsure (1)..(131): unsure at all Xaa locations
MADPELEAIRQRRMQELMAQRGAXNPQNAGQQKAQEDAKQXAEERRQMMLAQILSSEARERLSRIALVKPDKARGVEDVLLRAAQSGGISXEKVSEERLISLLEQINXPHLANRRKFTISEAPERPFDDDD

SEQ ID NO: 3511 - protein, 175 aa, Glycine max
  unsure (1)..(175): unsure at all Xaa locations
MGEESSLLKESTSINDTNMVEEVEERDPESNPLNEPLLKRNRTLSSNPLALVGAKVSYIESLDYEINENDLFKQDWRSRSRTQVLQYIFWKWTLAFLVGLLTGVIATLINLAVENIAGYKFLAVVNFIQKERYLRGFLYFTGINFLLTFVASILSVCFAXPTAAGPGIPEIKAIL

SEQ ID NO: 3512 - protein, 485 aa, Saccharomyces cerevisiae
MVHLGPKKPQARKGSMADVPKELMDEIHQLEDMFTVDSETLRKVVKHFIDELNKGLTKKGGNIPMIPGWVMEFPTGKESGNYLAIDLGGTNLRVVLVKLSGNHTFDTTQSKYKLPHDMRTTKHQEELWSFIADSLKDFMVEQELLNTKDTLPLGFTFSYPASQNKINEGILQRWTKGFDIPNVEGHDVVPLLQNEISKRELPIEIVALINDTVGTLIASYYTDPETKMGVIFGTGVNGAFYDVVSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFVFLEDTDDIFQKDFGVKTTLPERKLIRRLCELTGTRAARLAVCGIAAICQKRGYKTGHIAADGSVYNKYPGFKEAAAKGLRDIYGWTGDASKDPITIVPAEDGSGAGAAVIAALSEKRIAEGKSLGIIGA

SEQ ID NO: 3513 - protein, 228 aa, Schizosaccharomyces pombe
MVQAKIAPSLLAGDFANLEKEVGRMLKYGSDWLHVDVMDAQFVPNLTIGPIVVKAMRNHYTKEEAFFDCHLMVIEPERYIDQLADAGASLFCFHYEATEKHEEIISRAHEKGMLVGCALKPKTPVEVILPFVEKLDMVLVMTVEPGKGGQSFMPECLPKVEFLRKKYPTLNVEVDGGLSLKTVDAAADAGANVIVAGTAVFHAQSPEEVISGLRNSVMKAQETKPWFK

SEQ ID NO: 3514 - protein, 306 aa, Musa acuminata
MAIPVIDFSKLDGKERAETMARIANGCEEWGFFQLVNHGIPVELLERVKKVSSECYKLREERFKGSKPVQLLDTLVKEGDGQRLDNVDWEDVFVLRDDNEWPSNPPDFEETMKEYREEIRKLAEKMMEVMDENLGFEKGCIKKAFSGDGQHPPFFGTKVSHYPPCPRLDLVKGLRAHTDAGGVILLFQDDQVGGLQMLKDGRWIDVQPLADAIVINTGDQIEVLSNGRYKSAWHRVLATSHGNRRSIASFYNPSLKATIAPAAGAATEEAAPPALYPKFLFGDYMDVYAKQKYEPKEPRFEAVRAI

SEQ ID NO: 3515 - protein, 688 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRELYRVIKQANKVRLAEFVKVRTGIDINPQAIFDIQIKRLHEYKRQHLNLLRILALYKEIRQNPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAID

SEQ ID NO: 3516 - protein, 415 aa, Zea mays
  unsure (1)..(415): unsure at all Xaa locations
MAMAVSGRWTRVRTLGRGASGAEVFLAADQASGDLFAVKCAPAAAGAELLRRERALMAGLRSPHVVPCILXGGRAGRDGSYQLFLEYAPGGSLADVAAARSGGRLEERAVAAYAADVAAGLAYVHAAGLVHGDVKPRNVVVGADGRAKLADFGCARRAADDDAALPIGGTPAFMAPEVARAEAQGPPADVWALGCTVLAMATGRAPWAAAAGDVLAAVRLIGYTDAVPEVPQWLSAEAKDFLGRCLARRPGDRSTAAQLLEHPFVASKSTLDLDGAKGTWVSPKSTLDAAFWESESDSDSDDDHRHHHDVDVDAVSAQSTADRIGALACPASALPDWWDSDEGWIDVLSAPAEASSDATVDEGPCVGDGGAGTEEEERADQAAEPLDTDADGAHNAGEADASPPDREWPLRVSSP

SEQ ID NO: 3517 - protein, 726 aa, Oryza sativa (japonica cultivar-group)
MEGQSQHRAPEREGSHNYDIESTDGSGGLWRRNGSSSGALLRYNDSGGGRSGSAGEPLLRKRTMNTTSQIAIVGANVCPIESLDYEVVENDLFKQDWRSRKKKQIFQYIVLKWTLVLLIGLLTGLVGFFNNLAVENIAGFKLLLTGNLMLKGKCRYLTAFFAYGGCNLVLAAAAAAICAYIAPAAAGSGIPEVKAYLNGVDAYSILAPSTLFVKIFGSILGVSAGFVLGKEGPMVHTGACIANLLGQGGSRKYRLTCNWLRYFKNDRDRRDLITCGSAAGVAAAFRAPVGGVLFALEEAASWWRSALLWRAFFTTAVVAVVLRSLIEFCRSGKCGLFGQGGLIMFDLSSTVATYSTPDLIAIIILGIIGGIFGGLFNFLLDKVLRVYSIINERGAPFKILLTITISIITSMCSYGLPWLAACTPCPVDAVEQCPTIGRSGNFKNFQCPPGHYNDLASLFFNTNDDAIRNLFSNGTESEFHMSTLFIFFTAVYCLGILTYGVAVPSGLFIPVILAGATYGRIVGTLLGSISDLDPGLFALLGAASFLGGTMRMTVSVCVILLELTNDLAMLPLVMLVLLISKTIADNFNKGVYDQIVVMKGLPYMEAHAEPYMRHLVAGDVVSGPLITFSGVEKVGNIVHALRFTGHNGFPVVDEPPLTEAPELVGLVTRSHLLVLLNGKMFMKDQLKTSGSFVLQRFGAFDFAKPGSGKGLKIQDLDFTDEEMEMY

SEQ ID NO: 3518 - protein, 385 aa, Saccharomyces cerevisiae
MVFDLKRIVRPKIYNLEPYRCARDDFTEGILLDANENAHGPTPVELSKTNLHRYPDPHQLEFKTAMTKYRNKTSSYANDPEVKPLTADNLCLGVGSDESIDAIIRACCVPGKEKILVLPPTYSMYSVCANINDIEVVQCPLTVSDGSFQMDTEAVLTILKNDSLIKLMFVTSPGNPTGAKIKTSLIEKVLQNWDNGLVVVDEAYVDFCGGSTAPLVTKYPNLVTLQTLSKSFGLAGIRLGMTYATAELARILNAMKAPYNISSLASEYALKAVQDSNLKKMEATSKIINEEKMRLLKELTALDYVDDQYVGGLDANFLLIRINGGDNVLAKKLYYQLATQSGVVVRFRGNELGCSGCLRITVGTHEENTHLIKYFKETLYKLANE

SEQ ID NO: 3519 - protein, 278 aa, Gossypium barbadense
ISHELMETVERLTKEHYRKCMEQRFKEMVASKGLEAVQSEINDMDWESTFFLRHLPESNMSEIPDLEEDYRKVMKEFAVELEKLAEQLLDLLCENLGLEPGYLKKVFYGSKGPTFGTKVSNYPPCPKPDLIKGLRAHTDAGGIILLFQDDKVSGLQLLKDGQWIDVPPMKHSIVINLGDQLEVITNGKYKSVMHRVIAQTDGTRMSIASFYNPGSDAVIYPAPALLEKEADKSQVCPKFVFEDYMKLYAGLKFQAKEPRFEAMKPVESAVNLGPIATV

SEQ ID NO: 3520 - protein, 483 aa, Novosphingobium aromaticivorans
MRTLCRIARLGTIQPRDPDYAGAFRAIGPAAIKLGQTLATRPDLVGEDAAHNLLALQDNLPPVDYRLIRAEIERTFEKPLEALFAQFDPEPIGAASIAQVHRAVTTEGHKVAVKVLRPGVRDKLARDIDTYEWAAAHLEAFGGEAERLRPRLVIANFKRWTVRELDLRREAASASELADVMKAHAGYRVPAIDWDRTNGRVMTLDWIDGIKISDTAALEAAGHDRKALASRLVLAFLTQAISGGFFHADMHQGNLFVQPDGTIAAIDFGIMGRIDRRARQWLAEILYGLTTGNYRRVAEIHFEAQYVPSYHSVDEFATALRAVGEPMRGKPVSELSVGQMLDGLFAITRDFDMQTQPHLLLLQKTMVMVEGIATQLDPTINMWDVSAPFVRNWIRDELGPEAAIAERIREDTQTLLRIPDLIRRIEDRFPAKGGAPEAPPLPRIELMWQRKRRKRGSGLSGQFLAFLAGGALVIGTHALGWWG

SEQ ID NO: 3521 - protein, 472 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLRRGGVFSKDWIDSYIAFKEEDVRRIRMAPHPLEFEMYYRL

SEQ ID NO: 3522 - protein, 103 aa, Oryza sativa
  unsure (1)..(103): unsure at all Xaa locations
RSTIHKQNDFKQPGERYRSWSPDRQERFILSFVGELVHPKVFPELRAIWVNFLXSCDESLGVKLFYLFPFFFLIHSHIIILISFYFFFLFSFFFFFFSLFFFL

SEQ ID NO: 3523 - protein, 224 aa, Mycoplasma capricolum
NDVGTQYRTGVYYTDINDKKVIELAFLEYKKKYDEFYVELEELKNYMTAEDYHQDYLDKNPTGYCHVNLNVDFNLTDKEQELIKLIRKELSLDELSLNVLKYSATEKPHTSEFNDEHRKGIYVEKITGEVLFASNTKFNAGCGWPSFAAPINNKAVEYKADYSHNMHRVEVRSKTGDNHLGHVFNDGPKEMGGLRYCINGAAIEFIPYEEMEEKGYFEYKKFLD

SEQ ID NO: 3524 - protein, 137 aa, Glycine max
AIEKRISVYSQIPIENGELMQVLRYEKNQYYKPHHDYFSDTFNLKRGGQRIATMLMYLSDNIEGGETYFPLAGSGECSCGGKLVKGLSVKPIKGNAVLFWSMGLDGQSDPNSVHGGCEVISGEKWSATKWLRQTTHT

SEQ ID NO: 3525 - protein, 517 aa, Candida tropicalis
MIEQLLEYWYVVVPVLYIIKQLLAYTKTRVLMKKLGAAPVTNKLYDNAFGIVNGWKALQFKKEGRAQEYNDYKFDHSKNPSVGTYVSILFGTRIVVTKDPENIKAILATQFGDFSLGKRHTLFKPLLGDGIFTLDGEGWKHSRAMLRPQFAREQVAHVTSLEPHFQLLKKHILKHKGEYFDIQELFFRFTVDSATEFLFGESVHSLKDESIGINQDDIDFAGRKDFAESFNKAQEYLAIRTLVQTFYWLVNNKEFRDCTKSVHKFTNYYVQKALDASPEELEKQSGYVFLYELVKQTRDPNVLRDQSLNILLAGRDTTAGLLSFAVFELARHPEIWAKLREEIEQQFGLGEDSRVEEITFESLKRCEYLKAFLNETLRIYPSVPRNFRIATKNTTLPRGGGSDGTSPILIQKGEAVSYGINSTHLDPVYYGPDAAEFRPERWFEPSTKKLGWAYLPFNGGPRICLGQQFALTEAGYVLVRLVQEFSHVRSDPDEVYPPKRLTNLTMCLQDGAIVKFD

SEQ ID NO: 3526 - protein, 185 aa, Methanosarcina acetivorans C2A
MEPTITIENIVASTRLAEDFDLQKLLDTGLKGAVYNKNKFPGLVYRIENPKAAFLIFASGKVVCTGTKNVENSRIALFNLANELNSIGYKGIYLKPEIHVQNVVASANLRTSLNLNAVLSAFGVENVEYEPEVFPGLVYKLADPRVVVLVFRTGKLVITGGKCPEDCEEGLRIIKTQLDNLGLLY

SEQ ID NO: 3527 - protein, 209 aa, Coffea arabica
DQYEKVEKIGEGTYGVVYKARDRLTNEMIALKKIRLEQEDEGVPSTAIREISLLKEMQHNNIVRLQDVVHSEKRIYLVFEYLDLDLKKHMDSCPELAKDPCLIKTFLYQILHGIAYCHSHRVLHRDLKPQNLLIDRRTNALKLADFGLARAFGIPVRTFTHEVVTLWYRAPEILLGSRHYSTPVDIWSVGCIFAEMVNQRPLFPVDSEI

SEQ ID NO: 3528 - protein, 496 aa, Apium graveolens
MAGSGVYADIIEGDVFKYYSDGEWKKSSSGKSVAIINPTTRMTQFKVQACTQEEVNKAMETAKKVQKQWAKTPLWKRAELLHKAAAILKEHKAAIADCLVKEIAKPAKDSVTEVVRSGDLVSYCAEEGVRLLGEGKFLVSDSFPGNERTKYCLTSKIPLGVILAIPPFNYPVNLAVSKIGPALIAGNALVLKPPTQGAVACLHMVHCFHLAGFPKGLISCITGKGSEIGDFLTMHPGVNCISFTGGDTGIAISKKAGMVPLQMELGGKDACIVLEDADLDLVASNVIKGGFSYSGQRCTAIKVILVMQSVADTLVEKVNAKVAKLTVGPPEDNSDITPVVSESSANFIEGLVKDAKEKGATFCQEYKREGNLIWPLLLDNVKPDMRIAWEEPFGPILPVIRINSAEEGIHHCNASNFGLQGCVFTRDINKAMLISDAMESGTIQINSAPARGPDHFPFQGLKDSGIGSQGITNSINMMTKIKTTVINLPSPSYTMG

SEQ ID NO: 3529 - protein, 237 aa, Abies beshanzuensis
YTYNLRNKGPEDVILRVIYCGICHSDLVQMRNEMGMSHYPMVPGHEVVGIVTEIGSEVKKFKVGEQVGVGCIVGSCRKCGNCNESMEQYCSKRIWTYNDVNHDGTPTQGGFASTMVVDQMFVVRIPDNLPLEQAAPLLCAGVTVYSPLKHFGMTESGKRCGILGLGGVGHMGVKIAKAFGLHVTVISSSDKKKEEALEVLGADAYLVSKDAEKMQEAAESLDFIMDTIPVAHPLEPY

SEQ ID NO: 3530 - protein, 428 aa, Arabidopsis thaliana
MSTKGEHHTVPLSVLLKRESANEKIDNPELIHGQHNQSKKGEDFTLVKTECQRVMGDGVTTFSVFGLFDGHNGSAAAIYTKENLLNNVLAAIPSDLNRDEWVAALPRALVAGFVKTDKDFRERARTSGTTVTFVIVEGWVVSVASVGDSRCILEPAEGGVYYLSADHRLEINEEERDRVTASGGEVGRLNTGGGTEIGPLRCWPGGLCLSRSIGDLDVGEYIVPVPYVKQVKLSSAGGRLIISSDGVWDAISAEEALDCCRGLPPESSAEHIVKEAVGKKGIRDDTTCIVVDILPLEKPAASVPPPKKQGKGMLKSMFKRKTSDSSSNIEKEYAEPDVVEELFEEGSAMLSERLDTKYPLCNMFKLFMCAVCQVEVKPGEGVSIHAGSDNCRKLRPWDGPFLCASCQDKKDAMEGKRSSGDRHSSESD

SEQ ID NO: 3531 - protein, 254 aa, Chlamydophila pneumoniae AR39
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 3532 - protein, 457 aa, Stypocaulon scoparium
  unsure (1)..(457): unsure at all Xaa locations
DYNVKDTDILALFRITPQPGVDPVEAAAAVAGESSTATWTVVWTDLLTACDIYRAKAYRVDPVPGTSDQFFAYVAYECDLFEEGSLANLTASIIGNVFGFKAVKALRLEDMRIPFAYLKTFQGPATGLIVERERLDKFGRPFLGATVKPKLGLSGKNYGRVVYEGLRGGLDFLKDDENINSQPFMRWKERFLYCMEGVNRAAAATGEVKGSYLNVTAATIEQMYERAXFADSIGTVIVMIDLFIGYTAIQTMAIWARKAQMILHLHRAGNSTYARQKNHGINFRVICKWMRMSGVDHIHAGTVVGKLEGDPLMVRGFYNTLLLTELNVNLAEGLFFDMDWASLRKCVPVASGGIHCGQMHQLLYYLGDDVVLQFGGGTIGHPDGIQSGATANRVALEAMVLARNEERDYVAEGPEILRTAAKTCGPLKAALDLWKDITFEYTSTDTPDFVEVATGSN

SEQ ID NO: 3533 - protein, 182 aa, Betula pendula
MACSMISSATVAAVSRASPAQSSMVAPFTCLKSTSAFPVTQKTNNDITSIASNGGRVQCMQVWPPLGLKKFETLSYLPPLSSEQLAKEVDYLLRKNLIPCLEFELEHGFVYREHNRSPGYYDGRYWTMWKLPMFGCNDSSQVLKELEECKKAYPSAFIRIIGFDNKRQVQIISFIAYKPPGV

SEQ ID NO: 3534 - protein, 188 aa, Streptococcus pyogenes M1 GAS
MILLIDNYDSFTYNLAQYLSEFDETIVLYNQDPNLYDMAKKANALVLSPGPGWPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 3535 - protein, 306 aa, Glycine max
MALEAVVFPQDPFTYGCNNKDFLYSLVGGDGGGGGGSHDVKEQWDSHSSPEACTVDQSLPRAFPLPPSSSSPEAAATGRRKRRRTKSAKNKEEIENQRMTHIAVERNRRKQMNEYLAVLRSLMPPSYVQRGDQASIIGGTINFVKELEQLLQCMKGQKKRTKEGSGFSDSSPFSEFFMFPQYSTRATQSSSSSSSKGYPGTCEANNNMARNPSSWAVADIEVTLVDGHANMKILCKKRPGMLLKMVVGLLSLGLSILHLNVTTVDDMVLTSVSVKVEEGCQLNTVDEIAAAVHQLSRTVQEEAVFS

SEQ ID NO: 3536 - protein, 483 aa, Nicotiana tabacum
MATTQNRRSSVSSATAKRQAMTANSSLENNNHGKLVAKKRPALTNISNHTTASARNSLSHSSKLAPCTSKAVSIKKSNSNAASSVLPTSSFVKPISKTVSIPRSDAAIPKITAIPLPATCSMDISPSHSDGSLVSMDETMSTSDSLRSPDVEYIDDNQTAAFDSIEKKAFSTLYISEDVKAADICKRDVLVDIESGDKIANIDNNFVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVVALHSLCCNNNNSSLPAIREKYSQHKYKFVAKKYCPPTIPVEFFQNISC

SEQ ID NO: 3537 - protein, 479 aa, Glycine max
  unsure (1)..(479): unsure at all Xaa locations
VDDIEGSACSHPMVLVQIPMCNEREVYEQSISAVCQIDWPRDRLLIQVLDDSDDESIQWLIKTEVRKWSQKGINIIYRYRLVRTGYKAGNLKSAMSCDYVKDYEFVAIFDQLRRPPPDFLKQTVPYFKDNPELGLVQARWAFVNKDENLLTRLQNINLCFHFEVEQQVNGAFLNFFGFNGTAGVWRIKALEESGGWLERTTVEDMDIAVRAHLNGWKFIFVNDVKVLCEVPESYEAYRKQQHRWHSGPMQLFRLCLPAILRSKISPWKKGNLILLFFLLRKLILPFYSFTLFCIILPLTMFVPEAELPLWVICYIPVFMSFLNILPAPKYFPFLVPYLLFENTMSVTKFNAMISGLFQLGSSXYEWIVLKKAGRSSESDLVAAAEREVKSIMEQQKIHRGASDSVLVESNQCKEHKETNGTPVKKANKIYKKELTLALLLLTASVRSLLSAQGVHFYYLLFQGVTFLLVGLDLIGQQMS

SEQ ID NO: 3538 - protein, 178 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISN

SEQ ID NO: 3539 - protein, 345 aa, Dechloromonas sp. RCB
MALISLRQLLDHAAEHSYGLPAFNVNNMEQIQAIMQAAEACDSPVILQASAGARKYAGEPFLRKLVEAAIEQYPDIPVCLHQDHGTSPAVCQQSMRSGFSSVMMDGSLGPDGKTPANYAYNVLVTRKVVEMAHAIGVSVEGELGCLGSLETGEAGEEDGIGAAGKLDRSQMLTDPDEAADFVARTGVDALAIAIGTSHGAYKFTRPPTGEILAIDRIKAIHARIPNTHLVMHGSSSVPQEWLAVIRQYGGAIKETYGVPIGEIVEGIRHGVRKVNIDTDIRLAMTGAMRKAMAEKPEEFDPRAFWKAAVAAASDLCRQRFEVFGSAGQASRIKPISLEKMATTYR

SEQ ID NO: 3540 - protein, 434 aa, Streptococcus pneumoniae R6
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 3541 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPDVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDA

SEQ ID NO: 3542 - protein, 194 aa, Helicobacter pylori 26695
MKIFFIDNFDSFSYNLVYELECLGYEVAVYQNDIDPSYLMDLMNEESKTPLLFISPGPGNPNSSGNLLKIIAMAKKKFPILGICLGLQALAQSYGAKIIRSKEIVHGKATAIALKKHAVFKGLGESMVVGRYHSLMASGLPKNLEVIAEHDNIPMAIVNEEDKILAYQFHPESIMTLQGRALLEQSVGFLEGLL

SEQ ID NO: 3543 - protein, 488 aa, Bacillus anthracis str. A2012
  unsure (1)..(488): unsure at all Xaa locations
MNPNNRLTTNQGAPVGDNQNSRTAGRRGPVLLEDYHLVEKLAHFDRERIPERVVHARGAGAHGVFVTKNSMKKYTKAAFLQNEGTETPVFVRFSTVIHGQGSPETARDPRGFAVKFYTEEGNYDIVGNHLPVFFIRDAIKFPDMVHSLXPAPDTNIQTPDRYWDFMTLSPESTHMMTWVFSDYGTPASYREMEXFGVHSFKWINAEGKIVYIKYHWKPQQGVRNLSAKEVQEVQGKDFNHATRDLFDAIEKGNYPKWDLHVQVMQLEETDSLDFDPLDPTKVWPEDRFPLMEVGTMTLNRNPKNFFAEVEQVAFSPSATVNGIEPSEDKLLQGRLFSYPDTQRYRLGANYLQIPVNCPYAAVHNQQRDGAMQINQNPSTINYEPSRHAENPVEDPAYRDSTMKVEGYVSREKIDKPNDFKQAGERYRSFSKEEQDNLIANLTSDLKDVNERTKLLAVCNFFRADQEYGMRLAQALNVDITQYVGNAPK

SEQ ID NO: 3544 - protein, 498 aa, Oryza sativa (japonica cultivar-group)
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAAASNSNNQV

SEQ ID NO: 3545 - protein, 327 aa, GIBBERELLA ZEAE PH-1
MSFNPNNDIPDLSGKVIIVTGASSGLGKESALQLAKHNPATIFVTARTEKRGNAAIKEIQDAVPNFKGQIKFLELDLSSFASIQKGATAFLNQSDRLDILMNNAGLMATPAGLTTDGYEVQFGSNYMGPALFTKLLLPTIVRTAQQQGDARVINLSSELFKQAPKEGVLLSRVKTPLEDISSLARYGQSKLADYYHTRSLSKYYPSVKFVAIHPGVVNTGLFDDLRKRRPWLGGLIGVMGSIFLTDVHAGAKAQLWASTAKSESVRSGGFYNQKLKEYKDAVLDDEKAVEELWDWTEKEFAIIITSIQQKRKVIVEVGYAKLPLQLS

SEQ ID NO: 3546 - protein, 383 aa, Desulfovibrio desulfuricans G20
MTEPAKREDSGLPEAVTAIRPEVAAFKPYAPGLSIDEIKERYGLSQVVKMASNENPLGTSPLVQQTLRTHADLAFRYVQSGNPRLVSAIARSFGVAAESVVTGNGSDEVIDLIIRVKARPGKHNIVAFNPCFSMYELQTRFCGVEFRQVPLRADFSFDYDAFVGAADADTAVAFITTPDNPSGYCPPVEEIIDLARRLPSSCLLVVDEAYMDFADDPAAHSVLPHLTEFPNVAVLRTFSKSYGLAGLRLGFGVMHPALADYVKRVRLPFSINILAEYAGIAALQDTTFHAQTLRVTREGRTYLTGALTEAGCTVYPSAANFIMFALPENCPHDARAVFEALLRRGIIIRPLSSYNLPQCLRVSIGNRHENELFIAQFKELLRG

SEQ ID NO: 3547 - protein, 54 aa, Triticum aestivum
MAKSVISMDQLKALWHSEVHDERKWAANMKLVRALGVFAGGVFLMRNFGDLMAV

SEQ ID NO: 3548 - protein, 956 aa, ASPERGILLUS NIDULANS FGSC A4
MYSSMQQGRLLWSLARPCRFVAHRRFPAAVTSPLRRFHLSQTWRSSTPSDPNNPRDSVPENAHSETPTLNGTFNPTHADASIDPVDRPSAKDPGPYGSPIRRALRSRKRSKEPVAQTVTIPDWFRERNTVLSQSWAAETQQPVNIRAVVQDDKSSADGLSSGGNGEEPPAATGQPPLKHRYALTDALWEELCASARAGLRLPPAKYATEPSARKSHLVLHYPGPDGILFLDAVIKRLAGELSADLVTLNAQDIAQLCVEQDLTDTGRTSPIRLLGYEVFRPSVSNSWRESGDGMNEEDEGETDAMVPRNLRPGGMGSPKFITIESAREPGDIPLPNLFGLKSLVAAISPSDGSVGTASSQPSYDRVEERRLQLLHKLISPGEPSGQALTPTATDQDEPSDFVEPKQEQRGDIIVQVQDYAEIQSSREGSRFLNLLQQVIQDRRKDGHRVLFIGTAAQDVPPDSDSSRLLQNAFDDQFSQVVVVTPAMSTDIREKTFAEDRKKRTLEVNIRHIQSMLRTRLEEQPSAVKDEVFQSSSWPLDPSSIKDSGLDERYWSYNQVHWAATLALGSLRATEAFGFEHIQSGLEMLRRTERVRDEWLQERTPKARSSETENNRERLISSLRKTCNSHEKKLLNGVVDAKSIRTTFADVHVPPETIDALKTLTSLSLIRPEAFTYGVLATDKIPGLLLYGPPGTGKTLLAKAVARESGATVLEVSGSEVYDMYVGEGEKNVKAIFTLAKKLNPCVVFIDEADAIFCSRTGASSRTSHRELINQFLREWDGMNDLSTFIMVATNRPFDLDDAVLRRLPRRLLVDLPTEQDRLAILKIHLKDEALDASVDLAELARRTPLYSGSDLKNLCVAAALACVREENALAQQHTGESPYQYPARRTLTWAHFTRGMEEISASISEDMSSLSAIRKFDEQFGDRKGRRKKSPGWGFTTHVSDQAIPDAARVRT

SEQ ID NO: 3549 - protein, 254 aa, Glycine max
MEVLVGPAFTIDVPSSPPQHAGSDDRIFLNVSPEEGDGSNFRISGPPKFFAGGESESSSSIGTPDDSDNEEEEEVQSQLKIRTGLGSLDALEESLPIKRGLSSHFDGKSKSFSDLSQMSNLSNLKELQKQESPFNKRRRVLIASKWSRRSSFYSWSNPQSMPLLPVDEDQDYDYEEEEEEEDDEEKARKVPSASSSSSSSLAEEKKQEDQVQLRLNRVPESYAAHMRLRLGSFKARSFSLADLQEHDDEEEDDD

SEQ ID NO: 3550 - protein, 449 aa, Bifidobacterium longum DJO10A
MSTTTSAQPAQLTRNERLDRLPFNKAHRKLLVASGIGWAFDAMDVGLVSFVVAAIAADPHFNLTPTEKSWVLSIGFVGMAIGAAVGGFIADRVGRKTVFTATLIIFGIANGAMALSWSLGMLLGARLIIGLGLGAELPVASTLVSEFSPTKQRGRMTVLLESFWAVGWIVAAMIGYFVIPNTGDWGWRWALAIGALPLLYAIVTRVHIPESVRFLEAKGREDEAEKAVRYFEEAGGVAPVTSPKGKPLPKIKTRELFGSKYLARTIAIWATWFFVNFSYYGAFTWMPSLLADQFGSLTKSFGYTLAISIAQLPGYFLAAWLVEVWGRRKTLSIFLAVSAVAAFAFSQAGSVALVLVFGMLLSASNLGAWGVLYAVTPEIYPTRLRGAAAGAAAAVGRIAAIIAPLLMPWFLTLSGGNKAVAFIIFAAAFIIACVAALCLPERKGLDLED

SEQ ID NO: 3551 - protein, 463 aa, Bacillus cereus ATCC 14579
MQHTNKSGTLNRGLKERHITLMSLGSAIGVGLFLGSASAIKLAGPSILLGYMIAGLVIFFIMRALGEMAIEQPVAGSFSKYAYDYIGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNKQKLSYKMPLYPLSSYFSLVFLVLVLGIMAYSEDTRIALIVGPIWLIGLAIVYYMKGFHKIDETPNSKIS

SEQ ID NO: 3552 - protein, 243 aa, Zea mays
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPAWLP

SEQ ID NO: 3553 - protein, 615 aa, Saccharomyces cerevisiae
MSSISLKEIIPPQPSTQRNFTTHLSYDPTTNAIAYPCGKSAFVRCLDDGDSKVPPVVQFTGHGSSVVTTVKFSPIKGSQYLCSGDESGKVIVWGWTFDKESNSVEVNVKSEFQVLAGPISDISWDFEGRRLCVVGEGRDNFGVFISWDSGNSLGEVSGHSQRINACHLKQSRPMRSMTVGDDGSVVFYQGPPFKFSASDRTHHKQGSFVRDVEFSPDSGEFVITVGSDRKISCFDGKSGEFLKYIEDDQEPVQGGIFALSWLDSQKFATVGADATIRVWDVTTSKCVQKWTLDKQQLGNQQVGVVATGNGRIISLSLDGTLNFYELGHDEVLKTISGHNKGITALTVNPLISGSYDGRIMEWSSSSMHQDHSNLIVSLDNSKAQEYSSISWDDTLKVNGITKHEFGSQPKVASANNDGFTAVLTNDDDLLILQSFTGDIIKSVRLNSPGSAVSLSQNYVAVGLEEGNTIQVFKLSDLEVSFDLKTPLRAKPSYISISPSETYIAAGDVMGKILLYDLQSREVKTSRWAFRTSKINAISWKPAEKGANEEEIEEDLVATGSLDTNIFIYSVKRPMKIIKALNAHKDGVNNLLWETPSTLVSSGADACIKRWNVVLE

SEQ ID NO: 3554 - protein, 219 aa, Triticum aestivum
IKPLALQVCRFMYHHHLQQQQQQRGESEAAASVDQDSSMSNLTTSASASANPPPPPTPASNKRKRSLPGNPDPESEVVALSPATLMATNRFLCEICGKGFQRDQNLQLHRRGHNLPWKLKQRGSKEVVRKKVYICPEASCVHHDPSRALGDLTGIKKHFFRKHGEKKWKCDKCSKKYAVQSDWKAHSKICGTREYKCDCGTVFSRRDSFITHRAFCDAL

SEQ ID NO: 3555 - protein, 336 aa, Agrobacterium tumefaciens str. C58
MTVKVAINGFGRIGRNVLRAIVESGRTDIEVVAINDLGPVETNAHLLRYDSIHGKFPADVKVEGDTIIVGGGKPIKVTAVRDPATLPHKELGVDIALECTGIFTARDKAAAHLTAGAKRVIVSAPADGADLTVVFGVNDDQLTKDHLVISNASCTTNCLVPVVKVLDDVIGIDHGFMTTIHSYTGDQPTLDTMHKDLYRARAAALSMIPTSTGAAKAVGLVLPHLKGKLDGTSIRVPTPNVSVVDFKFIAKRDTTVEEVNEAIKSASNGKLKGILGYTEEPLVSRDFNHDSHSSIFAIDQTKVMEGNFVRVLSWYDNEWGFSNRMSDTAVAFAKTI

SEQ ID NO: 3556 - protein, 182 aa, Campylobacter jejuni subsp. jejuni NCTC 11168
MIKLTQEEQKYLLDSIRIIPDFPKKGIIFRDITTLLNNKEALNFLLKHLKERYKDYNLDFIAGTESRGFIFASMICAKLNLPFVPIRKPGKLPFETFSCEYDLEYGSDKVELHKDAFKNIQNARVLLVDDLIATGGTAIASYELIQKAGAKCVEACFLINLKDLNGANKLEKLTSVYSVLEI

SEQ ID NO: 3557 - protein, 451 aa, Spinacia oleracea
MASHAALAPSRIPASTRLASKASQQYSFLTQCSFKRLDVADFSGLRSSNSVTFTREASFHDVIAAQLTTKPTGAAPVRGETVAKLKVAINGFGRIGRNFLRCWHGRKDSPLDVVVVNDSGGVKSATHLLKYDSILGTFKADVKIIDNETFSIDGKPIKVVSNRDPLKLPWAELGIDIVIEGTGVFVDGPGAGKHIQAGAKKVIITAPAKGSDIPTYVVGVNEKDYGHDVANIISNASCTTNCLAPFVKVLDEELGIVKGTMTTTHSYTGDQRLLDASHRDLRRARAAALNIVPTSTGAAKAVSLVLPQLKGKLNGIALRVPTPNVSVVDLVVNIEKVGVTAEDVNNAFRKAAAGPLKGVLDVCDIPLVSVDFRCSDFSSTIDSSLTMVMGGDMVKVVAWYDNEWGYSQRVVDLADLVANKWPGLEGSVASGDPLEDFCKDNPADEECKLYE

SEQ ID NO: 3558 - protein, 358 aa, Candidatus Blochmannia floridanus
MVKICNFIKPGVVVGDDVQRLFNLAKKNNFALPAVNCIGMDSINAALEAAANMKSPIILQFSRQGSAFMAGYGLNHRSCSASVLGAVAGSLYVHHISSHYGIPVILHTDHCTKKFLPWIDNLLDLSEKNFYETGRPLFSSHMIDLSKESLEENIKVSSVYLNRMDKLKMTLEIELGYTGGEEDGINNDNVDLSLLYTTPEDVAYAYEKLHVISPRFMIAASFGNVHGVYRPGNVHLDPNILHMTQRYISKKFGLPKNYLNLVFHGGSGSTVEEIKESIGYGIVKLNIDTDIQWATWSGVLGYYQKNKDFLKTQLGNVYGDDQPNKKFYDPRSWIRAGQESMIKYLEEMFVILNATDVL

SEQ ID NO: 3559 - protein, 324 aa, Zea mays
MESGSRSSGGAGFDDEDGLTTRREVSSSLQDLAVRVDWKGGSCSDGGTNQGPNTPRSKHSATEQRRRSKINDRFQILRELLPHNDQKRDKATFLLEVIEYIRFLQEKAQKYEATFPEWNQENPTMLPWSKGQIPGDSPPDPSHFVRNGSSPGSNFTGKLDDNHTSAAASGAQDQAETDHMASGCYRSAETPANITNNAMSQSQPQWTGPSPVDDSAVNSETLNNQQLVIDEGTIRVSSNYSQELLNSLTHALQSSGVDLSQANISVQINMGKRAAKRPAAGVSSNSKEPADPASSNELGHQLTLSGAGADCLSHATKRHKRSNS

SEQ ID NO: 3560 - protein, 322 aa, Zea mays
  unsure (1)..(322): unsure at all Xaa locations
MRGHKPHPTYIIPCPLSFFLHKHVKSNLEALFLPPSLPLSLFAVRSSAPQSNRHLTEMGRKFFVGGNWKCNXTTDQVEKIVKTLNEGQVPPSDVVEVVVSPPYVFLPVVKSQLRQEFHVAAQNCWXKKGGAFTGEVSAEMLVNLGVPWVILGHSEXRELCLGESNEFVGDKVAYALSQGLKVICMCXGETLEQREAGSXPVDVVAAQTKSNWLRRSKDWSNVVVAYEPVWAIGXTGKVATPAQXAQEVHASXEGHWLKTQWPGPEXVAESTRIIYGRLCNCLRTAKELAAQXPDVDGFLVGGASLKPEFIDIINAXATVKSA

SEQ ID NO: 3561 - protein, 494 aa, Burkholderia fungorum
MADQVEVFSMYIDGEFVQAEGGRTLDSINPWSGSVWAKVPDATAADVNRAVEAAHRAFTSGPWPKMTPTERAVLLQKLADKLVEHKERLGYVETQDTGKLLKETTWQAGHTARAYTYFAGLADKLQGDIPPSGASMLNLVLHEPVGVVAAIIPWNSQLQLSAYKIAPALATGNTIVVKASEDASTPLLTLAKLVHEVGFPPGVINFVSGGANPCAITLTSHPLVRRIAFTGGADTARRLIPNSAHNIAKLSLELGGKSPVIVFDDADLDSCVNGIVAGIFGASGQSCAAGSRLLAHESIHDVLVERLVERCKTIRVGDPFDAATNMGPLATARQVDRIETLLASSVEQGARVVSGGKRIGGLPFNQCFEPTIALCDRSDYPIVQEELFGPVLSVLKFRDDDEAVALANDSKYAFAGGIFSRDFARAMRTARVVNAGRLWINTYRVTGVNVPFGGFKQSGYGREAGIDALKDYTETKAVMIEVGGEAVADPFVMR

SEQ ID NO: 3562 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIKPCSEEGXXXXVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 3563 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPRYYDGRYWTMWKLPLFGCTDSAQVLKEVEECKKEYPNAFIRIIGFDNTRQVQCISFIAYKPPSFTG

SEQ ID NO: 3564 - protein, 223 aa, Xylella fastidiosa Dixon
MSNCLIAPSILSADFARLGAEVDAVLAAGADWIHFDVMDNHYVPNLTFGPMVCKALRSYGITAPIDVHLMVEPVDRIVPDFAQAGASMISFHIEASRHVHRTIQLIKSHGCMAGLVFNPATPVDMLDWVLPELDLVLLMSVNPGFGGQRFIPGTLDKLRLVRKKIDLLGRPVRLEVDGGVGIDNIGAIAEAGADTFVAGSAIFHARDYGDVIAQMRAVVAAVR

SEQ ID NO: 3565 - protein, 279 aa, Wigglesworthia glossinidia endosymbiont of Glossina brevipalpis
MKIKKVVIPIAGLGKRMLPITKVIPKELLPLIDKPLIQYAIHECINSGLKNIIFVTNYKKYLIKNYIENIFLKKKCNFQKKLNIDYIYQKSVNGLGNAILSALPKIGYKSFAVILPDVIINSYSCNNLKINNLLSMLNRFEKTGRSQVLVKLSYNTKDYGIVNCKKSKLNPNDISKIINIIEKPYIKNSIPSLSVVGRYVFSKNIWGMLEKIKPGIENEFQLTDAIKMLIKNEIVEAYCIKGSSYDCGNKLGYMKAFVKYGLYNKYFGKVFKKWLKKIL

SEQ ID NO: 3566 - protein, 465 aa, Dechloromonas sp. RCB
MIKMIKENDAKFVDFRFTDTRGKEQHVTVPVSAFSEDKFENGHAFDGSSIAGWKGIQASDMQLNPDPATAYIDPFFDETTVVLTCDVVDPADGRGYDRDPRSIAKRAEAYLKSSGIGDTAYFGPEPEFFIFDGVEWNVDMSGCSLKIHSAEAAWGSGEKNDGNGSTGHRPTVKGGYFPVPPVDSLHDIRSAMVLTLEALGCPVEVHHHEVATAGQCEIGTVFNTLVKRADQTQILKYVVHNVAHQYGKTATFMPKPIVGDNGSGMHVHQSIWKDGKNLFAGDGYAGLSELALFYIGGIIKHAKALNAITNPGTNSYKRLVPHYEAPVKLAYSAKNRSASIRIPYVASTKARRIETRFPDPIANPYLCFAALLMAGLDGIQNKIHPGDPADKNLYDLPPEEDAKIPTVCASLEEALAALDKDREFLTRGGVFSNDWIDAFISLKMDEVNKVRMTTHPVEFDLYYSC

SEQ ID NO: 3567 - protein, 372 aa, Corynebacterium efficiens YS-314
MTDTTLAPEVTLSDLPLREELRGESAYGAPQLNVSVRLNTNENPYPPSEALIADLVETVRATATELNRYPERDSVELRDALADYITHQTGVQVTRENLWAANGSNEVLQQLLQAFGGPGRKALGFQPSYSMHPILSKGTQTEFIAIPRGADFRIDMDAALAAIEEHVPDIIFVTTPNNPTGDITSLADIEKIINAAPGIVIVDEAYAEFSPSPSATTLITRYPAKLVVSRTMSKAFDFAGGRLGYFVAAPAFIEAVMLVRLPYHLSALSQAAATVALRHRDDTLATVAKLSSERIRVAARLEELGYTQVPSESNFIFFGKFTDQHTAWEAFLDRGVLIRDVGVSGHLRVTIGLPEENDSFLAAAAEISGLNL

SEQ ID NO: 3568 - protein, 509 aa, Bifidobacterium longum NCC2705
MTEINDKAQLDIAAADDTDAVTSDTPEETVNTPEVDETFELSAAKMREHGMSETAINQFHHLYDVWRHEEASSWIREDDIEPLGHVPSFHDVYETINHDKAVDAFAKTAFLKLNGGLGTSMGLDKAKSLLPVRRHKAKQMRFIDIIIGQVLTARTRLNVELPLTFMNSFHTSADTMKVLKHHRKFSQHDVPMEIIQHQEPKLVAATGEPVSYPANPELEWCPPGHGDLFSTIWESGLLDVLEERGFKYLFISNSDNLGARPSRTLAQHFENTGAPFMAEVAIRTKADRKGGHIVRDKATGRLILREMSQVHPDDKEAAQDITKHPYFNTNSIWVRIDALKDKLAECDGVLPLPVIRNKKTVNPTDPDSEQVIQLETAMGAAIGLFNGSICVQVDRMRFLPVKTTNDLFIMRSDRFHLTDTYEMEDGNYIFPNVELDPRYYKNIHDFDERFPYAVPSLAAANSVSIQGDWTFGRDVMMFADAKLEDKGEPSYVPNGEYVGPQGIEPDDWV

SEQ ID NO: 3569 - protein, 325 aa, Rhodovulum sulfidophilum
MVKRQISMVLDLNKCIGCQTCTSACKLQWTNRNGREYMYWNNVETHPGPGYPRNYEHSGGGFDEEGALKIGITPSAEDYGIPWEYNYEEALMTGTDPWLRPNVKPTWGANWNEDEGRGEYPNSYYFYLPRICNHCANPGCLAACARNAIYKRQEDGIVLVDQERCRGYRYCITACPYKKVYFNEQISKAEKCIFCYPRIEKGLPTACAKQCVGRIRFIGYLDDEAGPVHLLVERYKVAIPLHPEWGTKPSVFYVPPLAPPRIGDDGEPTEETRVPLAYLKELFGEAVVPALETLKTERAKKQSGAESELMDTLIGYRHPEMFKLS

SEQ ID NO: 3570 - protein, 367 aa, Thermoanaerobacter tengcongensis
MKEGEKMKPYEHGGNIYDYQGNLIDFSSNINPLGPPEWIWEAIKEVDLSRYPDIKYRRLKEAIAEYVGCDRENIIVGNGAAELIHLFARAFKLKKPLIPSPSFLEYERAVKLNGGEPVYLKLEEEEGFRVNFAKVISKIEEADGLILGNPNNPTGQGIIREEIGILLKKAELMNIPVLIDEAFIEFMKDYKKYEALPLVKKHDKLFVVRAVTKFFGMPGIRLGYGIGSPSLIQKLEEYKEPWTVNAFAEAVGRWLFKDREYIEKTREYVNAEIEHMLFSLRTIDYLVAFDTKVNFILLKLKAGTVDEVKEKLLKKGILIRDASNFRYLDKRFFRVAVKRREDNMCLIEALRGLYEEGVMPDKERVVV

SEQ ID NO: 3571 - protein, 414 aa, Matricaria chamomilla
MKPASSSADSGTESCSSKGVAKTGEGLRQYYLQHIHDAQLQVRQKTHNLNRLEAQRNELNSRVGMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCAFIRVSGSELVQKYIGEGSRMVRELFVMAREHAPSIIFMDEIDSIGSARMESGSGNGDSEVQRTMLELLNQLDGFESSTKIKVLMATNRIDILDPALLRPGRIDREIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 3572 - protein, 497 aa, Pseudomonas fluorescens PfO-1
MSGQNSQSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYIHYWAPEIPSWVTAAAFFVLINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVILLSLTPWDSLLETLNASGDSYSGSPFVQVFSMLGSNTAAHILNFVVLTAALSVYNSGTYCNSRMLLGMAEQGRCAESAGEDRQARRAGAFDPGLGGRDSGGGAAQLPDPATRAGTADVAGGCNAGDQLGDDQLLALQVPPAHEQDPPEAAVQGAVVPVRQLHLPGVRPVHPRRDAADPGHSDLGVRDSGVGGVHVDLLRDQEQTWRAAGTARSERSQVSVVAKTTNPAKCRVFCTFAVSCGF

SEQ ID NO: 3573 - protein, 253 aa, Borrelia burgdorferi B31
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYSKSASDNIIIQYGGSVNSNNVKELMNEPNIDGALIGGASLKAESFLSIINNVL

SEQ ID NO: 3574 - protein, 606 aa, Methanosarcina barkeri
MNIMFSKSEFREVVKSMGLVFGDIGTSPIYTLTVIFLLTRPTHTHIIGVLSLIIWTLIILVTVEYAWLAMSLGKKGEGGTIVLKEILVPLLKSSRNVAFVTLLAYIGTSFLMGDGVITPAISILSAVEGLRIIPQFENIGQSTIILISAAIAIALFSVQSKGIEKITWVFGPIMVLWFATIGFSGIASIFYTPEVLKAINPYYAIRFLLDNGIIGFFVLSEVILCATGGEALYADMGHLGREPILKAWRFVFLALVLNYLGQGAFLIRNPGSTNFLFEMINQQANILYIPFLLLSVVATIIASQAMISGMFSIVYQGITTRIIPMLKIDYTSGVFKSQIYISTVNWLLLVSVLFMMLIFKESSKLAAAYGLAVTGTMSITGIMMTSIFYHRKNITKALISLFITFIDVVFLLSNSYKIPHGGYWSVIIALFILSLILIYTSGQKKLYKLMKLMKSKDFLEKYKQVYATQNKIMGTALFFTRDIERIPQYISHVMFKNNIIYENNIFISIIKSDSPFGIETSFTKEPAKGLKILEIRAGYMEIVNVEKILKDQGIGEKTIFYGVEDIFTKNIIWRIFSIIKKVSPSFVQFYKLPTDELHGVMTRFEM

SEQ ID NO: 3575 - protein, 61 aa, Zea mays
IVLFYVVCFAFYQEKYEKELKDTRARELMYAEEAAILDKELKKEKLKNAAAIKELQEKAEQ

SEQ ID NO: 3576 - protein, 351 aa, Prochlorococcus marinus str. MIT 9313
MAKQGPMRIGINGFGRIGRLVFRALWGRPGIEICHLNDPSGDAATAAHLLKFDSVHGRWDQLVGGSENQLLVNQQTISYSQGSTPGAVPWNDAGIDIVLECSGKFKSPETLSVYFDQHALKRVIVACPVKGKLAGKEVLNIVYGINHHLYDPKIDHLVTAASCTTNCLAPLVKVVHENFGISHGCITTLHDTTNTQVPIDSFQTDLRRARSCLQSLIPTTTGSAKAIAMIFPDLEGKLNGHAVRVPLLNASLTDAVFELKRSITVKDANEAFRHAAEHQLKGILGYEDKPLVSIDYVNDSRSSIVDGLSTMVVNGSQLKVYAWYDNEWGYSSRMADLTCYISNLENTSNTF

SEQ ID NO: 3577 - protein, 380 aa, Oenococcus oeni MCW
MNSSQNEFVDVLFEKEVMLMKPENTFNSKESVDVGGSERIPSEMRAWEVTSPAPIDSSPSPIHFVKHPVPVPKTSEVLVRVISCGICHTDLHVAEGDLPVHHPHVIPGHEIIGRVVANGPQAGRFNLGDRIGVPWLRWTCGVCTYCRSGKENLCPNSLYTGWDHDGGYAEYVTVPEGFAYRIPSAFNSVTAAPLLCAGIIGYHAFRRANVPAGGRLGLYGFGGSAHLAAQIAIAQGIEVHVFTRGKDAQRFALELGAASAQGVYDPSPVSLDSSILFAPVGDIVPKALENLAAGGTLALAGIHLTDVPSLNYQNHLFHEKVLTSVESNTRRDGEEFLTLADRLKIHPKTTEYPFEKADEALRHLSHGDMQGACVLRISEG

SEQ ID NO: 3578 - protein, 165 aa, Glycine max
  unsure (1)..(165): unsure at all Xaa locations
ASSMISSPAVTTVNRAGAGMAAPFTGLKSMAGFPTWKTNNDLASVASNGXRLQCMLVWPPVGKMIFETLCYLPDLDDAQLAKEVESLLKKGWIPCMEFELEHSFEYREHSCVPGYYNGRYCTMCKLPMVGCTMLPTCMNDILEAKTVVPRGYIRLSGLGNVRQVQ

SEQ ID NO: 3579 - protein, 759 aa, Arabidopsis thaliana
MWKLKIAEGGSPWLRTTNNHVGRQFWEFDPNLGTPEDLAAVEEARKSFSDNRFVQKHSADLLMRLQFSRENLISPVLPQVKIEDTDDVTEEMVETTLKRGLDFYSTIQAHDGHWPGDYGGPMFLLPGLIITLSITGALNTVLSEQHKQEMRRYLYNHQNEDGGWGLHIEGPSTMFGSVLNYVTLRLLGEGPNDGDGDMEKGRDWILNHGGATNITSWGKMWLSVLGAFEWSGNNPLPPEIWLLPYFLPIHPGRMWCHCRMVYLPMSYLYGKRFVGPITSTVLSLRKELFTVPYHEVNWNEARNLCAKEDLYYPHPLVQDILWASLHKIVEPVLMRWPGANLREKAIRTAIEHIHYEDENTRYICIGPVNKVLNMLCCWVEDPNSEAFKLHLPRIHDFLWLAEDGMKMQGYNGSQLWDTGFAIQAILATNLVEEYGPVLEKAHSFVKNSQVLEDCPGDLNYWYRHISKGAWPFSTADHGWPISDCTAEGLKAALLLSKVPKEIVGEPIDAKRLYEAVNVIISLQNADGGLATYELTRSYPWLELINPAETFGDIVIDYPYVECTSAAIQALISFRKLYPGHRKKEVDECIEKAVKFIESIQAADGSWYGSWAVCFTYGTWFGVKGLVAVGKTLKNSPHVAKACEFLLSKQQPSGGWGESYLSCQDKVYSNLDGNRSHVVNTAWAMLALIGAGQAEVDRKPLHRAARYLINAQMENGDFPQQEIMGVFNRNCMITYAAYRNIFPIWALGEYRCQVLLQQGE

SEQ ID NO: 3580 - protein, 450 aa, Oryza sativa (japonica cultivar-group); identical to SEQ ID NO: 1658

SEQ ID NO: 3581 - protein, 488 aa, Cyanidioschyzon merolae
MAQSVQERTRLKNKRYESGVIPYAKMGYWNPNYVVKDSDMLALFRVTPQPGVDPIEAAAAVAGESSTATWTVVWTDLLTACDVYRAKAYRVDPVPTAPDQYFVYIAYDIDLFEEGSIANLTASIIGNVFGFKAVKALRLEDMRIPFSYLKTFQGPATGVIVERERLNKFGRPLLGCTVKPKLGLSGKNYGRVVYEGLKGGLDFLKDDENINSQPFMRWRDRYLYVMEGVNRAAAASGEVKGSYLNVTAATMEECYKRAEFAKEVGSVIIMIDLVIGYTAIQTMAIWARENNMILHLHRAGNSTYSRQKNHGINFRVISKWMRMAGVDHIHAGTVVGKLEGDPIIIKGFYNTLLLPKLEVNLPQGLFFEMDWASLRKTLPVASGGIHAGQMHQLLHYLGEDVVLQFGGGTIGHPDGIQAGATANRVALEAMVLARNEGRDYFNEGPQILRDAAKNCGPLQTALDLWKDIAFNYTSTDTSDFVETPTANV

SEQ ID NO: 3582 - protein, 1002 aa, Schizosaccharomyces pombe
MLMKQTFLYFLLTCVVSAQFNGYVPPEQNGGDIVVPKDFYEKFGEDFIREQEESSAPLMNPVPERDEAEAPHHPKGHHEFNDDFEDDTALEHPGFKDKLDSFLQPARDFLHTVSDRLDNIFDDDEDEHVREKRPHDSADEDAPRRKHGKCKGKGKHHKGKHAKGKGKKSHPKPEDDSVFFDDERPKHHEFDDEDREFPAHHEPGEHMPPPPMHHKPGEHMPPPPMHHEPGEHMPPPPMHHEPGEHMPPPPMHHEPGEHMPPPPMHHEPGEHMPPPPMHHEPGEHMPPPPMHHEPGEHMPPPPMHHEPGEHMPPPPMHHEPGEHMPPPPMHHEPGEHMPPPPFKHHELEEHEGPEHHRGPEDKEHHKGPKDKEHHKGPKDKEHHKGPKDKEHHKGPKDKEHHKGPKDKEHHKGPKDKEHHQGPKEKHNERPEQNMQSSHELLVIEAFADLINSVPVEEIAEEFSRFLDTLGIEYYGNIPVHIQENAPKDSSIPPLFEFDDDLELSDLTPEQFAYLEMLKAEGIDPMTAFRDQSHPAKPSNAQPADSSRPYAVFSQEENGEHVNLKAFPDHTLRVKDSKPESLGIDTVKQYTGYLDVEDDRHLFFWFFESRNDPENDPVVLWLNGGPGCSSLTGLFMELGPSSINIETLKPEYNPHSWNSNASVIFLDQPINTGFSNGDDSVLDTVTAGKDVYAFLNLFFAKFPQYAHLDFHIAGESYAGHYIPQFAKEIMEHNQGANFFVASGYEMEKQYINLKSVLIGNGLTDPLVQYYFYGKMACESPYGPIMSQEECDRITGAYDTCAKLITGCYQTGFTPVCIGASLYCNNAMIGPFTKTGLNIYDIREECRDQEHLCYPETGAIESYLNQEFVQEALGVEYDYKGCNTEVNIGFLFKGDWMRKTFRDDVTAILEAGLPVLIYAGDADYICNYMGNEAWTDALEWAGQREFYEAELKPWSPNGKEAGRGKSFKNFGYLRLYEAGHMVPFNQPEASLEMLNSWIDGSLFA

SEQ ID NO: 3583 - protein, 388 aa, Ajellomyces capsulatus
MFSLRTAQPAQSLFRAATNTYSTSLPRSAIAARSFATVQSDIFKPTKYGGKYTVTLIPGDGIGTEVAESVKTIFKADNVPIEWEQVDVSGLDAGNKHSEDLFKESIASLKRNKLGLKGILHTPVERSGHQSFNVALRQELDIYASIVLIKNIPGYKTRHDNVDLCIIRENTEGEYSGLEHQSVSGVVESLKIITRAKSERIAKFAFSFALANNRKKVTCIHKANIMKLADGLFRSTFHKVAESYPTLETNDMIVDNASMQAVARPQQFDVMVMPNLYGGILSNVGAALVGGPGIVPGCNMGRDVAVFEPGCRHVGLDIKGKDQANPTALILSGSMLLRHLGLDEHANRISKAVYDVIGEGVTRTRDMGGQASTHEFTRAVLDKMESAL

SEQ ID NO: 3584 - protein, 353 aa, Neurospora crassa
MPQFEIPEQQWAQVVEKKGGPVVFKQIPVQKPGPDEVLINVKYSGVCHTDLHAMKGDWPLATKMPLVGGHEGAGVVVAKGELVTEVEVGDHAGIKWLNGSCLACSFCMQADEPLCPHALLSGYTVDGSFQQYAIAKAAHVAKIPKGCDLETTAPVLCAGITVYKGLKESGVRPGQCVAIVGAGGGLGSMAIQYANAMGLHAIAIDGGEEKGKNCRELGAQAYVDFTTTKDLVADVKAATPDGLGPHAVILLAVSEKPFHQAVDYVRSRGTIICIGLPAGAKFQAPVFDTVIRMITIKGSYVGNRQDTQEALDFFARGLIKVPIKTVGLSKLQEVYDLMEEGKIVGRYVVDTSK

SEQ ID NO: 3585 - protein, 221 aa, Zea mays
  unsure (1)..(221): unsure at all Xaa locations
MSEVFEGYERQYCEASASLSRKCTAASALDREKKXQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDDNIGKSKKILAAMSKRMDRNKWIIGGIITALVLAILLILYFKLAN

SEQ ID NO: 3586 - protein, 473 aa, Oryza sativa (japonica cultivar-group)
MAHAVESMEKLRAAVDEDKDSFMHLVSRYLIREEKEMIDWNKVERPTPEMVVPYDSLVQAPRDIPEIRNLLNKLAVLKLNGGLGTTMECVAPKCTIEVRSGLTFLDLAIMQTEFLNKKYGCSVPILLMNSFNTSLVNKIVEKYTNIEIHTFNQNKYPRIITEKFLPLSSEGSTGSHCWYPPGHGDVFFSLCKSGILDTMLSQYNILINVSWLASEIESLTSTEILNHLIHNKNEYCMEVTPKTSADVKGGSLICYEGLSCNVKFVANHHVDEFQSIENFNMLNTNNLRVNLKAIKRLVKAEALKMEIIPNLKEVDGVKVLQLEKEAGSAIQCFEKAIGVTVPRSRFLAVKNTSDLFLILSDLYIVMDGTVTRNPARDNSTNPLIDLGPEFRKVDSFLDRFKSIPSIVALDSLKISGDVWFGSRITLKGEVTIAAQLGLKLDILDGSVFDNKVKVHLWIIICFVVILETVLLFQ

SEQ ID NO: 3587 - protein, 1019 aa, Adiantum capillus-veneris
MDPYQQDAASSSGTGYSLHRPPPPDASSSTSGVPTVPRDTHGSLEVFSPAGYIPSGPTSSMFARGSDKQFKPGVHIADRQPVIDFGKFPSPLRPYEEDVASEDFSIEPAEAEKAEESGKEDLHTDWPTEAEKASPAPAEKGDHKILSDDGVAERAAQWGLVVKGRAGVGARTSNEEKRTDSFQQQRGTSLSVRSSEDSEHGGLYIPRVSKDLKDALETFQQTFVVSDATRPDYPILYASAGFFKMTGYSSKEVIGRNCRFLQGADTDPDDVERIRESLAEGKNYCGRLLNYKKDGTAFWNLLTIAPIKDEEGNVLKFIGMQVEVSKHTEGHKVKALRPNGLPESLIKYDARQKDRAVMDVSELIQAVKHPHHNGHAPQHHPPSSVKSTIAEVPSVATVPPMTDRRSSLGPGKSDSMSDGIPKRHRSSGFRSLIGLDKFGKSAQQEPIEFIEPEILMTRDEETDSLDELDDKERLQEIRRGIDLATTLERIEKNFVITDPRLPDNPIIFASDSFLELTEYTREEIIGRNCRFLQGQDTDQKTVQKIRDAIREQREITVQLLNYTKTGKRFWNLFHLQPMRDQKGELQYFIGVQLDGSEQLEPIQKRLSEKTEKEGAKIVRATALNVEEAVGELPDANLTPDDLWANHSKSVSAKPHKVHSDLWKALQKIRERGEKIGLKHFRPVKPLGFGDTGSVHLVELRGSGELFAIKAMEKSVMLNRNKVHRACAEREILAVLDHPFLPALYASFQTQTHVCLVTDFCPGGELFLLLDRQPRKVFSEETARFYLAEIIIALEYLHCQGIIYRDLKPENVLLQRDGHVVLTDFDLSFITSCNPQLVRPPSPPGRRRKYKQMPPPFFMAEPVTTSNSFVGTEEYIAPEVITGAGHSSAVDWWAVGILLYEMIYGRTPFRGKNRQKTFANVLHKDLTFPSSIPASLAARQLINGLLHRDPANRLGSATGAYEIKNHAFFRGINWPLIRDMVPPPLEAPLELVGKDPDFDSREALEWDELEASSTFVSDVF

SEQ ID NO: 3588 - protein, 762 aa, Lotus japonicus
MWKLKVADGGKNPYIFSINNFVGRQTWEYDPDAGTPEERAQVEEARQDFYNNRYKVKTCGDRLWRFQVMRENNFKQTIPSVKIEDGEKVTYDKVTTTVRRAAHHLAGLQTSDGHWPAQIAGPLLFTPPLIFCMYITGHLDSVFPEVYRKEILRYTYVHQNEDGGWGLHIEGHSTMFCTVLNYICMRILGEGPDGGQDNACARARKWIHDHGGATHIASWGKTWLSILGIFDWSGTNPMPPEFWILPSFLPMHPAKMWCYCRLVYMPMSYLYGKRFVGPITPLILQLREELFTQPYEKVNWKKARHQCAKEDLYYPHPLIQDLMWDSLYLFTEPFLTRWPFNKLIRERALQVTMKHIHYEDHNSRYITIGCVEKVLCMLACWVEDPNGIAFKRHLARVPDYLWLAEDGMCMQSFGSQEWDAGFAVQALLSTNLIDELGPALAKGHDFIKNSQVKDNPSGDFKSMHRHISKGAWTFSDQDHGWQVSDCTAEGFKCCLLLSMLPPEIVGEKIEPERLFDTVNLLLSLQSKKGGFAVWEPAGAQEWLELLNPIEFFEDIVIEHELVECTGSAIGALVLFKNHYPEHRKKEIEDCIANAVRYFEDIQTADGSWYGNAGICFIYGTWFALGGLEAAGKTYANCAAIRKGVKFLLTTQSKDGGWGESYLSCPKKIYVPLEGNRSNVVQTAWALMGLIHAGQAERDPTPLHRAAKLLINSQLEDGDWPQQDITGVYVKNCTLHYPMYRNNFTTMALAEYRRRVPLPSIAV

SEQ ID NO: 3589 - protein, 237 aa, Paenibacillus macerans
MKKKSCFTLVTTFAFSLIFSVSALAGSVFWEPLSYFNRSTWEKADGYSNGGVFNCTWRANNVNFTNDGKLKLGLTSSAYNKFDCAEYRSTNIYGYGLYEVSMKPAKNTGIVSSFFTYTGPAHGTQWDEIDIEFLGKDTTKVQFNYYTNGVGGHEKVISLGFDASKGFHTYAFDWQPGYIKWYVDGVLKHTATANIPSTPGKIMMNLWNGTGVDDWLGSYNGANPLYAEYDWVKYTSN

SEQ ID NO: 3590 - protein, 496 aa, Actinobacillus pleuropneumoniae serovar 1 str. 4074
MNNGAPVVDNQNSMTAGPRGPLLAQDLWLNEKLANFVREVIPERRMHAKGSGAFGKFTVTHDITQYTKAAIFSEVGKETELFARFTTVAGERGAADAERDIRGFAVKFYTEQGNWDFVGNNTPVFFLRDPRKFPDLNKAVKRDPRTNMRSATNNWDFWTLLPEAFHQVTIVMSERGIPASYRHMHGYGSHTYSLINANNERFWVKFHFRTEQGIKNLTNEEAAAIIANDRESHQRDLYESIEKGDFPKWKLYIQVMPEAEAEQVDFHPFDLTKIWSKKDYPLIEVGVMELNRNPANFFADVEQSAFAPSNLVPGISVSPDRMLQARLFNYADAQRYRLGVNHHQIPVNAPRCPVHSNARDGQSRVDGNYGSTLHYEPNSFGQWQEQAQFAEPPLKINGDAAFWDYRQDDSDYFSQPRALFNLMTEKEKQSLFKNTAEGMGDALDFIKYRHIRNCYFCDPAYGEGVAKALGMTVADAMEAYNTDPAMGQPGLIKPNF

SEQ ID NO: 3591 - protein, 357 aa, Nicotiana tabacum
MARKSFPILKQLIQQSTNRFFTTNASPRAVTLIPGDGVGPLVTDSVEQVMQAMKAPVYFERYEVRGDMKCIPEEVIDSIKKNKVCLKGGLKTPVGGGVSSLNVLMRKELDLSASIVHCFTFPGLPTRHEDVDIVVIRENTEGEYAGLEHEVVPGVVESLKVITKYCSERIAKFAFEYADVNKRKKVTAVHKANIMKLADGLFLKSCREVASKYPEIQYEEIIVDNCCMQLVSRPEQFDVMVTPNLYGNLIANTAAGLAGGTGVLPGGNVGLIKPVFEQGASPGNVGHEKILKLKKANPVALLLSSAMMLRHLEFPSFADRLETAVKRVIAEGKVRTKDLGGDSTTQEVVDAIIAALD

SEQ ID NO: 3592 - protein, 479 aa, Dunaliella salina
MATVQEYIDKHQLQKKTEDVLNIAVKSKPDEPLSFLAKELLRMAPSEILKVVGRQIIDSRGNPTVEADVHTHKGMFRAAVPSGASTGIHEAVELRDGDKTKFLGKGVQKAVESINTIISPALKGMDPKNQSEVDQKMIDLDGTPNKAKLGANAILAVSLATAKAGAAEKEVPLYRHIADLAGNPKLYLPVPAFNIINGGSHAGNALAMQEFMILPTGASSFSEAMRMGTEVYHTLKGIIKAKYGQDATNVGDEGGFAPNIQSNDDGLSLVTDAIEKAGYTGKVKIGMDVAASEFITEDKMYDLNLKQQPNDGSHKKTAAQMLEMYKEFCTKYPVISIEDPFEQDDWEPAKSLTAENICQVVGDDMLVTNPIRVKRGIEQKAVNSLLLKVNQIGSLTESIEAVRMSKEAGWGVMTSHRSGETEDCFIADLAVGLSTGQIKTGAPCRSERNAKYNQLLRIEEELGENAVYAGEKWRFIEWQ

SEQ ID NO: 3593 - protein, 401 aa, Petroselinum crispum
MDRVFSVEDISDQFWSPPAREDSSKLVMNRSDSEWAFQSFLQQASALESSQPLPSDPVPVAGDVKNPVEIPANVPVDSEDYQAYLKSRLDLACAAVALTRASSLKPQDSAALLDNGSQASNTSQLVSQVPPKGSGHDLSKEEDKEALAATATPLLPALQKKSAIQVKSTTSGSSRDHSDDDDELEGETETTRNGDPSDAKRVRRMLSNRESARRSRRRKQAHMTELETQVSQLRVENSSLLKRLTDISQRYNDAAVDNRVLKADIETMRAKVKMAEETVKRVTGLNPMFQSMSSEISTIGMQSFSGSPSDTSADTTQDGSKQHFYQPAPTSHMPAQDQKIQNGLLQVPPVDNLQQHSASGPVEGNKMERTSSMQRVASLEHLQKRIRGGVSSCEAQVSGKQ

SEQ ID NO: 3594 - protein, 666 aa, Neurospora crassa
MDGSLMAALPQGQDVIRVISTGGVTKVVKIAECNTCEEVMRVTLRKFGLREDHERNYCFWVLAGVDPDPNQCRRLGDTELWRVIKDHTRPERNRLILRRVPSGEPGKAELERAAAIAMEEAQQTHRPPIEPSDKRSQLKLQKVLGVGWEDLQQQPPLSPMSYQDRERNVSNAARDLERPAPLETPRAMPRRTQALRQFGGLRPPSELIASDLTSYFPDHSREAIDRTARLSMRRSARLSRVNHRLSVASTLSFASSIQDAPPIPTIADSWLTASNQIAKVRPRDVLPRAPHGYRDSVASSVLDTLQEEGSPTEPNRRSFVPFSDSGSDTAAVSVIDPDGNIVRHSYYDSGTNNSADSAVIQEALAEDGEDAADKELQTFLAGDAWDDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLDQYGALPESLVRSFVRQILQGLSYVHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFLTPVPGT

SEQ ID NO: 3595 - protein, 159 aa, Frankia sp. FE34
ITKEQYSRDPRNIAKKAETYLRGTGIADTAYFGPEAEFYIFDDVRYDYNPYGSMHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARSRGKTV

SEQ ID NO: 3596 - protein, 215 aa, Brassica napus
MAGGGPTFSIELSAYGSDLPTDKASGDIPNEEGSGLSRVGSGIWSGRTVDYSSESSSSIGTPGDSEEEDEESEEDNDEEELGLASLRSLEDSLPSKGLSSHYKGKSKSFGNLGEIGSVKEVPKQENPLNKKRRLQIYNKLARKSFYSWQNPKSMPLLPVHEDNDDEEGDDGDLSDEERGGDVLARRPSFKNRALKSMSCFALSDLQEEEEEEEDE

SEQ ID NO: 3597 - protein, 754 aa, Streptococcus pyogenes M1 GAS
MTRFTEYVETKLGKSLTQASNEEIYLSLLNFVKEEASHKAKNSAKRKVYYISAEFLIGKLLSNNLINLGIYKDIKEELAAAGKSIAEVEDVELEPSLGNGGLGRLASCFIDSIASLGINGEGVGLNYHCGLFKQVFKHNEQEAEPNFWIEDDSWLVPTDISYDVPFKNFTLKSRLDRIDVLGYKRDTKNYLNLFDIEGVDYGLIKDGISFDKTQIAKNLTLFLYPDDSDKNGELLRIYQQYFMVSNAAQLIIDEAIERGSNLHDLADYAYVQINDTHPSMVIPELIRLLTEKHGFDFDEAVAVVKNMVGYTNHTILAEALEKWPTAYLNEVVPHLVTIIEKLDALVRSEVSDPAVQIIDESGRVHMAHMDIHFATSVNGVAALHTEILKNSELKAFYDLYPEKFNNKTNGITFRRWLEFANQDLADYIKELIGDEYLTDATKLEKLMAFADDKAVHAKLAEIKFNNKLALKRYLKDNKDIELDEHSIIDTQIKRFHEYKRQQMNALYVIHKYLEIKKGNLPKRKITVIFGGKAAPAYIIAQDIIHLILCLSELINNDPEVSPYLNVHLVENYNVTVAEHLIPATDISEQISLASKEASGTGNMKFMLNGALTLGTMDGANVEIAELAGMENIYTFGKDSDTIINLYATASYVAKDYYDNHPAIKAAVNFIISPELLAFGNEERLDRLYKELISKDWFMTLIDLEEYIEVKEKMLADYEDQDLWMTKVVHNIAKAGFFSSDRTIEQYNEDIWHSR

SEQ ID NO: 3598 - protein, 507 aa, Pseudomonas sp. KIE171
MSGDYMVQATTNLVGAAYWRGRADEIQFEGRCLIDGKMVEAQSGYTFDCVSPVDGRVLTKVSAGGEADVNRAVAAARSAFRDRRWSGQSPVSRKRTLQAFAALIRLHRDELALLETLDMGKPISASRSVDVEAVASCFEWYAEAIDKLYEQIAPTAETDLALITREPLGVVGAIVPWNFPMLTAAWKTAPALACGNSVVLKPAEQSPLTAIRLAQLALEAGVPEGVFNVVPGLGGSAGRALACHMDVDGIFFTGSTATGRLLTEYAAKSNLKRVCLELGGKSPNIILASYGDIEKAAVASAESMFNNQGEVCIAPSRLIVERSIHKRVVEIVAEVAKRRQPGDPLDPTTRMGALVDANHADRVMGFIGRAKADGATLVAGGTRALTETGGSYVVPTVFDNVSNCMEIARDEVFGPVLSVIPVANVGEAVAVANDSPYGLGAGVWTDRLSDAHKISRELRAGVVYVNCYNDCDITTPFGGVKQSGNGRDKSLYALDEYTELKTTWIKL

SEQ ID NO: 3599 - protein, 421 aa, Balbiania investiens
  unsure (1)..(421): unsure at all Xaa locations
LQXXLVRSSTATWTVVWTDLLTACDLYRAKAYKVDAVPNSSDQYFAYIAYDIDLFEEGSIANLTASIIGNVFGFKAVKALRLEDMRMPVAYLKTFQGPATGTIVERERMDKFGRPFLGATVKPKLGLSGKNYGRVVYEGLKGGLDLLKDDENINSQPFMRWRERYLYSMEGVNRAQAAAGEIKGHYLNVTAGTMEQMYERAEFAKQLGSVICMVDLVIGYTAIQSMAIWARKTDMILHLHRAGNSTYSRQKSHGMNFRVICKWMRMAGVDHIHAGTVVGKLEGDLLMIKGFYNTLLDSHLEINLPQGIFFEQDWASLRKVTPVASGGIHCGQMHXLLDYLGDDVVLQFGGGTIGHPDGIQAGATANRVALESMVLARNEGRDFLAEGPQILKEAAKTCGPLQTALDLWKDITFNYTSTDTA

SEQ ID NO: 3600 - protein, 510 aa, Spirodela polyrhiza
MFIEKFRVESPNVKYGDGEIESVYSYETTELVHEVRNGSYQWVVKPKSVQYQFKTDTRVPRLGVMLVGWGGNNGSTLTAGVIANREGISWVTKEKVQQANYFGSLTQSSSIRVGSFNGEEIYAPFKSLLPMVNPDEIVFGGWDISDMNLADAMGRAKVLDIDLQKQLRPYMESMVPLPGIYNPDFIAANQGSRANNVIKGPKKQQVQRIIDDIREFKEREKVEKVVVLWTANTERYSDLVVGLNDTMENLLAAVERDEAEISPSSLYALACIMEGVPFVNGSPQNTFVPGLIEMAIKRNSLIGGDDFKSGQTKMKSVLVDFLVGAGIKPTSIVSYNHLGNNDGMNLSAPQTFRSKEISKSNVVDDMVSSNGILYEPGEHPDHVIVIKYVPYVGDSKRAMDEYTSEIFMGGKSTIILHNTCEDSLLAAPIILDLVLLAELSTRIQLKAEGESKFHSFHPVASILSYLSKAPLVPPGTPVVNALSKQRAMLENILRACVGLAPENNMILEYK

SEQ ID NO: 3601 - protein, 244 aa, Zea mays
MGRGRVELKRIENKINRQVTFAKRRNGLLKKAYELSVLCDAEVALIVFSNRGKLYEFCSGPSITRTLERYEKNSYAGPDTAVQNKENELVQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 3602 - protein, 366 aa, Arabidopsis thaliana
MENQEEDEVVLAKVTSEVEDNFEDEGLVSNSTLEKVAAAKKYIENHYNRRMRHIQQRKERRWVLEQKIASLDVSEKEQLELLEDLQRKETEYTRLMRNRLCVDDFDLLSIIGRGAFGEARLCREKKTGNIYAMKKLKKSEMLSRGQVEHVRAERNLLAEVASDCIVKLYYSFQDPEYLYLIMEYLSGGDVMTLLMREETLTETVARFYIAQSVLAIESIHKHNYVHRDIKPDNLLLDKYGHMKLSDFGLCKPLDCRNISAMNVNEPLNDENINESIDGDENCSIGRRGRRWKSPLEQLQHWQINRRKLAYSTVGTPDYIAPEVLLKKGYGVECDWWSLGAIMYEMLVGYPPFYSDDPVTTCRKVYL

SEQ ID NO: 3603 - protein, 68 aa, Zea mays
GAMAGSPSLSRAEKEVNSLIHQVGDDYGLKVSVGLPQETAQAIPAAKDKEKVAEDALFPPLAELKAPG

SEQ ID NO: 3604 - protein, 417 aa, Xanthomonas axonopodis pv. citri str. 306
MISYAEALALVHAHVATLSSEWVASDDAEGRVLADALSSQAELPPFDNSAMDGFALATAGMGALADSEHVVSGTVAAGQDAGAAAIGAAWEIMTGAGVPPGADAVVPIEQVQILEHDGERPSRIRLHRPVRAGQHIRRRGEDVRLHDRVIDAGTVLRGAHLMLLAGLGCAQVQVLRRPRVALIATGRELIGDPAQPLQPGQIRDGTSSYLLARLRAAGADVVWRGQVGDDDAAFDAALAQARHAGADLILSTGAVSRGRYDFIPDALARHAAEVLFHKVAVRPGKPVLFARFGDGALYAGLPGNPMASAAGLRFFVEPALRGLLGMPVERGLRVALEAPMQARPLWRQHLRARLLCSVAGELSVQILPQQESFRVAPLLQANVWAVLEPQDEGAAASTHAEVFGLGHLQPAAPAIAP

SEQ ID NO: 3605 - protein, 151 aa, Coxiella burnetii RSA 493
MAKAVQKYPHSMLSHLQQDINRLFEPFGWATGGELWDAFSSEWSPHIDIKDEGQNYLICADIPGVDPKKIQVSMENNILTIKGERETEAKEKSEGYLRIERTKGAFLRQFTLPESVDAESIKAKSKHGVLEITIPKAQPPRTKKIEIEEQE

SEQ ID NO: 3606 - protein, 468 aa, Archaeoglobus fulgidus DSM 4304
MVGRMCVAVLIVLLLVATAGADPNGAETLKENPELPVDFVWALICGFLVMFMQAGFAMLEAGFSRAKNVANVMMKNLMDFAVGSLAFFAVGFALMMGADWQGIAGTTGWFLAGESYDVSTIELWFFMLVFAATAATIVSGSIAERPKFSVYLVYSAVVSAVIYPIYGHWLWGGGWLSSSEFMVKLGGGYGALDFAGSGVVHALGGYIALAAVMLLGPRLGKYDSDGNPRAIPGHNLAFAVIGTFILWFGWFGFNAGSTLSAHELRVSIIASNTNLAAAAGAVTAMAITWLRNGKPDVGMTCNGAVAGLVAITAPCAWVQPWSSVVIGTIAGFIATYGYWWLEKRGLDDVVGAIPVHGFSGTWGLIALGIFADGSYGLYATESPLVTGLLYGNWGFFIVQLISAIVNFAWAFGTGFALFWILKKVIGIRVSPEEEMLGLDIAEHAAVAYPNFVCTETELPLAMKQGGGR

SEQ ID NO: 3607 - protein, 489 aa, Xanthomonas axonopodis pv. citri str. 306
MEALSETLRGIAARGPLGLFIDGQWRASTGDRTVDVIAPHTEERLLRYTEPSPSDTEAAIAAARSAFDNGPWPQLSPQERSVVLKRVADHLRARMPELAEAWTGQVGATLGFSKRASQQAPDLFDYYADLIATHAFVQPRVRPSGGRVHVVQEPVGVVAAITPWNAPLVLLCYKVAAALAAGCTVVAKPSPETPIDAYILAECISAAGVPDGVFNLLPAGREVGEQLIRHPHVDKISFTGSTQAGRSIGIACAERLARVGLELGGKSAAIVLEDADLAKMLPTLVPYSMPIAGQVCFSLTRVLVPTQRREEILQAYCTALSAVKLGDPFAADTGMGPLALGRQLERVQSYIAKGKAEGARLVMGGSRPAHLSRGFFVEPTVFAEVMPDMAIAREEIFGPVVSFIDYHDEADLIAKANASDYGLHGTIYSEDAERAYRIARRVRSGSHAINGMWVDISMPFGGFKHSGIGREGGIEGLHAFLETRTLYLS

SEQ ID NO: 3608 - protein, 494 aa, Pseudomonas putida
MSASSKFNVDPAGFRNRNLIGGQWKGSISGETITVENPATEEIIAHIPQGRHEDIDEAVRVARATFESPAWRKIRPIDRGRILENVARKIEEHADELAYLESLDTGKALTFAKAIDLPSTIDVFRYMGGWCSKLGGTTPPISFDGREYHTYTRREPIGVVGAITPWNYPLALGSWKIASALAAGCTMVLKPTELTPLSTLRLAELCLEAGLPEGALNIVNGHGHEAGEALARHPGVDKITFTGSTVVGKKIVEYALGNMKRVTLELGGKSPSIVFADADLDQVGLGAALAVFFNSGQICFAASRLFVQDSVYDQVVEAVAAAAAQFKVGNGLDPDTLLGPLVSRKQQERVMGYVQSGIEQGARLVCGGKSVGEKGYFLQPTVFADAAPSMRIAQEEIFGPVVSVIRFKDEAEAIRMANDTAYGLAANIWTRDIKKAHRVAHRLQAGSVWINCHGVIDPAAPFGGFKQSGWGREVSEEGLSAYTETKTVCALLDD

SEQ ID NO: 3609 - protein, 218 aa, Rosa rugosa
NGLLKKAYELSILCDAEVALIIFSNRGKLYEFCSSSSILKTLERYQKCSYGAMEVNEPAKELEQSSYREYLKLKTRCESLQRTQRNLLGEDLGPLNTKELEQLERQLESSLKHVRSTKTQYMLDQLSDLQSKEHMLIEANRDLTMKLDEINSGTQLRQTWERGHAHQTMLYGTQHAQTQGLMFQPLDCNPTLQIGYNAVGSQQMTAATPAPTQPVNGF

SEQ ID NO: 3610 - protein, 443 aa, Glycine max
MGQGTPGGMNRQGDRKPDGGDKKEKKFEPSAPPARVGRKQRKQKGPEAAARLPTVTPVTKCKLRLLKLERIKDYLLMEEEFVANQERLKPQEEKAEEDRSKVDDLRGSPMSVGNLEELIDENHAIVSSSVGPEYYVGILSFVDKDQLEPGCAILMHNKVLSVVGLLQDEVDPMVSVMKVEKAPLESYADIGGLDAQIQEIKEAVELPLTHPELYEDIGIKPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSRMTLADDVNLEEFVMTKDEFSGADIKAICTEAGLLALRERRMKVTHADFKKAKDKVMFKKKEGVPEGLYM

SEQ ID NO: 3611 - protein, 194 aa, Zea mays
GTCAVAGIMSDANILINTARLHAQRYALSYQEPIPVEQLVQSLCDTKQGYTQFGGLRPFGVSFLFAGWDKHHGFQLYMSDPSGNYGGWKAAAVGANSQAAQSMLKQDYKDGLTREEAVALALKVLSKTMDSTSLTAEKLELAEVFLQPDTGEVQYQVCSPEALGKLLAKSGLTQPTPEGIMYWFAVACDAFYCS

SEQ ID NO: 3612 - protein, 343 aa, Oryza sativa
MAGSRAAGRGGRPLLGGGGGKRGGGGGGGGGGGGKSSSYTTTVILAALLLASVALLLLVALGALSLPSGGGVGVGHAGIGLPRPRPRFRRSAAFESGLEMRGGEKGEPWTEVLSWEPRAFLYHNFLSKEECEYLISLAKPHMKKSTVVDASTGGSKDSRVRTSSGMFLGRGQDKIIRTIEKRISDYTFIPVENGEGLQVLHYEVGQKYEPHFDYFHDEFNTKNGGQRIATLLMYLSDVEEGGETIFPSSKANSSSSPFYNELSECAKKGLAVKPKMGDALLFWSMRPDGSLDATSLHGEIPILWLLTNSNLSMLLLKERKEKRSFLAHVEDFNFSIEKHYNFF

SEQ ID NO: 3613 - protein, 549 aa, Shewanella oneidensis MR-1
MTLASIRRGYHVIKTLLQYGLDDVLPPKMTPWYFTLARNSLFWIRNKHKDKSGGERLKLAMQELGPVYIKLGQMLSTRRDLLSDEWATELAMLQDKVPPFDGALARLAIEAELKAPIETFFDDFNETPLASASISQVHTATLKSNGKAVVLKVLRPNVETKIQADLLLMSQTAKVIDYLLGEGNRLRPAEVIEDYRVTILGELNLKLEALNAIKLRNNFIDSDALYIPYVYEEFCYPRLMVMERIYGIPVSDIVALKAQGTNFKLLAERGVELFFTQVFRDNFFHADMHPGNIFISRENPENPYYIGLDCGIMGTLSEVDKRYLAENFLAFFNRDYHRIAQLYIESGWVSEKTDLQAFEQAIKVVCEPMFNKPLDEISFGHVLLELFRTARHFDIVVQPQLVLLEKTLLYIEGLGRQLYPQLDLWQTAKPFLEQWMAEQVGPKAMFKKVSTKLPYWSDKLPEFPELIYDNLKLGRKLLSSQQQMLDKYLKYQQQAHKSNYLLITSAILLICGTLLFNQDATLLSPYVCLISGAVLWIIGWRSRPKNRKF

SEQ ID NO: 3614 - protein, 354 aa, Magnetococcus sp. MC-1
MPLVSMRQLLDHAAENSYGLPAFNVNNMEQVRAIMRAADETDSPVILQASAGARKYAGEAFLRHQILAALELYPHIPICMHQDHGQSPAICQAAIRSNFSSVMMDGSLREDGKTPSDWDYNVATTAKVVEFSHAIGVSVEGELGVLGSLETGMAGEEDGVGAEGKMEKDALLTDPEEAARFVKETHVDALAIAIGTSHGAYKFTRKPTGDILAIGRIAEINARIPNTHLVMHGSSSVPQELLAIINEFGGEIPETYGVPVEEIVRGIQHGVRKINVDTDLRLAMTGAIRKYFHKNPSAFDPRGYNRPAEDAAYAVCKARYEAFGAAGNASKIKVITMEDMAKRYASGELDPKVN

SEQ ID NO: 3615 - protein, 395 aa, Beta vulgaris
MALLHHLNKTKSLSSVLLPLTSTHTHSRRLSSDSTKTLTIETSVPFKSHIVEPPSRSVDTTPAELMTYFRDMALMRRMEIASDSLYKAKLIRGFCHLYDGQEAVAVGMEAAITKKDNIITAYRDHCIYLARGGSLLSAFAELMGRQDGCSRGKGGSMHFYKKDSGFYGGHGIVGAQVPLGVGLAFAQKYNKEDCVSFALYGDGAANQGQLFEALNMAALWDLPAILVCENNHYGMGTAEWRAAKSPSYYKRGDYVPGLKVDGMDVLAVKQACKFAKEYVLKNGPIILEMDTYRYHGHSMSDPGSTYRTRDEISGIRQERDPIERVRKLLLAHDIAGEKELKDIEKEIRKEVDEAIAKAKESPMPDTSELFTNIYVKGYGVESFGADRKVLRTTLP

SEQ ID NO: 3616 - protein, 692 aa, Oryza sativa
MAVAVAAAAAVSRQWTRVRTLGRGASGAEVFLAADDASGELFAVKSVGAAGAAALRREQGVMAGLSSPHVVPCIGGRVGRDGSYQMFLEFAPGGSLADVAARCGGRMEECAVGEYAVDVARGLAYLHGMGLVHGDVKARNVVIGGDGRAKLADFGCARWADSGRPIGGTPAFMAPEVARGEEQSPAADVWALGCTVIEMATGRAPWSDMDDVLAAVHRIGYTEAVPEVPGWLSADAKDFLARCLQRRPIDRSTAAQLLEHPFVASAAGDGKPEAAKSKWVSPKSTLDAALWESDTDEEEDDELSQSTAERIGSLACAASSLPDWDSDDGWIDVISTPTEESCETTTSPADEETTTDLNGDIRTAEFELPHIDVDSGNGNTTHNVGEANAQHIISPSNLVFDQHRQQHMGPCPFSKGERERADGERRTRGRTEEKELTKGAHFTISVASYYCERACVRASLRLLPPVGIRHGNGICYYCQLRCDGVTVRFVIRPPVVFFLSLSTCNSPRRGLLLDPVVRFWMAFSDVCKTAKRLRVDFIISRRDDTTRTGRRRPFYHKSERFERKSYARHFWRSQRHPRITHTSIEIARFGFGRRLRKRVNTIPVATASRTTLKAVDAITPSSWAPGPQCHFPRTGTAAPRRSTNGAARSIDRSSEGILKVRRDLPDHRMCISIAVLAAQLKPAHGIGVIMTD

SEQ ID NO: 3617 - protein, 269 aa, Beta vulgaris
  unsure (1)..(269): unsure at all Xaa locations
AMGGLIFGYDIGISGGVTSMPDFLKKFFPSVYRKEALDKSVNQYCKFDSVTLTLFTSSLYVAALVASLVASVVTRKLGRKLSMLFGGLLFCVGAIINALAKDVAMLIVGRILLGFGVGFANQSVPLYLSEMAPYKYRGSLNIGFQLSITIGILIANVLNYFFAKIHDWGWRLSLGGAMVPAIIISIGSLLLPDTPNSMIERGKRDEALLKLKRVRGVDDVEDEFNDLVVASENSKKVEHPWRNLLQRKXRPHLTMGFXIPFFHNLLGLM

SEQ ID NO: 3618 - protein, 151 aa, Yersinia bercovieri
LMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAG

SEQ ID NO: 3619 - protein, 141 aa, Zea mays
  unsure (1)..(141): unsure at all Xaa locations
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGTTPGYYDGXRYGTMWKLPLXFGGTDSASRV

SEQ ID NO: 3620 - protein, 474 aa, Zea mays
MDMALASKASPPPSNATTAEQLIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKVFQTDVPTVKNINLDFSLGYYIILDMPFCPLIFNIYF

SEQ ID NO: 3621 - protein, 373 aa, Synechococcus sp. PCC 7942
MLPFLRSELARCQPYHPNPGGTGMAMDILDTNECPYDLPTDLKQTLADRYVEAIASNRYPDGSHTDLKAAIVDYLSEQTAGQWQPGPEHVTVGNGSDELIRSILIATCLGGQGSVLVAEPTFSMYGIVAETLGIPVVRIGRDPQTWEMDLAAAETAITQTEGTPVRLCFVVHPNSPTANPLTEAEKDWLRQVPPQILVVIDEAYFEFSGETLLAELPQHPNWLITRTFSKALRLAAHRVGYGIGDPQLIAALEAIRLPYNLPSVAQLAATLALEARSQLLSAIPRLITERDRLYRKLQVVSQLQVWPSASNFLFLKTQSSSQTAALAAQLKAQGTLVRHTADGLRITIGSPAENERTLAHLQTAITQSLPATV

SEQ ID NO: 3622 - protein, 391 aa, Solanum tuberosum
MALSTSRAINHIMKPLSAAVCATRRLSSDSTATITVETSLPFTSHNIDPPSRSVETSPKELMTFFKDMTEMRRMEIAADSLYKAKLIRGFCHLYDGQEAVAVGMEAAITKKDCIITAYRDHCIFLGRGGTLVEAFAELMGRRDGCSRGKGGSMHFYKKESGFYGGHGIVGAQVPLGIGLAFAQKYKKEDYVTFAMYGDGAANQGQLFEALNMAALWDLPAILVCENNHYGMGTAEWRAAKSPAYYKRGDYVPGLRVDGMDVFAVKQACTFAKQHALKNGPIILEMDTYRYHGHSMSDPGSTYRTRDEISGVRQERDPVERIRSLILAHNIATEAELKDIEKENRKVVDEAIAKAKESPMPDPSELFTNVYVKGFGVEAYGADRKELRATLP

SEQ ID NO: 3623 - protein, 475 aa, Helicobacter pylori J99
MEHQNTTQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFVNIPIHYWVISCIALVFLLNFFSVKIFAEGEFFFSLIKVLAVIAFISIGVIGIIYQIYLHGFSSIFDNFHFGDKGFFPNGSEAVFSAMLAVIFAFTGTEVIGVAVGETKNASEVMPKAIKATLWRIVFFFLGSVFVISVFLPMSDSSIAQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSISQYSFRKQYLKAGHSLEDLPYKAPFLPFLQLIGITGCIIGVIGSAMDKDQRIGMILTIVFAVVCYIGYYFTQKANENNKKDLI

SEQ ID NO: 3624 - protein, 971 aa, Candida albicans
MTSIYTSDLKNHRRAPPPPNGAAGSGSGSGSGSGSGSGSLANIVTSSNSLGVTANQTKPIQLNINSSKRQSGWVHVKDDGIFTSFRWNKRFMVINDKTLNFYKQEPYSSDGNSNSNTPDLSFPLYLINNINLKPNSGYSKTSQSFEIVPKNNNKSILISVKTNNDYLDWLDAFTTKCPLVQIGENNSGVSSSHPHLQIQHLTNGSLNGNSSSSPTSGLLSSSVLTGGNSGVSGPINFTHKVHVGFDPASGNFTGLPDTWKSLLQHSKITNEDWKKDPVAVIEVLEFYSDINGGNSAAGTPIGSPMINSKTNNNNNDPNNYSSTKNNVQEANLQEWVKPPAKSTVSQFKPSRAAPKPPTPYHLTQLNGSSHQHTSSSGSLPSSGNNNNNNSTNNNNTKNVSPLNNLMNKSELIPARRAPPPPTSGTSSDTYSNKNHQDRSGYEQQRQQRTDSSQQQQQQKQHQYQQKSQQQQQQPQQPLSSHQGGTSHIPKQVPPTLPSSGPPTQAASGKSMPSKIHPDLKIQQGTNNYIKSSGTDANQVDGDAKQFIKPFNLQSKKSQQQLASKQPSPPSSQQQQQKPMTSHGLMGTSHSVTKPLNPVNDPIKPLNLKSSKSKEALNETSGVSKTPSPTDKSNKPTAPASGPAVTKTAKQLKKERERLNDLQIIAKLKTVVNNQDPKPLFRIVEKAGQGASGNVYLAEMIKDNNRKIAIKQMDLDAQPRKELIINEILVMKDSQHKNIVNFLDSYLIGDNELWVIMEYMQGGSLTEIIENNDFKLNEKQIATICFETLKGLQHLHKKHIIHRDIKSDNVLLDAYGNVKITDFGFCAKLTDQRNKRATMVGTPYWMAPEVVKQKEYDEKVDVWSLGIMTIEMIEGEPPYLNEEPLKALYLIATNGTPKLKKPELLSNSIKKFLSICLCVDVRYRASTDELLEHSFIQHKSGKIEELAPLLEWKKQQQKHQQHKQETSDTGFA

SEQ ID NO: 3625 - protein, 525 aa, Oryza sativa
MASSQLARRAARRLLSSQHRRHCAAPACPWLLGSAPPVLAPSPVAAAAAGDRRGFCSVRRFTGESNAAAAVEEAENGLVAGGDQHLCAYSLGCKVTAKPSIPPLSFHERKRNLVERKQAIDFPGGKVSFVAEMNFLPESQRDRINCYRVLDDDGRTISGSRFQEVSKELALKMYNEMATLQVMDTIFFEAQRQGRISFYLTSHGEEAINIASAAALTIDDIVLPQYREPGVLLWRGFTLQEFANQCFGNKLDYGKGRQMPIHYGSNRLNYFTVSSPIATQLPHAVGAAYSLKMDKKDACAITYFGDGGTSEGDFHAALNFAAVMEAPVIFFCRNNGWAISTPTSEQFRSDLYNNLNSTAIAGDGAVIRGQAYGMRSIRVDGNDALAVYSAVHTAREMAIKEGRPILVEALTYRVGHHSTSDDSTKYRPVDEIEHWRTARDPISRYRKWVQGNGWWCDEDESELRNNVRQELLKAIQVAERMPKPPLAELFTDVYDEVPSNLREQERLLRDTIKKHPADYPADVHI

SEQ ID NO: 3626 - protein, 435 aa, Pachymenia cornea
  unsure (1)..(435): unsure at all Xaa locations
PVEASAAVAGESSTATWTVVWTDLLTACDLYRAKAYKVDAVPNSSDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFXKDDENINSQPFMXWKERFLYSMEAVNRSIAATGEVKGHYMNVTAATMXXMYERAEFAKQLGSIIIMIDLVIGYTAIQTMGIWARKNDMILHLHRAGNSTYSRQKSHGMNFRVICKWMRMAGVDHIHAGTVVGKLEGDPLMIRGFYNTLLYTHLKVNLPQGIFFEQDWASLRKVTPVASGGIHCGQMHQLLDYLGIDVVLQFGGGXIGHPDGIQXGATANRVALXXXXXARNEGRDYVGEGPQILQDAAKTCGPLQTALDLWKDITFNYTSTDTADFVETPTANV

SEQ ID NO: 3627 - protein, 257 aa, Zea mays
  unsure (1)..(257): unsure at all Xaa locations
MATPSSSLCSSFASLRTASIGHPRGIASSTPRKAFQVRASARVDKFSKSDIIVSPSILSANFAKLGDQVKAVEVAGCDWIHVDVMDGRFVPNITIGPFVVDALRPVTDLPLDVHLMIVEPEQRVPDFIKAGADIVSVHCEQTSTIHLHRTVNQIKSLGAKAGVVLNPATPLTAIDYVLDXFIESQVKKIAELRRLCAEKGVNPWIEVDGGVGPKNAYKVIEAGANAIVAGSAVFGAPDYAEAIKGIKTSQRPLAVAA

SEQ ID NO: 3628 - protein, 311 aa, Glycine max
  unsure (1)..(311): unsure at all Xaa locations
MSSRVWFLLFLLLISKCHQVWGSYAGSASSIVNPSKVKQISWKPRAFVYEGFLTDLECDHLISLAKSELKRSAVADNLSGESQLSDVRTSSGMFISKNKDPIISGIEDKISSWTFLPKENGEDIQVLRYEHGQKYDPHYDYFTDKVNIARGGHRIATVLMYLTDVAKGGETVFPSAEEPPRRRGAETSSDLSECAKKGIAVVLFILPGIAFAXVKPRRGDALLFFSLHTNATPDTSSLHAGCPVIEGEKWSPTKWIHVDSFDKTVGAGGDCSDNHVSCEKWASLGECPKNPEYMIGSSDIPGYCRKSCKAC

SEQ ID NO: 3629 - protein, 249 aa, Triticum aestivum
  unsure (1)..(249): unsure at all Xaa locations
MGLGSDASSSSSRLDSAPLLPHHSAEGGHLSSQPKTFANVFIAVVGAGVLGLPYTFSRTGWAAGSILLLSVALLTFYCMMLLVACRRRLADDHPKMLSSFGDLGDAVFGAPGRLAVDTMLVLSQASFCVGYLIFISNTMAHLYPVFAPSSNVFLSPKALFIYAMLPFQLGLNSIKTLTLLAPLXSIFADVVDLGAMGVVVGQGRVDLARRXQPTVAAFGAPAALLYGGGRVRTPKGSVWAWPLGGPGQE

SEQ ID NO: 3630 - protein, 173 aa, Flaveria pringlei
MASIPATVATVAQANMVAPFTGLKSNAAFPVTKKVNDFSTLPSNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 3631 - protein, 428 aa, Oryza sativa (japonica cultivar-group); identical to SEQ ID NO: 2589

SEQ ID NO: 3632 - protein, 314 aa, Symbiodinium sp. P083-2
RIGRMVFQAICDQGLLGSKLDVVGVVDMSTDAEYFAYQMKYDSVHGKFKHDVKIGEKDELIVNGHKIKCIQASREGPKALPWKDMGVKYVIESTGLFVEYEKAAGHIEAGAEKVIISAPGKGNLKTLVMGVNHTEYDKANHHVVSNASCTTNCLAPICHVLLKEGVGIEKGLMTTIHAYTATQKTVDGVSAKDWRGGRAAACNIIPSATGAAKAVGEVLPVTKGKLTGMAFRVPTPDVSVVDLTFTAEKDTSIEEIDKLLKAATESYMKGVLSYTDEELVSMDFVHNKNSSIYDSKATLQNNLPGEKRFFKVVS

SEQ ID NO: 3633 - protein, 218 aa, Zea mays
IVFVVVVAKRHTSGGVARRPCPTCPPPYATPPSPSSASPSPAPTRGPSLPASNHQPLESVPSPCSSCNRASDQPSKGHRTDRELHRSGDRHARKAPAAHDTATAAAAAAAPKGCVTVRVGLEGEEQRRFAVPLGHLKHPLFGALLEEAEREYGFRHQGALAIPCRVDRFVQLERLIGRDLHGACAHHLVDLDGAAAAAAQHQHQHHLHLPRFVGCFRA

SEQ ID NO: 3634 - protein, 173 aa, Glycine max
  unsure (1)..(173): unsure at all Xaa locations
TRPSTRSSTRSGSGVVTAYGTGAITETKKSPFSVKVGLAQMLXGGVIMDVGDAEQARIAEEAGACAGMALERVPADIRAQGGVARMSDPQLIKDIKRAGTIPVMAKARSGHFREAQIREATGIGYGDESEVLTLADDAGHINKHHLAEYPLAGGRRNLRKDPRRNWEGDDKNR

SEQ ID NO: 3635 - protein, 536 aa, Bradyrhizobium japonicum USDA 110
MIAAKFQTFLILLAVLAGTALVARRFNIAPAILLMLSGVGLAFVPGMPPVELPPELVLLMVLPPLIYSASVAMSWREFRNNLRPIVLLAVGAVIFTAAMVAAATHYLIGLPWAIGFLLGAIVAPPDVVAPLAIARRLNIPRRLLVILEGEGLANDATALILYRFALAAIMVGHLSLPMAAGEFVLIIAGEIAFGIGVGWLSLRFRRWAKDQQVELTLSLITPYVSYWLPEHVGGSGVIATVACGLYVSWNGPLLISSATRLQGIFFWDLIIYLIEGLLFLLTGFQMRALYEKSKAFPLDDILIATAVVLTIIVTARFAWLYPATYLPRILSKSLRKRDPSPPWQWPFVLAFTGVRGAVSLAAALALPFTLPDGNAFPYRDLILFVAFGVIFVTLIGVGLTLPPVVRWLGVAEAGRNEHVAEHEAEIAARRQALDAALKSLDALTEAKEVSDEVMRLLRARHEIRVNQLPDSLDPTHHDVSAAGTALTRELIAAERKFIHDLLRDGQITDETRRRIERDLDLEEASLANREYRGVPL

SEQ ID NO: 3636 - protein, 474 aa, Pelagomonas calceolata
  unsure (1)..(474): unsure at all Xaa locations
RYESGIIPYAKMGYWDANYAVKTTDLLALFRITPQPGVDPVEAAAAVAGESSTATWTVVWTDLLTACDIYRAKAFRVDPVPSAPDQFFAYVAYEGDLFEEGSLANMTASIIGNVFGFKAVKXXRLEDMRIPHSYLKTFQGPASGVDVERDVXXXFGRPLLGATVKPKLGLSGKNYGRVVFEGLKGGLDFLKDDENINSQPFMRWRERFLYCIEGINRAAAATGEVKGSYLNMTAGNNDEMITRGEFAKELGSVIVMIDLVIGYTAIQTAAIWARANHMILHLHRAGNSTYARQKNHGINFRVICKWMRMAGVDHIHAGTVVGKLEGDPLMIQGFYDTLLKTKLSIDLPKGIFFDMDWASLRKCLPVASGGIHCGQMHQLLNYLGDXXXXXXXXXXXXXXXXXXXGATANRVALEAMVLARNEGRNYIEEGPQILRDTAKMCGPLQTALDLWKDXXFNYASTDTADFADTPTANV

SEQ ID NO: 3637 - protein, 213 aa, Wolbachia endosymbiont of Drosophila melanogaster
MEIFLDSVDLNEIKGLKEFIDGITTNPSLIAKSGRKDKYEDLVREICSIIKGPVSVEVVADSHEEMITEGLNLAKIADNVVIKLPLTHEGLISCKKLWTEHKIPVNITLCFSPGQALLAAKVGACFISPFVGRLDDISYDGLSLIEDICTIYSNYGFDTKVLVASVRSPAHVIEAARLGADSITVPAKVLRQLVNHPLTDQGLAIFEKDWGVK

SEQ ID NO: 3638 - protein, 462 aa, Bacillus subtilis
MMSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 3639 - protein, 335 aa, Zea mays
MAAAPSHPFVYIDAAALHSLLPFASLIPHLRAGLAHPELSAGIQCPQRVSIPLPTAPSAALLLMPSWCAHPSLPYLALKAVTSFPSNSPRLPSVHAAVSLFSAATGAPLASIDGSALTLLRTAAVSALAASLLASPSRPPSVLALAGAGALAPYLAEAHLAALPSVSRVLVWNRTRAKSAALVAKLRESHPGLTVEEVGSMDEAVAAADVVSCATGSREPIVRGELLRPGAHLDLVGSFTPAMRECDDDALRRGRVFIDFEAAMEEAGELVGAVQRGVLRREDVAGTLSELAAGTVVGPRRDDEITVFKSVGTAVVDLLAAQLAYETHLAATKDA

SEQ ID NO: 3640 - protein, 488 aa, Vaucheria bursata
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNTTAGTMEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNVLLETKLEINLPQGLFFEMDWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVETATQSK

SEQ ID NO: 3641 - protein, 667 aa, Lactobacillus plantarum WCFS1
MQTVFLVLLLVAAVVVANAVYARFNQIPVAFLQIGAGLILSLIPLYRNFELEPEIFLFVIISILMFNDGQNTNIRKLSHQFGTTLSLSVVLAIVTILIVGTVTHLLIPEFSLALAFALGAIITPTDAVAVSSITTKVAIPGEVMTTLENESLFNDASGIVAFNLAIAAIVTGKFSVWHGVTNFLYVFAGGIFVGLIIGYIIVAVRIMLIRMRVDTPSVIVPYTLLTPFVVYFLAESLGVSGILAVVATGLIHGVQSDQLRLTTSRLQIVMTTTWSIVASILNGIVFVLLGVSLPSVINHLQQRDTSSVAVLVGLGILLYLIMTFARFLWTRFDLARIRAWDNHEKTRNAFVMGLSGVHGTITLAMAFSLPLTLNGSAFPYRNDIIFVAAVVILTSLMVPTLLLPLTLPKQVVKVTEDELATAKADMVTHAIDLMQARHGNNAGTSKVIAILSGQRVLDGRPKRSQLASLFDATFKVEQTTIDEMVANNEITPQAAEKYMRVASQTRLQNQQTFFERLKLFFRFTLSKWSLSKKARARRKMFRQYRPHGGQSRAELMTRNRQMWQQMRQIEQKPYEAVLAYLADTITADNQQAIGIVRRAYDERHRRLSGERDFQETQNELLIEAFQLEYNFIQTQLANKTFSSELGNQLYEQISTDQLVYLQSINTD

SEQ ID NO: 3642 - protein, 369 aa, Streptomyces coelicolor A3(2)
MTFGIDDLPVRDELRGKSPYGAPQLDVPVRLNTNENPYPLPEALVERIAERVREAARDLNRYPDRDAVELRTQLARYLTDTSGHPLDVSNVWAANGSNEVIQQLLQTFGGPGRTAIGFEPSYSMHGLIARGTGTGWISGPRHEDFTIDVPAATRAIDEHRPDVVFITTPNNPTGTAVPAETVLALYEAAQAAKPSMVVVDEAYIEFSHGASLLPLLDGRPNLVVSRTMSKAFGAAGLRLGYLAAHPAVVDAVQLVRLPYHLSAVTQATALAALEHTDTLLKYVEQLKTERDRLVAELRAIGYAVTESDANFVQFGRFADSHATWRKILDRGVLVRDNGVPGWLRVTAGTPEENDAFLDAVREVKKEQHT

SEQ ID NO: 3643 - protein, 542 aa, Oryza sativa
MRRSGNGGAAKKKKKRSASAASERRPRADGGMRIVVPLQGVVQGRGGLVLGSLIPCALFYFFQLYIKRNRASPPPPPGSPTAASAAAVSPIHRSLSRGLLAPRAALPAISARGASVRDDDSLYYAGLRRCAADPYHPVTNPSGIIQLGLAENYLSLDLVGRWMEEHAAEAASMAGGEDEDERELSIRGLAAYQPYDGILALKMALAGFMRQIMQGSVSFEPSQVVITSGATPAMEILSFCLADPGNAFLVPSPYYPGWDRDIKWRTGIELIPVPCRSTDNFNISITALEIAYNQAKKRGIKVRGVLISNPNNPTGSFVPKQTLHDLLEFAAEKNIHLISDEVFAGSTYGSGKFVSVAEVVDDLEDFDKGRVHIIYGLSKDLSLAGFRVGVIYSYNESIVTAAAKIARFSSVSTPTQRLLVAMLSDQKFISDYLKVNRERLRKMYHLFVDALDQVGIECYKSSGGFYCWADMSKFIRSYSEKGERKLWDRLLEEAKVNVTPGSSCHCIEPGWFRCCFTTLSEHDIPVLVQRLRTITDSHKPNH

SEQ ID NO: 3644 - protein, 170 aa, Zea mays
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 3645 - protein, 141 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 3646 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 3647 - protein, 337 aa, Nostoc punctiforme
MIRVAINGFGRIGRNFARCWVGRENSQIDLVAINDTSDPRTNAHLLKYDSMLGKIKGAEISADDNSIIVNGKTIKCVSDRNPEKLPWRDWGIDLIIEATGVFTSKEGALKHVNAGAKKVLITAPGKNEDGTFVVGVNHHDYDHNIHNIISNASCTTNCLAPIAKVLNDKFGIIKGTMTTTHSYTGDQRLLDASHRDLRRARAAAINIVPTSTGAAKAVALVIPDLKGKLNGVALRVPTPNVSMVDFVVQVEKRTITEEVNQALKDAAEGPLKGILDYSELELVSSDYQGSDASSIVDSSLTLVMGNDLVKVMAWYDNEWGYSQRVLDLAELVAEKWQ

SEQ ID NO: 3648 - protein, 201 aa, Pseudomonas aeruginosa PAO1
MLLMIDNYDSFTYNLVQYFGELKAEVKVVRNDELSVEQIEALAPERIVLSPGPCTPNEAGVSLAVIERFAGKLPLLGVCLGHQSIGQAFGGEVVRARQVMHGKTSPIHHKDLGVFAGLANPLTVTRYHSLVVKRESLPECLEVTAWTQHADGSLDEIMGVRHKTLNVEGVQFHPESILTEQGHELLANFLRQQGGVRGEGN

SEQ ID NO: 3649 - protein, 174 aa, Dendrobium grex Madame Thong-IN
MGRGRVEMKRIENKINRQVTFAKRRTGLLKKAYELSVLCDVEVALIIFSNRGKLYEFCSSRSMLKTLEKYQKCSDGAPEMTMTSRETQSSQVEYLKLKSQVEALQRSQRNLLGEDLNPLGGKDLDQLERQLEASLKQIISTRMQYMLDQLGDLQQRELLLFETNKSLGTRVSAL

SEQ ID NO: 3650 - protein, 271 aa, Arabidopsis thaliana
SSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIEKYIDEHLNSTYYLTRLMKYTSPPDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 3651 - protein, 713 aa, Agrobacterium tumefaciens str. C58
MARKPNSTSSITATIHDQQLIRGAGGELHQIATGDEPVLTTAQGAPVADDQNSLRIGPRGPLVVDDFHFREKIFHFDHERIPERVVHARGYGAHGYFETYDSLATHTKADLFQRAGERTPAFVRFSTVAGNKGSADLARDVRGFAVKLYTKEGNWDLVGNNIPVFFIQDAIKFPDLVHAAKQEPDRAFPQAQTAHDTFWDFISLTPESMNMVMWIMSDRTIPRSFRFMEGFGVHTFRFINAKEQSTFVKFHWKPKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPINAPKCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKLGKASVPVNKE

SEQ ID NO: 3652 - protein, 385 aa, Populus alba
MAIDCIKTMPSITTPHHHPKDQDQCKDDGKSFVFDAQVLRHQTNIPQQFIWPDHEKPNTNAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEESSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYRSCLHRAVVNSQTPRKSLAFFLCPKNDKMVTPPHELVDTCNPRIYPDFTWPMLLEFTQKHYRADMKTLEVFTNWLHQRSLS

SEQ ID NO: 3653 - protein, 250 aa, Zea mays
MYFRPPPKGPEWYAGDAETGQAARPLYPMMLEDPRLRWAFIRKVYSILSIQMLLTVAVAAVVVYVRPVALFFVSTAAGFGLYIFLIILPFIVLCPLYYYYQRHPVNLLLLGLFTVAISFAVGLTCAFTKGEVIPDSAVLTAVVVLSLTAYTFWAAKRGHDFNFLGPFLFAAVMILMLFALIQLFFPLGRISLMIYGGLAALVFCGYIIYDTDNLIKRYSYDEYVWAAGALYLDRINLFLSLVTLFRAADS

SEQ ID NO: 3654 - protein, 227 aa, Eucalyptus grandis
MAREKIQIKKITNATARQVTFSKRRRGLFKKAEELSVLCDADVALIVFSSSGKLFEYCSSSMKEILERHHSHSENLGKLDQPSLKLQLVENGDYSRLSKEVAEKGHQLRQMRGEELQGLNIDELQQLEKSLEAGLNRVIEKKGEKIMKEITDLQQKGAKLMEETKRLKQQVTEISGRKTTATDSETIINEEGLSSESITNVCSSSSGPPQEDDSSDISLKLGLPYNG

SEQ ID NO: 3655 - protein, 321 aa, Dianthus caryophyllus
MANIVNFPIIDMEKLNNYNGVERSLVLDQIKDACHNWGFFQVVNHSLSHELMDKVERMTKEHYKKFREQKFKDMVQTKGLVSAESQVNDIDWESTFYLRHRPTSNISEVPDLDDQYRKLMKEFAAQIERLSEQLLDLLCENLGLEKGYLKNAFYGANGPTFGTKVSNYPPCPKPDLIKGLRAHTDAGGIILLFQDDKVSGLQLLKDGHWVDVPPMKHSIVVNLGDQLEVITNGKYKSVMHRVIAQTDGNRMSIASFYNPGSDAVIYPAPTLVEKEEEKCRAYPKFVFEDYMNLYLKLKFQEKEPRFEAMKAMETTGPIPTA

SEQ ID NO: 3656 - protein, 325 aa, Triticum aestivum
MGVKGFVEGGIASIVAGCSTHPLDLIKVRMQLQGESSAAAAAVPQPALRPALAFQAGAHTVTLPHAPTPVPKPGPIGICTQILRAEGAAGLFSGISATMLRQTLYSTTRMGLYDILKKRWTQENGGVLPLHLKIAAGLIAGGVGAAVGNPADLAMVRMQADGRLPLADRRNYRSVGDAIARMTRDEGVRSLWRGSALTVNRAMIVTASQLATYDQAKEAILARRGPAADGLGTHVAASFAAGIVAAAASNPVDVVKTRVMNMKVAPGAPPPYAGALDCALKTVRSEGVMALYKGFIPTVSRQGPFTVVLFVTLEQVRKVFKDVEF

SEQ ID NO: 3657 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKTVPLTKQLMDDYERTHASTIAVMPVPHDEVSAYGVIAPQGEGKDGLYSVETFVEKPAPEDAPSDLAIIGRYLLTPEIFEILEKQAPGAGNEIQLTDAIDTLNKTQR

SEQ ID NO: 3658 - protein, 340 aa, Zea mays
  unsure (1)..(340): unsure at all Xaa locations
QVLAATQMPEEPAGWFXGYSHKSIDNIVILSGDQLYRMNYMELVQKHVEDDADITISCAPVDTSPFLEARLVKIDHTGRVLQFFEKPKGADLNSMRVETNFLSYAIDDAQKYPYLASMGIFLEDINAXDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 3659 - protein, 348 aa, Escherichia coli O157:H7 EDL933
MEFFKKTALAALVMGFSGAALALPNITILATGGTIAGGGDSATKSNYTAGKVGVENLVNAVPQLKDIANVKGEQVVNIGSQDMNDDVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKNGTAVVRSSRVPTGATTQDAEVDDAKYGFIASGTLNPQKARVLLQLALTQTKDPQQIQQIFNQY

SEQ ID NO: 3660 - protein, 314 aa, Azotobacter vinelandii
MHEVDVLCFGETMAMFVAEDSGDLARVERFGKRIAGADSNVAIGLSRLGFKVTWLSRVGDDSLGRFVLDSLTREGLDCRHVRIDPAHPTGFQLKSRETDGRDPKVEYFRRGSAASHLSIADLVPDLLKARHLHATGIPPALSESCRMLSRELMECMRSAGRSLSFDPNLRPSLWPSQARMIAEINELAALAHWVLPGIEEGRLLTGYQSPADIAAFYLERGAEAVVIKLGPEGAYYRTADSEGRIDGVPATRVVDTVGAGDAFAVGVISALLEGRSFPQALKRGNAFGSRAVQCIGDMEGLPRRHELSEETLNV

SEQ ID NO: 3661 - protein, 814 aa, Rhizobium etli
MIDKKALLDNMTLAEQVSLLSGDTFWSLPPIDRLGIGRLRLTDGPNGARGAGSFVGGVTAAAFPVGIAIGASWNPDLAKEIGSALGDEVLSKGAHVSLAPTVNIQRSVTNGRNFECFSEDPILTAELAVGYIEGLQSTKVGATIKHFVGNESEIERTTISSDIDERTLREVYLIPFETAVKRAKVWAVMSSYNKLNGTYTAESHWLLNEVLRGDWGFNGVVMSDWFGSRSTAPTVNAGLDLEMPGPTRDRGSKLLAAVEGGEVSVETIRACVRNILTLMERTGAINDHREFKEYAIDQPKHRALIRRAGAESAVLLQNDGILPLAQQGMVAIIGPNAKVAQVMGGGSAQLNPHYVISPWQGLVDALGEENLCYAQGCNNYRFQPLIENPTTFEFFQGRELAGEPVKVVEEPSSLGVWLPPVAEGFVDPLRFSARMRTIFTASEAGVYRVGLTSAGLGRVYVDGRLVVDAWASWIRGTTFFEEGCEEVVGEITLEAGRTYEVVAEYARHDHVNLYIAAIRVGIGRFSAEAEIAEAAAVAAKADHAVVFVGRTGDWDTEGSDLRGIALPGLQNQLVEAVIAANPNTIVVLQTGGPVEMPWLSGARAVLQCWYPGQEAGNAIADVLLGKAEPSGRLAQTFPVRWADNPTHTEDDAVYPGKDGHVRYDEGVFVGYRHYDRHGIKPLFPFGHGLGYSSFAMSDLTVGLPDAAGAVTVTLELTNISERPGSAVVQIYVGDVEASIPRPVKELKAFSKIALEPGEKRRLRFILDARTFAFFDTTERRWRIEAGEFAVMAGFSATDIRLSLTVTQKGAVLAL

SEQ ID NO: 3662 - protein, 316 aa, Zea mays
  unsure (1)..(316): unsure at all Xaa locations
MSFHYHDHGLXMDAAAAAAAAASSPNPSGFSPGIGGEREKAAIAAHPLYERLLEAHVACLRVATPVDQLPRIDAQIAARXXPLXAAAGAAAAGGPSGGEELDLFMTHYVLLLCSFKXQLQQHVRVHAMEAVMGCWELEQSLQSLTGASPGEGTGGTMSDDEDNQVDSEANMFDGNDGSDGMGFGPLILTEGERSLVERVRKELKNELKQGYKEKLVDIREEIMRKRRAGKLPGDTASVLKAWWQAHSKWPYPTEDDKARLVQETGLQLKQINNWFINQRKRNWHSNPTSSAEKTKKKKKKXXXXXPDGGPGTQFAL

SEQ ID NO: 3663 - protein, 489 aa, Escherichia coli K12
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 3664 - protein, 128 aa, Yersinia pestis
ADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEA

SEQ ID NO: 3665 - protein, 195 aa, Zea mays
  unsure (1)..(195): unsure at all Xaa locations
MTAKGGATPSPGGAGPAAGNGRLFTVGLVTAWYPSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYVMTVKRESWVTYLTLVPVVTGXHLFGFIMCIGATAARALKTVLQGILLSSDGEKLNSMN

SEQ ID NO: 3666 - protein, 527 aa, Agrobacterium tumefaciens str. C58 (U. Washington)
MDGTHLFELVIAMFLAIIVLHYIAHRLGLPPSVALLAGGGTLAFVPGLPTISVNPELVLVIFLPPLLLDGAWSISVDRLKRHVFGIASLAIGAVLFTTVIVAVVVHFLMPSLPWAACAALGAIVSPPDAVSARAVLERIRIPRRLQILLEGESLLNDASGLVLFRFAVAAAAGGVFSTVDALGEFFFLAVGGAAVGAFVGLLWVKTVRHLGDEYLMIAATAVLSWAAYILAEQAQTSGVIATVTAGLIASWHQHTVLSAATRMRGTSFWNVLVFLMEAMVFILIGLSLRDVVERGGGFGSIASSMALPALAVLVTLVAARFVWIFASDLVIRLFHGLKLAHSKPLGPGAVTALGWAGMRGVVTLALALSLPEDFPGRDFILVMAFAVIMGTVLIQGTTLGRIIAWAGLGGIEPERAPMTMSEAEASMAQVQFTTVQGLAYDENGELIHPQLLKRYEHRLAASVKYAESTEKYSPLLHAHFDVVLKAVAAGRKELIRLRREGQIDDETLRELEHDLDLEELTAISAKA

SEQ ID NO: 3667 - protein, 385 aa, Pseudomonas fluorescens PfO-1
MPYGPSTNARLILAHSYTDTAHSPRKPGTYNASENSPMVHSPVTPSITATQRILKAVRMLFAISALASTLAAQATSRTEPKPDWSTQDMPSQNGRIVLVTGGTSGMGYEDALALTRAGAEVIIAARNAERGREAIANIRQAVPEARVQFETLDLANLQSVRDLANRLQGRLPRLDVLINNAAIMSPPVRGVSADGYEMQLATNYLGHFALTGLLMPLLRKSDDGRVVSLSSIAAGRAVLNFDDLQAERAYDPFTTYSQSKLAVLKWSIELQQRSDAAGWGIRSIAAHPGVAVTELIARGPGLDSEFGKQWAVERDMYHSAAQGALPTLYAATAPEAVGGAYYGPTGDNEKRGPLGFAKMPPAAADRSNSDALWQLSERLTGVTYR

SEQ ID NO: 3668 - protein, 149 aa, Zea mays
  unsure (1)..(149): unsure at all Xaa locations
AHARPPHTRGERAANPPGRPGEPNPRAATEPYKHRPARGSNTRGRTTNAGAPTRNNNGGHTEGTARGKPPREDXRKEKRAQSDRERSPETREQARRASAKGYFEGTHDDAHLTXAADLRAPGGQTPAIERRSTAGHERGSPETKREPRG

SEQ ID NO: 3669 - protein, 513 aa, Nitrobacter hamburgensis
MDIRAQVSMVFHLDKCIGCHTCSIACKNIWTDRKGTEYMYWNNVETKPGTGYPTRWEDQTKYRGGWVVDGTRQKSLRLRLQGKWGTLSNIFYNPYLPTLDDYFEPWTYDYQNLINAPLADEQPTARAISMVTGKYMDTIEAGPNWDDDLGGSQVYANNDPNFDGASDEEMRQINEINSTVFFYLPRICNHCLNPGCVAACPQGAIYKRGEDGVVLVSQERCRAWRMCVSGCPYKKTYFNWSTGKAEKCILCYPRLESGHAPACFHSCVGRIRYIGLVLYDADAIEETAKAPQDQLVMAQRNIIKDPFDPDIIAAARANGIPDSKIEAAQKSPVYQFVKKWGIALPLHPEFRTLPMLFYVPPLGPVLAKVENGVYDNIASESRLGPLMSSLERSRIRLRYMASLLSGGNEDIIRDVYKKLVAVRVYMRSKKVKDIPEEEVQRALAEGKTTAAEVEAVWRLTSLPTFEERFVVPPMERETAVDSLFPQLDPVSRNYPVRKGEVGVGFHTDPARGP

SEQ ID NO: 3670 - protein, 219 aa, Lactobacillus delbrueckii subsp. lactis
GETEFWFAMIKIIAIISLVVTGIIMVAANAKTPVGHASLSNFTGSFSLLPKGKYAFFTAFPMVFFSFAGIEFVTITIGEAKNPKKVIKKAVNETLLRILLFHIATLAVIMCVIPWGKITSGTSPFVQVFKIAGFNAVASVFNFVVLTAAASSLNSGIFSAGRHFFQLAEEAPKDSFLKKHFAKISANGVPAAGIVISVALMLIAPIMSFSSTAIEVFGT

SEQ ID NO: 3671 - protein, 477 aa, Hymenena laciniata
KNERYESGVIPYAKMGYWDPNYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQTMAIWSRKNDMILHLHRAGNSTYSRQKIHGMNFRVICKWMRMAGVDHIHAGTVVGKLEGDPLMIKGFYDTLLLPYLDVNLPLGIFFTQDWASLRKVTPVASGGIHCGQMHQLLDYLGNDVVLQFGGGTIGHPDGIQAGATANRVALESMVIARNEGIDYVTEGPAILRDAAKTCGPLQTALDLWKDITFNYTSTDTPDFVETPTANV

SEQ ID NO: 3672 - protein, 342 aa, Solanum tuberosum
MTRRCSHCSTNGHNSRTCPNRGVKLFGVRLTDGLIRKSASMGNLTHFASGSGGGSTPLNGVVHDSPGDTPDHPAVGGGSADGYASEDFVAGSSSSRERKKGVPWTEEEHRMFLLGLQKLGKGDWRGIARNYVISRTPTQVASHAQKYFIRQSNMSRRKRRSSLFDIVADESGDTPMVSRDFLADDPAQAEMQSNNLLPPTPAVDEECESMGSAASANSIDGEHALPIPESSQYQHPLVYPAYVAPFYPMPYPCWPGYTAEPAIAETHEVLKPIAVHSKSPINVDELVGMSKLSLGESIGDAAKPPSLSLKLVEGSSRQSAFHANPSSGSSGMNSSHNPIHAV

SEQ ID NO: 3673 - protein, 439 aa, Synechocystis sp. PCC 6803
MCCWQSRGLLVKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRAMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 3674 - protein, 84 aa, Oryza rufipogon
ARYVKFHWKPTCGVSCLMDDEATLVGGKNHSHATQDLYDSIAAGNFPEWKLFVQVIDPEEEERFDFDPLDDTKTWPEDEVPLRP

SEQ ID NO: 3675 - protein, 291 aa, Desulfovibrio vulgaris subsp. vulgaris (strain Hildenborough)
MKIAEAIERQSRPFYSLEFFPPKEREQWPAFFATVERLKAMDPVFASVTYGAGGGTQDNTLDITAHLKNALGLEPMAHLTCVGATRERIAGFLARLREQGVENVLALRGDPPRGQQVDWETAEFRYASDLVRFVRNEFPEFGIGVAGYPAAHPESVSFSQDIAHTCQKIHAGADFVVTQLFFDVREYFAFIERLKECGVEKPVLPGILPIQSLESIKRILALCGANIPGKLYLELEEADARGGAEAVREAGIAFAVRQIRSLIDGGAPGIHLYTLNKADMCLQIRDAVGAL

SEQ ID NO: 3676 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYPIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 3677 - protein, 846 aa, Glycine max
  unsure (1)..(846): unsure at all Xaa locations
MAAKVDANGGGGKGGVSAVSAKVPAVAHPLAEKPDEVASNISYHAQFSPHFSPFKFELEQAYYATAESVRDRLIRQWNETYLHFHKVDPKQTYYLSMEFLQGRALTNAIGNLNIQDAYANALRKFGLELEEIAEQEKDAALGNGGLGRLASCFLDSMATLNLPSWGYGXRYRYGLFKQKITREGQEEVAEDWLEKFSPWEVVRHDILYPIRFFGHVEVNPDGSRKWVGGEVVQALAYDVPIPGYQTKNTISLRLWEAKASAEDFNLFLFNDGQHDAASVLHSRAQQICAVLYPGDTTEGGKLLRLKQQFFLCSASLQDIISRFKERRQGPWNWSEFPTKVAVQLNDTHPTLAIPELMRLLMDDEGLGWDEAWDVTSKTIAYTNHTVLPEALEKWSQPVMWKLLPRHMEIIQEIDKRFTAMINTTRLDLENELSAMRILDDNPQKPVVRMANLCVVSSHAVNGVAQLHSDILKSELFANYVSIWPTKFQNKTNGITPRRWLQFCNPELGGIITKWLKTDKWVTNLDLLTGLRQFADNEDLQAEWLSAKMASKQRLARYVLQVTGESIDPDTLFDIQVKRIHEYKRQLLNILGVIYRYKKLKEMSLEERKNTTPRTVMIGGKAFATYTNAIRIVRLVNDVGAVVNSDPEVNGYLKVVFVPNYNVSVAEVLIPGSELSQHISTAGMEASGTSNMKFALNGCLIIGTLDGANVEIREEIGEDNFFLFGATAEDVPRLRKERENGLFKPDPRFEEAKKFIRSGVFGSYDYNPLLESLEGNSGYGRGDYFLVGHDFPSYMDTQAKVDEAYRDRKRWLKMSILSTAGSGKFSSDRTIAQYAKEIWNIEECRVP

SEQ ID NO: 3678 - protein, 178 aa, Flaveria pringlei
MASISSTVATVSRAAPAQANMVAPFTGLKSNVAFPATKKANDFSTLPSNGGRVQCMKVWPPLGKKRYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPEGF

SEQ ID NO: 3679 - protein, 454 aa, Vibrio vulnificus CMCP6
MTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYSEFCQKLVAKVSALKVGNGFDQGVHIGPLINDAAVAKVVQHVEDAQSKGAQIECGQLPTAGSRLVQPLVLSGVTDEMLVAQEETFGPMAPLFVFDSEEEVLARANNTDFGLAAYFYTQSLSRAWRMSEALEAGIVGINEGLISTTVAPFGGVKESGLGREGSFLGMDDYMESKYILMGL

SEQ ID NO: 3680 - protein, 377 aa, Zea mays
  unsure (1)..(377): unsure at all Xaa locations
MRRVALLLVAAVCALAPAAAVVTDGLLPNGNFEDGPPKSALVNGTVVSGANAIPRWETSGFVEYIESGHKQGDMLLVVPQGAHAVRLGNEASIRQRLAVARGAYYAVTFSAARTCAQAERLNVSVSPEWGVLPMQTIYGSNGWDSYAWAFKAKMDAVTLVIHNPGVEEDPACGPLIDGVAIRALYPXRSPGGRGETLLKNGGFEEGPYFLPGASWGVLVPPNIEDDHSPLPAWMIVSSKAVKYVDSAHFAVPQGARAVELVGGRESALVQEVRTVPGWTYRLAFAVGDSGDGCAGSMAAEAYXARATVKVPYESRGTGGYKRAVLDFTAIANRTRVVFQSTFYHMKPDGTLCGPLVDDASLVGLRKKKPARRLMQLL

SEQ ID NO: 3681 - protein, 415 aa, Polysiphonia strictissima
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIASTGEVKGHYMNITAATMEEMYERAEFGKQIGTVIVMIDLVIGYTAIQTMAVWARKNDMILHLHRAGNSTYSRQKIHGMNFRVICKWMRMAGVDHIHAGTVVGKLEGDPLMIKGSYDTLLQPYLDINLPQGIFFQQDWASLRKVAPVASGGIHCGQMHQLLDYLGNDVVLQFGGGTIGHPDGIQAGATANRVALESMVIARNEGRDYVTEGPQILRDAAKTCGPLQTALDLWKDITF

SEQ ID NO: 3682 - protein, 302 aa, Aspergillus fumigatus
KRSFILRSADMYFKYTAAALAAVLPLCSAQTWSKCNPLEKTCPPNKGLAASTYTADFTSASALDQWEVTAGKVPVGPQGAEFTVAKQGDAPTIDTDFYFFFGKAEVVMKAAPGTGVVSSIVLESDDLDEVDWEVLGGDTTQVQTNYFGKGDTTTYDRGTYVPVATPQETFHTYTIDWTKDAVTWSIDGAVVRTLTYNDAKGGTRFPQTPMRLRLGSWAGGDPSNPKGTIEWAGGLTDYSAGPYTMYVKSVRIENANPAESYTYSDNSGSWQSIKFDGSVDISSSSSVTSSTTSTASSASSTS

SEQ ID NO: 3683 - protein, 419 aa, Neisseria flavescens
FTIPTRIVLDDPEEWFENGQAFDGSSIGGWKGIQASDMQLRPDASTAFVDPFYDDTTVVFTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 3684 - protein, 519 aa, Helicobacter pylori 26695
MLLIVFFKFYFQYSIKKKSFYFIFVIIQAIFIFNLRRCRMDNQKITHQNITQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFADIPIHYWVILCIALVFLLNFFSVKIFAEGEFFFSLIKVLAVIAFIGIGAIGIIYQIYSHGFGSIFDNFHFGDKGFFPNGSAAVFSAMLAVIFAFTGTEVIGVAVGETKNASEVMPKAIKATLWRIVFFFLGSVFVISVFLPMNDSSITQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSVSQYSFRKQYLKAGHSLEDLPYKAPFLPFLQLIGITGCAIGVIGSAMDKDQRIGMILTIVFAVICYIGYYFTQKANENNKKDLI

SEQ ID NO: 3685 - protein, 253 aa, Zea mays
  unsure (1)..(253): unsure at all Xaa locations
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAAQXDVDGFLVGGASLKPEFIDIINAATVKSA

SEQ ID NO: 3686 - protein, 568 aa, Novosphingobium aromaticivorans
MTLKYVIFLSRMDNNGEGGVLSLMALAQRATGGGWVAVTLLGATGAALFYGDAIITPALSVLSAAEGLKTIPGLDGMSQTAIIGVTVGILAALFMFQSRGTASVATLFGPVCLVWFVALAGLGLWHIADAPEVLTAFNPLHAVTFLVSHGVTGLFVLGAVFLTVTGAEALIADMGHFGRRPIQLGWLSFVWPALTLNYLGQGALALKALAAAEAIGQPLANADWFFIMAPDVLRAPLVILATLATIIASQAVITGAYSLTHQAISLGLLPRLTIRQTSEHQMGQIYMPGVNWLLLGGVLLLVLGFKSSSAMAAAYGIAVTGTMVVTTCMAFLIAWKYWNWEPVWTALLIAPFLALDLFFFGANILRVSEGGWVPLLVAGLVGLVIFTWLKGRRTALARASEQGVSLNETVMALHARPPTRIEGTAVFLTQDLDVTPSALLHNLKHNKALHRNNIVLKVEIQARPYVAPEQRVVVDRIDESFLKARLRYGYMDTIDVPSDLARADGLLVGPGGTSFFVGRSAIRFAARPVLPRWMTVVYMFLHRNAADPTAYFSIPSNRVVELGSQIEL

SEQ ID NO: 3687 - protein, 210 aa, Salmonella enterica subsp. enterica serovar Typhi Ty2
MILHPSLASADPLRYAEALTALHDAPLGSLHLDIEDTSFINNITFGMKTIQAVAQYSRHPLSFHLMVSSPQRWLPWLAAIRPGWIFIHAESVQNPSEILADIRAIGAKAGLALNPATPLLPYRYLALQLDALMIMTSEPDGRGQQFIAAMCEKVSQSREHFPAAECWADGGITLRAARLLAAAGAQHLVIGRALFTTANYDVTLSQFTAL

SEQ ID NO: 3688 - protein, 481 aa, Hypoglossum hypoglossoides
GTAIKNERYESGVIPYAKMGYWDPNYVIKETDVLALFRVTPQPGVDPVEASAAVAGESSTATWTVVWTDLLTACDLYRAKAYKVDAVPNTSDQFFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQSMGIWARKNDMILHLHRAGNSTYSRQKIHGMNFRVICKWMRMAGVDHIHAGTVVGKLEGDPLMIKGFYDTLLLPHLDINLPLGIFFQQDWAALRKVTPVASGGIHCGQMHQLLDYLGEDVVLQFGGGTIGHPDGIQAGATANRVALESMVIARNEGRDYVAEGPQILRDAAKTCGPLQTALDLWKDITFNYTSTDTADFVASPTANV

SEQ ID NO: 3689 - protein, 697 aa, ASPERGILLUS NIDULANS FGSC A4
MMPLRPSKSALRTLHYQRYIASGRRAFASAVSTPHRFSTQKRDQSTATATASTSRPRPSPAFNQEPSRNEVSPLQNRQLPELDDSYGILILFVQIFVGLSGGEIFHEMMLRLGVKHVFGYPGGAILPVFDAIYNSKHFDFILPRHEQGAGHMAEGYARASGKPGVVLVTSGPGATNVITPMQDAFSDGTPMVVFCGQVVTTSIGTDSFQEADVVGISRACTKWNVMVKSVAELPRRIQEAFEIATSGRPGPVLVDLPKDITAGILRKPIPMQSTLPSRPSAATLAAKELSEKQLHSTINRVARLVNVAKKPVLYVGQGILENPDGPKLLKELADKACIPVTTTLQGLGGFDELDPKSLHMLGMHGSAYANLAMQEADLIIALGARFDDRVTGSIAKFAPQAKLAASENRGGIVHFEIMPKNINKVVQANEAVEGDCAENIRHLLPLVEPVSERPEWFAQINDWKTRFPLSLYEKQTPDGPIKPQALIEKLSDLTAHMKDRTIITTGVGQHQMWAAQHFRWRRPRSMITSGGLGTMGYGLPAAIGAKVARPDCLVIDIDGDASFNMTLTELTTAAQFNIGIKVLLLNNEEQGMVTQWQNLFYEDRYSHTHQKNPDFVRLAEAMGVAAERCTKPSEVESKLKWLIESDGPALLEVFTDRKVPVLPMVPGGSGLHEFLVFDEAKDRERRALMKKRNPNGV

SEQ ID NO: 3690 - protein, 373 aa, Oryza sativa
MRRVTVLVLLLACAAARAAAAVVTDGLLPNGNFEEGPPKSDLVNGTVVRGANAIPRWETSGFVEYIESGHKQGDMLLVVPQGAHAVRLGNEASIRQRLAVTRGAYYAVTFSAARTCAQAEQLNVSVSPEWGVLPMQTIYGSNGWDSYAWAFKAKMDEVALVIHNPGVEEDPACGPLIDGVAIRALYPPTLAKGNMLKNGGFEEGPYFLPNASWGVLVPPNIEDDHSPLPAWMIMSSKAVKYVDAAHFAVPQGARAVELVGGKESALVQEVRTVPGWTYRLSFAVGDARDGCAGSMVAEAYAARASIKVPYESKGTGGYKRAVLEFAAIANRTRVVFQSTFYHTMTDGSLCGPVIDDASLVGLRKKTAGRRLLL

SEQ ID NO: 3691 - protein, 488 aa, Vaucheria litorea
MSKSVQERTRIKSQRYESGVIPYAKMGYWDAFYNVKHTDVLALFRITPQPGVDPVEAAAAVAGESSTATWTVVWTDLLTACDIYRAKAYRVDPVPGTTDQYFAYISYQIELFEEGSLANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCMEGVNRAVAASGEVKGSYLNTTAGTMEEMYERAEYAKSIGSIIVMIDLVIGYTAIQSMSIWARKADMILHLHRAGNSTYARQKNHGINFRVICKWMRMAGVDHIHAGTVVGKLEGDPLMVKGFYNTLLLTKLEINLSQGVFFEMDWAALRKTVPVASGGIHCGQLHQLLYYLGDDVVLQFGGGTIGHPDGIQAGATANRVALEAMVLARNEGRDYMNEGPQILRDAAKTCGPLKTALDLWKDITFDYTSTDTPDFVETATQSR

SEQ ID NO: 3692 - protein, 135 aa, Zea mays
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQL

SEQ ID NO: 3693 - protein, 124 aa, Thermosynechococcus elongatus BP-1
MGKAERTALDNKLSQRFIHLDPAGYFIIYIDPEQQLIWMKHYPNDINEKGLAVDPDTGEPIPTKGKVTREPDLVLSGRTAKELCIELFEKDRQLVTMFDHAAYLGRELMRAQFCLDEGIEYIQD

SEQ ID NO: 3694 - protein, 156 aa, Zea mays
  unsure (1)..(156): unsure at all Xaa locations
ITMDPTKFRPSSSHDTTVTTTNAAAPVCNDNEELTVAYRGPILLEDYHLIEKVEHFARERIPERVVHARGGLRQGLLRVHHDATSLTCADFLRAPGGRTPGDPRFSTVNHETAAPAKRSRDPRRITPXKFYTPRRANWEPCLGXNFPPFFLHSGQR

SEQ ID NO: 3695 - protein, 132 aa, Arabidopsis lyrata subsp. lyrata
AVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPS

SEQ ID NO: 3696 - protein, 485 aa, Bacteroides thetaiotaomicron VPI-5482
MDKTYKRHSFTKLWIATAMFIFCCFATSAFAQEAVDADTFMTTTETITEVKTTPEIAETATASAETTPDTIGELALGLNTVWMLLAAMLVFFMQPGFALVEAGFTRVKNTANILMKNFVDFMFGSLLYWFIGFGLMFGAGGLIGMPHFFDLSFLDSDLPREGFLVFQTVFCATAATIVSGAMAERTKFSMYLVYTIFISVLIYPISGHWTWGGGWLMNGEEGSFMMNLFGTTFHDFAGSTIVHSVGGWIALVGAAILGPRIGKYGKDGKSRAIPGHNLTVAALGVFILWFGWFGFNPGSQLAASTEADAMAISHVFLTTNLAACAGGFFALAMSWMKYGKPSLSLTLNGVLAGLVGITAGCDAVAPSGAVLIGAICGVVMIFAVDFIDKVLKIDDPVGASSVHGVCGFLGTVLTGLFSTSEGLFYGHGAGFLGAQLFGAVVVGVWAAGMGFIIFKVLDKIHGLRVPARVEEEGLDIYEHGESAYN

SEQ ID NO: 3697 - protein, 180 aa, Pisum sativum
MASMISSSAVTTVSRASRGQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 3698 - protein, 291 aa, Legionella pneumophila
MKGIILAGGFGTRLYPLTKSISKHMIPVYDKPMIYYAISTLMLANIREILIISTEEHLPLYQNLLSDGSQWGISFAYLVQNEPRGIAEAFILGEKFIGNDSVCLVLGDNIHQGRGFSELLQNAKSKLNGATVFAYYVDKPQAYGVVEFNEKQQVLSIVEKPAQPKSNYAVTGLYFYDNQVIEIAKSLKPSGRGELEITDINQFYLYENKLDVQILGRGFVWLDMGTPETLLSASNYICTIEQRQGLKIGCPEEIAWRMKFISDDELLCRARELNKSSYGQYLAELLNHKRY

SEQ ID NO: 3699 - protein, 471 aa, Xanthomonas axonopodis pv. citri str. 306
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVGLPQALIAGPHAGGIVNLPAVAITFLVAGLLMAGTKESATLNAVLVVLKIIALGVFVAIALPAFNSANLQPFMPYGFSKAMGPDGIERGVMAAAAIIFFAFYGFDAISTAAEETKNPGRDLSIGIVGSMIGCTLIYVLVALAAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPGRARAFRTPLAWVVGPVAIGGCLYLFWSLPSKTQGWFLLWNALGVVVYLAYGRRNSRLNQAG

SEQ ID NO: 3700 - protein, 406 aa, Spyridia filamentosa
  unsure (1)..(406): unsure at all Xaa locations
ETDVLALFRVTPQPGVDPVEASAAVAGESSTATWTVVWTDLLTACDLYRAKAYRVDEVPNSSEQYFAYIAYDIDLFEEGSIANLTASIIGNVFGFKAVKALRLEDMRIPYAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTASTMEDMYERAEFAKDLGTVIIMIDLVIGYTAIQTMGIWARKNDMILHLHRAGNSTYSRQKNHGMNFRVICKWMRMAGVDHIHAGTVVGKLEGDPKMIQGFYRTLLEPFLEVDLPQGLFFEQDXASLRKVTPVASGGIHCGQMHQLIQYLGNDVVLQFGGGTIGHPDGIQAGATANRVALESMIIARNEGRDYIN

SEQ ID NO: 3701 - protein, 443 aa, Glycine max
  unsure (1)..(443): unsure at all Xaa locations
MRGVRGRVHYNLKKSVLVTPSDNWLRCDDSLVMQFLEIKNGYNYFRYVHSLSYSQSQRAFEAAKAINDINGIASILQHRPYHIDSLLTMAEYFAVLGEQQMSADAIARCLYALECAWHPMFNPLQGNCRLKFKHDTNKPIFTALFTHMKNLDRRGCHRSALEVCKLLLSLDSDDPMGAIFCIDYFALRAEEYAWLEKFSEEYKSDNSIWGGSRLLLEVCHLFRLTDTDDAFGADFFDDXKASWACRMKKALXLYPSVRRGLVASVPLPVPSWTVLLMHAFFWSDQTGIPSQDHLINIYVERNYLIWRLPDLQKLLSGAAKLVIETLESNKSELKDWACVRKEAFSSEKNEYGHLLVSEFSDSLSSIPRENLQQFMGVPRMMEGMQDENQFANLPGNGHAPRGVANRNALAVLFESMLPWVTYEDGVDGEPDDNQHDDHRQDNQ

SEQ ID NO: 3702 - protein, 346 aa, Bacteroides thetaiotaomicron VPI-5482
MKTLQELTRPNIWKLKPYSSARDEYKGAVASVFLDANENPYNLPHNRYPDPMQWELKTLLSKIKKVSPQHIFLGNGSDEAIDLVFRAFCEPEKDNVVAIDPTYGMYQVCADVNNVEYRKVLLDENFQFSAEKLLAATDERTKLIFLCSPNNPTGNDLLRSEIEKILREFEGLVILDEAYNDFSEAPSFLEELDKYPNLVVFQTFSKAWGCAAIRLGMAFASEAIIGILSKIKYPYNVNQLTQQQAIAMLHKYYEIERWIKTLKEERDYLEEEFAKLSCTVRMYPSDSNFFLAKVTDAVKIYNYLVGEGIIVRNRHSISLCCNCLRVTVGTRVENNTLLAALKKYQG

SEQ ID NO: 3703 - protein, 65 aa, Zea mays
  unsure (1)..(65): unsure at all Xaa locations
MAVTITWVKARQIFXGRGNPTVKVDVGPNDGSYARGAVPSGASTGIYEALELRDGGSDYLGKGVL

SEQ ID NO: 3704 - protein, 479 aa, Methanosarcina acetivorans C2A
MVAMKMQINGKAVEACGGEVFGIKNPATGELIEQVPRGTEEDVAVAVEAASSAFTGWASASPQQRGEVLYRAAEIVRQRKDELASLLTQEQGKPIVEARNEIEGFAHVLEYYCGLSGSQRGDFIPVPGNGYAFTVKKPLGVCAAIIPWNMPALIMGWKIAPVLISGNTLVLKPASNTPLTNLTLASIFVEAGLPAGVLNVVTGPGETVGESLVRSPEVRKISFTGEARTGKRVAELAACGMKRITLELGGSDPMLVCDDADLESAAAGALRGRFYNCGQTCTAVKRLYVFESVAEEFIKKLETGIKSLRLGNGMDKNISMGPLNNRTQWEYIKELAAEIEEKDAGRIITGGKVPEFKDSEKGYFFEPTLVSDVPGDSRLLKEEVFGPLLPVVTVKNLDEAIVGANSTCYGLGASIWTKNIDRARKGCEQLNAGIIWINQHLKVAPEVPFGGVKESGFGRENGPESLSEYLETKTIMLKI

SEQ ID NO: 3705 - protein, 434 aa, Lycopersicon esculentum
MAITDENKHPLIKESSVRVKDRAEMATRKVVGVETRSNRRVLGAINQNLVGGQGYPCVVNKRGLSDGNGFCDKNLPVHGHRPITRKYAAQIASSQKHSSEENKKPKIAAESFSVWEDDMEAANDKPVPMSLEQTEKVSKGKDQMTYIQEVEMEDIFEEAVIDIDGDDAKNHLAAVEYVGDLFANYRTMEVNSCASPYYMAQQADINERMRSILIDWLIEVHHKFELREETLFLTVNLIDRFLEKQGIVRKKLQLVGLVAMLLACKYEEVCAPLVEDLVLISDKAYTRKEVLEMESMMLNTLQFNMSVPTAYVFMRRYLKAAQCDRKLELLSFMLVELCLVEYEMLKFPPSFIAAAAIYTAQTTLYGVQQWSKTCEVHTTYSEDQLLECSRSIVGYHQKAATGKLTGVHRKYSISKFGYAAKCEPAHFLVQQTQE

SEQ ID NO: 3706 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 3707 - protein, 295 aa, Oceanobacillus iheyensis HTE831
MERKLGTDRVKRGMAQMQKGGVIMDVVNSEQAKIAEQAGAVAVMALERVPSDIRAAGGVARMANPSLVEEIIQSVSIPVMAKARIGHIVEARVLESLGVDYIDESEVLTPADEVFHLNKSDYTVPFVCGCRDLGEAARRIGEGAAMLRTKGEPGTGNIVEAVRHIREVQAQVNKVVHMSKDELMTEAKNLGAPYEILLQIKENGRLPVVNFAAGGVATPADAALMMELGADGVFVGSGIFKSHHPEKFARAIVQATTYFDDYERIAEVSKDLGEAMTGIDVHSLAADQRMQERGW

SEQ ID NO: 3708 - protein, 145 aa, Glycine max
  unsure (1)..(145): unsure at all Xaa locations
MNSTEEGMQGIGIGIGCFQNDVVGQLEXSPTMSNSSSSLSMELDESPESRIQRLISEHPVIIFTRSSCCMCHVMKKLLATIGVHPTVIELDDHEIASLPLPDTTAPAAFIGGTCIGGLESLVALHVSGHLIPKLVQVGALWNLCE

SEQ ID NO: 3709 - protein, 364 aa, Glycine max
  unsure (1)..(364): unsure at all Xaa locations
FPRVRAHASDDHEREEKEEEEEEEEEEGEVGGVRVESVEEENAAAIAEIVGDFSGFSTSNEDDSSSTSTGPRSNNISPNGRIKRVITAGNWQKGELLGRGSFGSVYEGISEDGFFFAVKEVSLLDQGNQGRQSVYQLEQEIALLSQFEHENIVQYIGTEMDASNLYIFIEXVTKGSLXNLYQRYNLRDSQVSAYTRQXILHGLKYLHDPNSVHRDIKCANILVDANGSVKLADFGLAKATKLNDVKSCKGTAFWMAPEVVKGKSRGYGLPADIWSLGCTVLEMLTGEFPYSHLECMQALLRIGRGEPPPVPDSLSRDAQDFIMQCLKVNPDERPGAAQLLNHTFVQRPLHSQSSGSTSPYIRRG

SEQ ID NO: 3710 - protein, 160 aa, Magnetospirillum magnetotacticum
MVAPPILSLRFSETGRTRFTVHVEPGPHIHRSLQTIRALGRRAGVALNPGTPASAIEPLLDMVDLVLVMTVNPGFGGQSFIHSALETVSRVKALVGGRNIDISVDGGITPETAGPAAQAGANILVAGSAAFKGGPAAYQKNIAAIREAAGAATGRDGVRC

SEQ ID NO: 3711 - protein, 375 aa, Torenia fournieri
MVSPASPSPARVELLSNSGIKAIPKEYVRTEEELRSITDIFSKEDGAKNIDSPDLPIIDLSKIDSSDEETRKKGHEELKEAAIEWGVMHLINHGISDELINRVKKAGGEFFDLPVEEKEKYANDQSSGNVQGYGSKLANNAGGILEWEDYFFHCVYPEEKRDMAIWPKDPQDYIPATTEYAKEIRSLTTKILSVLSLGLGLDQDRLEKEVGGKDDLTLQMKINYYPKCPQPELALGVEAHTDVSALTFILHNMVPGLQVLYKGEWVTASCVPDSIILHVGDTIEILSNGMYKSVLHRGLVNRERVRVSWAVFCEPPKEKIVLKPLPETVGEDRPALFPPRTFAQHMKHKLFKKSDDEVHDEEGVVVVEHDDKSVE

SEQ ID NO: 3712 - protein, 168 aa, Avena clauda
VMASSATTVAPFQGLKSTAGLPVSRRSSASLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 3713 - protein, 469 aa, Staphylococcus aureus subsp. aureus Mu50
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNKTNSHGVPYLSMLVSSIALLIAALLNYIFPNAIQLFIYVTTLSTVLFLVVWAMIIVAYLMYLKKHPEAHKNSKFKLIGGKPIAYIILAFFFFVFILLFFSDETRAAIYISPFWFIFLFFFYKKYKTNAEKLAYEQRQNDSGHFRYDNQ

SEQ ID NO: 3714 - protein, 394 aa, Zea mays subsp. mays
LGAERRARLPPGEMGWPLVGGMWDFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRPMAINLPGIAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 3715 - protein, 405 aa, Oryza sativa (japonica cultivar-group)
MASNSSAAAAAAFFGISRDGDQHDQIKPLISHQQHQHQQQQLAASLTGVATAAPTAASSQGAPPAAPPAKKKRNLPADPDAEVIALSPKTLLATNRFVCEVCNKGFQREQNLQLHRRGHNLPWKLKQKNPAQAQRRRVYLCPEPTCVHHDPARALGDLTGIKKHFCRKHGEKKWKCDKCSKRYAVQSDWKAHSKICGTREYRCDCGTLFSRRDSFITHRAFCDALAQESSRLPPTSLSSLTSHLYGASNAGNMALSLSQVGSHLTTSLQDGGGHHHHPSPELLRLGGAGGGGGAGGGSSIAARLDHLLSPSGASAFRPPQPAFFLNAAAAAAATGQDFGDDAGNGQHSFLQAKPFHGLMQLPDLQGMAPGAPARRDLTSSTSASSPTTATARGLAMSMPARADEQ

SEQ ID NO: 3716 - protein, 206 aa, Oryza sativa (japonica cultivar-group)
MRVPAAVTGGCGCGVDGGGGCCRGGGKLADWEEGKDDEMKSVVVKGWTRMAQVVPLHDNASAEDDDDDEEDDDEDDDDDDDEDDEEEAAPPYVMAVDDSSVDRAVITALLRRSKYRDSGKRALEILGSEPNVSMIITDYWMPEMTGYDLLKKIKESSELKQIPVVIMSSENVPTRISRCLEEGAEDFLLKPVRPADISRITSRMLQ

SEQ ID NO: 3717 - protein, 493 aa, Nicotiana tabacum
MRHANIKHGSFHLEEHNMRITRARARVSGSSGRLPPLHPSTKQDKKQALGAESKRSKRSASDENRPGTSSIATGVQPKRRAVLKDMKNVLHENSHMNCINGSKIQVKKGSDKRNNKAKPAVSLKLSQLQEKGKEDIADKVKKVKVEGSQEISSGANCKEDMLPQLSRDVTPAQCGLVHLVPVNRSSCKAFPLQNVMKKDESKVCQKQEGFANLGIADIDSRHKDPLMCSLYAPDIYNNLHAIEFDRSPSVDYLEKLQLDINKGMRGILIDWLVEVSEEYRLVPDTLYLTVNLIDRFLSENYIEKQKLQLLGVTCMLIASKFEEICAPRVEEFCFITDNTYSKEEVIKMESRVLNLLSFQLASPTTKKFLRRFIQAAQASYKVPSVELEFMANYLAELTLVDYGFLKFLPSLTAASAVFLARWTLDQSNHPWNPTLEHYTRYKVSELRTTVFALQELQMNTSGCTLNAIREKYRQPKFKSVATLAASKPVQSLF

SEQ ID NO: 3718 - protein, 486 aa, Gigartina sp. 2
  unsure (1)..(486): unsure at all Xaa locations
NSVEERTRIKNERYESGVIPYAKMGYWDPDYVVKDTDVLALFRVSPQPGVDPVEASAAVAGESSTATWTVVWTDLLTACDLYRAKAYKVDTVPNTTDQYFAYIAYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEAVNRSIAASGETKGHYLNVTAATMEEMYERAEFAKQLGSIIIMIDLVIGYTAIQTMAVWSRKNDMILHLHRAGNSTYSRQKIHGMNFRVICXWMRMAGVDHIPAGTVVGKLEGDPLMIKGFYNTLLLPYLEVNLPQGIFFEQDWASLRKVTPVASGGIHCGQMHQLLDYLGNDVVLQFGGGTIGHPDGIQAGATANRVALESMVIARNEGRDYVTEGPQILQDAAKTCGPLQTALDLWKDITFNYTSTDTADFVETPTANV

SEQ ID NO: 3719 - protein, 370 aa, GIBBERELLA ZEAE PH-1
MAEFVRAQIFGTTFEITSSPPFIAILTRLARRYSDLQPVGMGAFGLVCSARDQLTNQNVAVKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLSPYHDPTDEPVAEEKFDWSFNDADLPVDTWKIMMYSEILDYHNVEAGVTNMEEQFNGQ

SEQ ID NO: 3720 - protein, 661 aa, Glycine max
  unsure (1)..(661): unsure at all Xaa locations
MHGRPRKALKQEDEAASAAKAEKLRSLQAQFLANHHNHIYSKEALDVSAKLLEVNPECYTAWNYRKLAVQHLLSNSDSDPHSIFDDELKLVEIALRKNFKSYGAWHHRKWVLSKGHSSIDNEMRLLNGFQKMDPRNFHAWNYRRFVXELMKRSDEDELKYTEEVIATNFSNYSAWHNRSVLLSNLLKRKAEGYFPKEKVLEEEFEHVHNAIFTDPDDQSGWFYHLWLIQQTVKIDAPLLVSSWPSHGSNITLIGDNDLRGCGLSLLNGTLSNPGTLPIILYFNQAVEGINSSTVAIKSELLKEELVWKPLSMNNSNTAQNLFVYLNLANLELQLSKTYSVEINIGHSKGIISSNGNHYGDPSQISFKVFVQTSYTELTEGQGGKRTTWMDTNLQKIDHFQESDSIVTADQNHHIPTTSNRCAEEIGEEITKVRDLLSEYDCKIGRLTLARLLTALDMLSSQHDGRKSNTEEVLQLYTDLMKLDPTHYIYYKDECSLISLKRITSTRDSLIPYCHYYKDATETVSGNVCLRLQNLSLSRIGSIQNLLWVQMLDLSHNELRPIEGLDAMQLLSCLNLSHNKFXSFTALGPLRLLKSLKVLNNSYNELGSHSIDTTRYLSSSPVAHTEEFAKDRFEILTGSFSATKFWGVARCTQQYCWCTQHS

SEQ ID NO: 3721 - protein, 66 aa, Zea mays
  unsure (1)..(66): unsure at all Xaa locations
MSLIMQDKFHSFHSVATILSYLTKAPLVPPGTPVVNALAKXRAMLENIMRACVGLAPENNMILEYK

SEQ ID NO: 3722 - protein, 455 aa, Schizosaccharomyces pombe
MEANFQQAVKKLVNDFEYPTESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELFRRALFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 3723 - protein, 294 aa, Salmonella typhimurium LT2
MHPRFQTAFAQLADNLQSALAPILADHHFPAMLTAEQVSTLKNTAGLDEDALAFALLPLAAACARTDLSHFNVGAIARGVSGNWYFGANMEFLGATMQQTVHAEQSAISHAWLRGEKGLAAVTVNYTPCGHCRQFMNELNSGLDLRIHLPGRAPHTLRDYLPDAFGPKDLEIKTLLMDEQDHGFTLTGDTLTQAAITAANKSHMPYSHSPSGVALECKDGRIFTGSYAENAAFNPTLPPLQGALNLLSLNGYDYADIQRAILAEKGDAALIQWDATAATLKALGCHNIDRVLLG

SEQ ID NO: 3724 - protein, 301 aa, Agrobacterium tumefaciens str. C58
MTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 3725 - protein, 512 aa, Torenia hybrida
MSPLALMILSTLLGFLLYHSLRLLLFSGQGRRLLPPGPRPWPLVGNLPHLGPKPHASMAELARAYGPLMHLKMGFVHVVVASSASAAEQCLRVHDANFLSRPPNSGAKHVAYNYEDLVFRPYGPKWRLLRKICAQHIFSVKAMDDFRRVREEEVAILSRALAGKRAVPIGQMLNVCATNALSRVMMGRRVVGHADGTNDAKAEEFKAMVVELMVLSGVFNISDFIPFLEPLDLQGVASKMKKLHARFDAFLTEIVRERCHGQINNGGAHQDDLLSTLISFKGLDDGDGSRLTDTEIKALLLNLFAAGTDTTSSTVEWAVAELLRHPKTLAQVRQELDSVVGKNRLVSETDLNQLPYLQAVVKETFRLHPPTPLSLPRLAEDDCEIDGYLIPKGSTLLVNVWAIARDPKVWADPLEFRPERFLTGGEKADVDVKGNDFELIPFGAGRRICAGVGLGIRMVQLLTASLIHAFDLDLANGLLPQNLNMEEAYGLTLQRAEPLLVHPRLRLATHVY

SEQ ID NO: 3726 - protein, 210 aa, Zea mays
NFKGSNLDRRVEGARSHEVAANVEIRILPFSDLANSRDKPLVSARFSRKAAKASPEGSNLAHALLPSSARFKGSRALRVARPRKEETLESTWKAITEGRGPPLARHLKKSDTWDARPGRRPSAGGRSGEVDPAAVAPAGAMRKAETFNDGGGAGRSKTPPAPVRREPSLGQDELNRRVEAFIHKFNMEMRLQRQESLKHYSDMLGRGIRY

SEQ ID NO: 3727 - protein, 563 aa, Saccharomyces cerevisiae
MSEITLGKYLFERLKQVNVNTVFGLPGDFNLSLLDKIYEVEGMRWAGNANELNARYAADGYARIKGMSCIITTFGVGELSALNGIAGSYAEHVGVLHVVGVPSISSQAKQLLLHHTLGNGDFTVFHRMSANISETTAMITDICTAPAEIDRCIRTTYVTQRPVYLGLPANLVDLNVPAKLLQTPIDMSLKPNDAESEKEVIDTILVLAKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDAPQNLVEQAKLTAATNAKQ

SEQ ID NO: 3728 - protein, 463 aa, Pseudomonas putida KT2440
MNTVGSDGNLAQGFKPRHVTMLSIAGIIGAGLFVGSGHAIAAAGPATIISYFVAGTLVVLVMRMLGEMAVAHPDTGSFSTYADQAIGRWAGYTIGWLYWWFWVLVIPIEALAAGHVLNAWFPQVDSWIFALASVLLLAGTNLFSVAKYGEFEFWFAILKVTAILGFIGLGFAALMDWLPNREVSGLSGLMAEYGGFAPKGWSAVVGAFITVMFSFIGTEAVTIAASESSDPSRNIAKATRSVIWRISTFYILSIFVIISVVPWNDPQLAVVGSYQRALEIMNIPNAAFMVDLVVLVAVTSCMNSSIYIASRMMFSLAKRGDAPAFLNKTSKVGVPRAAVFGSTLIGAAIAVLNYFAPKGVFEFLLASSGAIALLVYMVIAISQLRMRRRLERENTELKFRMWLFPYLTWAVIIFIAGALAVMMYTPEHRAEVSSTLGLAIVISFLGIVTSRGHAQPVAARSMG

SEQ ID NO: 3729 - protein, 288 aa, Escherichia coli
IGQALALLLKTQLPSGSELSLYDIAPVTPGVAVDLSHIPTAVKIKGFSGEDATPALEGANVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEKNALEGMLDTL

SEQ ID NO: 3730 - protein, 143 aa, Triticum aestivum
  unsure (1)..(143): unsure at all Xaa locations
MAPTVMXSSATSVAPFQGLKSTAGLPVSRRSNGASLGSVSNGGRIRCMQVWPIEGIKKFETLSYLPPLSTEALLKQVDYLIRSKWVPCLEFXKVGXIFREXXASPGYYDXRXYWTMWKXLPMFXCXPXATQVINEVGGRSKKE

SEQ ID NO: 3731 - protein, 227 aa, Prochlorococcus marinus str. MIT 9313
MSTKPLVIAPSILSADFSRLGEDVQAVDQAGADWIHVDVMDGRFVPNITIGPLIVEALRPVTSKPLDVHLMIVEPERYVGDFAKAGADHIYVQVEACPHLHRNLAQIKDLGKKAGAVLNPSTPLDTLEYCLELCDLVLIMSVNPGFGGQSFIDNQVQKIRELRRICDEQGLDPWIEVDGGIKADNAWKVIEAGANAIVSGSGVFNQPDYAEAIRGIRNSKRPEGVVV

SEQ ID NO: 3732 - protein, 201 aa, Shigella flexneri 2a str. 301
MIRLKRAVSTTVTSRHTLMTATAQQLEYLKNSIKSIQDYPKPGILFRDVTSLLEDPKAYALSIDLLVERYKNAGITKVVGTEARGFLFGAPVALGLGVGFVPVRKPGKLPRETISENYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 3733 - protein, 245 aa, Glycine max
SYVGPPPLGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNALSETGGIPIGIGKNSHIRKAIIDKNARIGENVKIINFDNVQEAVRETEGYFIKSGIVTVIKDALIPSGTII

SEQ ID NO: 3734 - protein, 265 aa, Gossypium herbaceum
TKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNSPTSVSKSSSIKNPSLDFNYNEFQFKSNTDSLEEPNCTASSGMTTDEEQQEQLHKKQQYGPSNGQDINLELSIGIVSADSSRVSSANSAESKPKVDNNNFQFLEQAMVAKAVCLCWQLGFGTSEICRNCQNSNS

SEQ ID NO: 3735 - protein, 223 aa, Chloroflexus aurantiacus
MRLAPSILTADFARLGEQVATACAAGIDWIHLDVMDGRFVPNISFGPLVVRALRPLADQYGALLDAHLMIVEPERYLADFAAAGADLITVHAEATPHVHRAVQMIHNLGKKAGVAINPATPLSMVEELIDQVELILLMTVNPGFGGQTLIPSVLAKVQRLRTLLGDRPVEIMVDGGVNPTTIAACATAGATVAVVGSAVFGPQPIPDAISELRIALGEAVPGK

SEQ ID NO: 3736 - protein, 441 aa, Ferroplasma acidarmanus
MQDEESFIEKLKKDEVEFLQLQFTDISGSVKSLTIPHNRFEDVIYNGVMFDGSSIVGYKQIEDSDMKAVPELSSYTILTNENYAGKTVRFVCKIFNSDGTRFEGDPRYILEKQVEKLTKENKTYYLGPELEYFLFKQDENGEPTIEPSDYGGYFDKEPLDKAFTVKQEIIRKLEGLHYYPEASHHEVAYSQHEIDVKYSDAVTMADRIIMIKSVVKETANEYGYYATFMPKPVKGVNGNGMHVHQSIFSGDENLFYNESNKYGLSDYAMHYLGGILNNVSNASLVLASTVNSYKRLVPGYEAPVYIAWANRNRSALVRIPAAPPKGKRMELRFPDAAGNQYLQFAAILGMGLDGIENKTNPPEAMEKNIFEMDLAERQKNGIKSMPGSLGQAIESFRNSELMKKIFGESVFNNLLRIKENEWNEFRSEVTDWEINKYLDIY

SEQ ID NO: 3737 - protein, 341 aa, Brassica napus
MFRSALVRSSASAKQSLLRRSFSSGSVPERKVAILGAAGGIGQPLALLMKLNPLVSSLSLYDIANTPGVAADVGHINTRSQVVGYMGDDNLAKALEGADLVIIPAGVPRKPGMTRDDLFNINAGIVKNLWSAIAKYCPHALVNMISNPVNSTVPIAAEIFKKAGMYDEKKLFGVTTLDVVRVKTSYAGKANVPVAEVNVPAIVGHAGVTILPLFSQATPQAILSGDALTVTTKRTQDGGTEVEEAKAGKGSATLSMAYAGALFADACLKGLNGVPDVVECSYVQSTITELPFFASKVRLGKNGVEEVLDLGPLSDFEKEGLEALRPGIKSTIEKGVKFANQ

SEQ ID NO: 3738 - protein, 212 aa, Antirrhinum majus
KAHELSVLCDAEVALIIFSNRGKLYEFCSSTSMLNTLERYQKCNYGPPETNVSTREALELSSQQEYLKLKARYEALQRSQRNLLGEDLGPLNSKELESLERQLDMSLKQIRSTRTQAMLDTLTDLQRKEHALNEANRSLKHRLMDGSQISLQWNPNAEDHVGYGRQPSQPSADGFYHPLECEPTLHIGFQSDQITVAGAGPSVNNYISGWLP

SEQ ID NO: 3739 - protein, 581 aa, ASPERGILLUS NIDULANS FGSC A4
MSLARFKHLPRATQGPIKCPYKGAALLGNANYNKGSAHSERERREFNLHGLLPPNIQTLDEQVERAYQQYKSRPDDLAKNTFMASMKSQNQVLYYRLLQTHLKEMFSVIYTPTEADAIQNYSRLFRKPEGCYLSIRDHGEKEIDECFANFSGGDDVDYIVVSDGEQWQILGIGDQGVGAILISVAKLVITTACAGIHPSRQLPVVLDCGTNNEELLNDKLYLGLRQRRAQGEEYDKFVDKFVRMARKRFPNAYIHLCSEDFGLQNAKRILDRYRSQLPCFNDDIQGTGCVTLAALMAGLHVSNVKLKDVRVVCYGSGSAGTGIADQISDAIATEAGFSKSDALKQIWCIDKQGLLLKSQGDALTASQKYFAKEDNEWPEGQDIDLYSVIKHVKPHVLIGTSTKPGSFTEETIREMAKHVDRPIIFPLSNPTRLHEAQPQDITKWTDGKALIATGSPFPPVEYNGTKTEIVSAECNNSTAFPGIGLGAVLSRASRLSEKMVVAASKALAAKAPALEDPNKPLLPDVENVRELSLNVAKAVIQTAVKEGLAQEEGIPEDEKDLEDWIRAQMWEATYRDLEKAD

SEQ ID NO: 3740 - protein, 539 aa, GIBBERELLA ZEAE PH-1
MNSNQLDPRQHPLEAIGAAIGAEEQTELQTRSSNFQGADEGPASVIAKVSGAQSGGKREDGSSDLPNNKGTPRPNPTYSKTVGGLPLVSDTFLLQKQQHFNRSKTLERVVHSCGAGAFGYFECTRDVTELTKANFLSSVGEKTPVFVRFSTATLGREFPDASRNPRGFAIKFYTKEGNYDIVGLNFPVFFCRDPIQGPDVIRSQSRNPSNFLLDHDALFDFLANNPEANHAGIMLFSDHGTPQGWRFSHGYGCHTFKWVNADGEFMYVKYHFIAKHGQKQFADSEAMQMCGEDPDYSKRDLWEAIEKGEDIEWMVHVQIMDPRQADPDTLGFDPFDATKIWPRSEFRMKELGRLVLNKNPENFHRDVEQAVFSPGSMVPGIEDSPDPLLQFRMFLYRDAQYHRVGTNLHQIPVNCPFMAKSYASPFDGPMHVDTDRAGSKQYPLNSFAHKFRPDTDEAPYEVNDNFIKYLAQVYIISVDYAQGIYNLLDEPRFEFSKVKKLGETKFAEAADDWYKEPKFRDKPGSKLVGYPPEIAVYQP

SEQ ID NO: 3741 - protein, 358 aa, Kluyveromyces delphensis
MSEWKVDPDNRRRLLQLQKVGANKRCVDCNAPNPQWASPKFGIFICLECAGTHRSLGVHISFVRSITMDQFKQEELVRMEKGGNEPFIEYMTSHGIDMTLPHKIKYDNPIAEDYKEKLSCEVEDKEFVEPKHPDFDPKALGKTSTPSVATKAGAGSITSNATSRQDTPIESRRTGTPQQKEKNEQYFAQLGQKNQERPDHLPPSQGGKFQGFGNTPVNNSKQANTNTMSLENLQTDPVGTLSRGWGLFSSALQKSFDDVNETYIKPNVQQWNTGELSEETKRAAAQFGQKFQETSTYGVQAFSSFTKQYITGEEDTMSNFNRTSPMPGTANSTNSTDNLLKKEKMRPPKAGEDEWEEF

SEQ ID NO: 3742 - protein, 461 aa, Escherichia coli O157:H7 EDL933
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 3743 - protein, 472 aa, Oceanobacillus iheyensis HTE831
MQSYKMFVGGKWFGNNLEQIDVINPATNEQIGTIPNGGKEEAKQAVDAAHNALKEWSARTAEDRSNYLVKWHELIKEERETIAKIMTEEQGKPLKEAIGEVDYANGFISWYAEEGKRIYGDIIPASHTNKRIFVQKKPVGVVAAITPWNFPAAMITRKVGPALAVGCTVVIKPATQTPLTAFKLVELAEKAGIPRGVINIVTGSSSQIGKVWNDDGRVRKLTFTGSTEVGKILMKDAANTMKKISLELGGHAPFVVMEDADLDKAVAGVIASKFRNAGQTCVCTNRVYVHESIKDIFQDKLTEAVSKLKVGNGLEEGINIGPLIDQSAVDKVDEQVKDAISKGGRVTFGGKSLRGLYVEPTIVVDATDDMLCMYEETFGPLVPVTTFRDEEEVIARANNSPYGLAAYVFTENIGRAIRISEALEYGIVGLNDGAPSTPQAPFGGFKESGLGREGGYYGIEEFLEIKYISLAF

SEQ ID NO: 3744 - protein, 585 aa, Raphanus raphanistrum
  unsure (1)..(585): unsure at all Xaa locations
TFVSRYAPDEPRKGADILVEALERQGVETVFAYPGGASMXIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMXVDDIPRIVQEAFFLATSGRPGPVLVDVPKDIQQQLAIPXWDQPMRLPGYMSRLPQPPEVSQLRQIVRLISESKRPVLYVGGGSLNSSEELGRFVELTGIPVASTLMGLGSYPCNDEXSLQMLGMHGTVYANYSVEHSDXLLAFGVRFDDRVTGKLEAFASRAKIVHIDIDSAEIGKNKTPHVSVCGDVKLALQGMNKILENRAEELKLDFGVWRSELNEQKQKFPLSFKTFGEAIPPQYAIQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQXEDRFYKANRAHTYLGDPARESEIFPNMLQFAGACGIPAARVTKKEELREAIQTMLDTPXPYLLDVICPHQEHVLPMIPSGGTFKDVITEGDGRTKY

SEQ ID NO: 3745 - protein, 308 aa, Shigella flexneri 2a str. 301
MAVAMDNAILENILRQVRPLIGQGKVADYIPALATVDGSRLGIAICTVDGQLFQAGDAQERFSIQSISKVLSLVVAMRHYSEEEIWQRVGKDPSGSPFNSLVQLEMEQGIPRNPFINTGALVVCDMLQGRLSAPRQRMLEVVRGLSGVSDISYDTVVARSEFEHSARNAAIAWLMKSFGNFHHDVTTVLQNYFHYCALKMSCVELARTFVFLANQGKAIHIDEPVVTPMQARQINALMATSGMYQNAGEFAWRVGLPAKSGVGGGIVAIVPHEMAIAVWSPELDDAGNSLAGIAVLEQLTKQLGRSVY

SEQ ID NO: 3746 - protein, 676 aa, Shigella flexneri 2a str. 301
MKLAACFLTLLPGFAVAASWTSPGFPAFSEQGTGTFVSHAQLPKGTRPLTLNFDQQCWQPADAIKLNQMLSLQPCSNTPPQWRLFRDGKYTLQIDTRSGTPTLMISIQNAAEPVANLVRECPKWDGLPLTLDVSATFPEGAAVRDYYSQQIAIVKNGQITLQPAATSNGLLLLERAETDTSAPFDWHNATVYFVLTDRFENGDPSNDQSYGRHKDGMAEIGTFHGGDLRGLTNKLDYLQQLGVNALWISAPFEQIHGWVGGGTKGDFPHYAYHGYYTQDWTNLDANMGNEADLRTLVDSAHQRGIRILFDVVMNHTSYATLADMQEYQFGALYLSGDEVKKTLGERWSDWKPAAGQTWHSFNDYINFSDKTGWDKWWGKNWIRTDIGDYDNPGFDDLTMSLAFLPDIKTESTTASGLPVFYKNKTDTHAKVIEGFTPRDYLTHWLSQWVRDYGIDGFRVDTAKHVELPAWQQLKTEASSALREWKKTNPDKALDDKPFWMTGEAWGHGVMQSDYYRHGFDAMINFDYQEQAAKAVDCLAQMDTTWQQMAEKLQGFNVLSYLSSHDTRLFREGGDKAAELLLLAPGAVQIFYGDESSRPFGPTGSDPLQGTRSDMNWQDVSGKSAANVAHWQKISQFRARHPAIGAGKQTTLSLKQGYGFVREHGDDKVLVIWAGQQ

SEQ ID NO: 3747 - protein, 257 aa, Glycine max
MEDIGPNSCTRPVTEKKARPQEQLNCPRCSSTNTKFCYYNNYSLTQPRYFCKTCRRYWTEGGSLRNVPVGGGSRKNKRVTSSKVPDLNPPISLSSVSAISSQNPKMQGVHDLNLAFPAAMDKYHHGTSPYVEMPKLEIGGDHSTSHHSHHHSHSPSSAVELLRSGMDSRGLNPYAPNSLMSGSDHSLYTPGYPMQEIKPNLSFSVDDGFGNRSYGVQENGGGRLLFPFGDIKHLSAGLEVEHNKEQGNNSTGYWTGW

SEQ ID NO: 3748 - protein, 359 aa, Triticum aestivum
KKGLLDIVPAGVVTGKNLLKLFEYAREHKFAIPAINCTSTSTVNAALEAARDIKSPIIIQFSQGGSAFFAGKGLDNKNQEASIIGAVAGAQYVRAVAKAYGIPVVVHSDHCAKKLLPWFDGMLDADEKYYKAHGEPLFSSHMLDLSEEPKEENIEICLKYLKRMAAIDCWLEMEIGITGGEEDGVDNSGVDNAALYTQPEDIWDIYKAFKELSPLFSIAAGFGNVHGVYAPGNVKLHPELLGKHQGYVKEQLKNNDPKPVFFVFHGGSGSSEEEIAEAVRNGVVKMNVDTDTQWAYWKGLKEFYENKKDYLQSQVGNPEGPNKPNKKFYDPRVFIRESEKTMIQRVQQACKDLGNVNTL

SEQ ID NO: 3749 - protein, 460 aa, Gelidium crinale
  unsure (1)..(460): unsure at all Xaa locations
RYESGVIPYAKMGYWDPDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGNDVVLQFGGGTIGHPDGIQAGATANRVALEAMVXARNEXRDYAAQGPQXLRDAAKTCGPLQTALDLWXDXTFNYAF

SEQ ID NO: 3750 - protein, 803 aa, ASPERGILLUS NIDULANS FGSC A4
MILTRGNSRLIKTTAAVFCACVLLAFLFNHQDGYQSTRKLIHAGRSRLENAMFERIKNETLGFQHIYAIGLKERTDKHDSLTLAASATGMNVEWLEGVRPGDVSEKALPQGMDNPEIPYAVVLCWRAHMNALRRVVENKYTTALIMEDDADWDVTIRPQLREIARGVRELSSNQKAPRKEPYGTNWDLLWIGGCATLQDKNETDLYMIPDDPTTPSLGHRGPWQGPIGPHEDWRNQHPEVSMDSTRFVYRAGHGCCLYGYAVTYQGARKILAALSLERSAEVDNSLGDLCGGKNGRQQIRCFGVYPNVIGTFKPAGLSSRHSDIQNYSTTDWVNAESWNMVYSTRMNLQRLLAGEETVYSQWNTSFVPWSKGEVKPREVQYPRGSSRPVLGVAQCNTNAPGMPGTRRTRVSSVTHRDLLWTLCPFIDQTISACDRNGSRESDPLWTCQRYGVLLGQSRSLLRPPYMIYPQDPDCRDGEANLRLTEKDPDPSTLEKVNGDLKKLEVTNEKPASHSRSARFLIWTILNVTSTVGIVFTNKSVMSNPSFSNRQVSLACYHFFITGATLWAASHRFFGAFVPKPIGLKQMTPIAAAMAIQVVLQNLSLAHSSVMFHQLARLLLTPAVALLNYVLFRIKTPRAALMPLALLCSGVGVVTYYDSLPSADSGSSTSARGVIFALTAVCASSIYTVWIGYYHKRYELSSMQLLLNQAPISACLLLCAIPWAETTPAVSSVPTYMWSMVLLFYIVDAAGAVSGAVIGQLKTCIIVGLGWAWRNHAVPRQSMMGIIMALIGMSMYMNIVLKNR

SEQ ID NO: 3751 - protein, 310 aa, Zea mays
MGCSISGLNALYDAATGGGDVWINERRFRVLRQIGEGGFAFVYLVREHQPASDAAFARRDPAHVSEDGTYAMKKVLIQSKEQLDLSQQGDWSHEAYLLFPVHLDGTLFDNANIMLSRREFYSTADVLQIFQQMCEGLKHMHSFDPPYAHNDVKPGNVLITWRKGQAPVATLMDFGSARPARKEIRSRSEALQLQEWAAEHCSAPYRAPELWDCPSHADIDERTDIWSLGCTLFAIMYNVSPFEYALGESGGSLQLAIVNGQLKWPAGPKPPYPDELRHFVIWMLQPEAVMRPHISDVVLHVDKLIAKYLP

SEQ ID NO: 3752 - protein, 165 aa, Yersinia rohdei
NESDMVLMPDASTAVMDPFFEDSTLIIRCDILEPGTMQGYDRDPRSISKRAEDFLRSSGIADTVLFGPEPEFFLFDDVRFGSSIRGSHVSIDDIEGAWNSSTKYDGGNKGHRPAVKGGYFPVPPVDSSQDLRSTMCLTMEEMGLVVEAHHHEVATAGQNEVATRF

SEQ ID NO: 3753 - protein, 432 aa, Glycine max
SARGVGSFQKPDSDSGYVSYIKVSTDGGAGTGSGGGGGVHKHTIVVVVIVIIALVVICGLVFGGVRYHRRKQRLPESPREGSEEDNFLENLTGMPIRYSYKDLEAATNNFSVKLGQGGFGSVYKGVLPDGTQLAVKKLEGIGQGKKEFRAEVSIIGSIHHLHLVRLKGFCADGTHRLLAYEYLSNGSLDKWIFKKNKGEFQLDWDTRFNIALGTAKGLAYLHEDCDSKIVHCDIKPENVLLDDHFMAKVSDFGLAKLMNREQSHVFTTLRGTRGYLAPEWITNYAISEKSDVYSYGMVLLEIIGGRKNYDPSKSSEKSHFPTYAYKMMEEGKLRDIFDSELKIDENDDRFQCAIKVALWCIQEDMSMRPSMTRVVQMLEGICIVPNPPTSSSLGSRLYATVFKSSSEGATSSGPSDCNSDAYLSAVRLSGPR

SEQ ID NO: 3754 - protein, 464 aa, Glycine max
MANTLYNGATCRIPLRNQSLAFSRHVSRSLSFLPITRAAKQPNAIAVKASSHSDFDVDPSLSPRVNAVKPSKTVAISDHATALVQAGVPVIRLGGGEPDFDTPAPIAEAGINAIREGYTRYTPNAGTMELRQAICHKLKEENGITYTPDQVVVSNGAKQSIAQAVLAVSSPGDEVIIPAPFWVSYPEMARLADATPVILPTLISDNFLLDPKLLESKITERSRLLILCSPSNPTGSVYPKELLEEIARIVAKHPRLLVLSDEIYEHIIYAPATHTSFASLPGMWDRTLTVNGFSKAFAMTGWRLGYIAGPKHFVAACGKIQSQFTSGASSIAQKAAVAALGLGHAGGEAVSTMVKAFRERRDFLVKSFREIDGVKISEPQGAFYLFLDFSFYYGREAEGFGKIVDSESLCQYLLDVGQVALVPGSAFGDDTCIRISYAESLTTLQAAVERVKRALIPLSSAALV

SEQ ID NO: 3755 - protein, 106 aa, Glycine max
SMIFFPAGTTVNRAGARMGGSFTGLKFMGGFPTKKNNHDLTFIGCNRGRIPCMPVWAPIGKKKFETLFYLPDLDDAPLGKEVEYLLRKGWISCVEFELEHRFVYRE

SEQ ID NO: 3756 - protein, 524 aa, Uncinula necator
MYIADILSDLLTQQTTRYGWIFMVTSIAFSIILLAVVLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVYDCPNSKLMEQKKFMKTALTTEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 3757 - protein, 304 aa, Nitrosomonas europaea ATCC 19718
MEFGMVGLGRMGGNMARRLARQSRKIAVMNRSFDVAEALVKETGHIACRDYTELVAVLEKPRIIWLMLPAGDVTETALSTLLPLLSPGDLIVDGANAHYQDDAPRAARCAERGIEFVDAGVSGGIWGLENGYCIMFGGSDTAAARLKPYLEVLAPTPTTGWLHTGPVGSGHYVKMIHNGIEYGMMQAFAEGFALMKDKSGFNLDLAEIAELWRHGSVVRSWLLDLSADFLAEDQMFDDIAPFVADSGEGRWTALASIEQGIPAPVIMLSLMMRFTTQGRNDYAAKMLAKMRHGFGGHAIKKGEQ

SEQ ID NO: 3758 - protein, 503 aa, Triticum aestivum
MVAPAAIPQRQLFIDGDWRAPALGRRLPVINPTTEVTIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 3759 - protein, 263 aa, Vicia faba
AHIITAVIGSGVLSLAWAIAQMGWVAGPAVLLAFSLITYFTSTLLADSYRSPDPVHGKRNYTYSEVVRSVLGGRKFQLCGLAQYINLVGVTIGYTITASISMVAVKRSNCYHKHGHEAKCYTSNNPFMIVFACIQIVLSQIPNFHKLSWLSILAAVMSFAYSAIGLGLSVAKVVGGGPAVRTSLTGVQVGVDVTGTEKVWRMFQAIGDIAFAYTYSNVLIEIQDTLKSSPPENQVMKRASLIGVLTTSMFYMLCGCLGYAAFG

SEQ ID NO: 3760 - protein, 281 aa, Physcomitrella patens subsp. patens
MGRGKIEIKKIENTTSRQVTFSKRRGGLLKKAHELAVLCDAEVALVIFSSTGKHFEFASSGSMRDIIERYRKSSDGAVKRGTNTDLLGREVIKLKQQVERLESSQRHMLGEDLSALKVSDLLELEQQLDQGASRVRARKNQLILEEIEDLRRKEHELMIANEALRKKIADAEGAAEAAARANFPDARLESPKPFASDFSRDMSVSSQLAASVYPHPNLLQAQRSQTSLQLGWLSEQQIPSTEEGCAGESSLKWDHPHFHIQNRLHANISPSVRTYKLHVDR

SEQ ID NO: 3761 - protein, 138 aa, Glycine max
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREA

SEQ ID NO: 3762 - protein, 484 aa, Azotobacter vinelandii
MQLTDSTLLRTRAFIAGQWVDADDGATFVVTDPADLSPIGTVASLGAAETARAIAAAEAALPAWRAKTAKERSVLLRKWFELIMANREDLARLLSREQGKPLAESRGEIAYGASFIEWFAEEAKRTYGDVIPHDKQGRRLVVIRQPIGVVAAITPWNFPNAMITRKAGPALAAGCTIVIKPASETPLSALALAELAVRAGIPAGVINVVTGDPRVIGGELTRNPAVRKLSFTGSTGIGKLLMAQCADTMKKVSMELGGNAPFIVFDDADLDAAVAGALASKYRNSGQTCVCTNRLLVQEGVYDAFARRLVAAVKALKVGPACEEGAQLGPLINAKAVLKVQEHIEDALTKGARLLAGGKPHSLGGSFFEPTVLGEATPEMLVAREETFGPLAPIFRFRSEAEAIQMANDTEFGLASYLYTRDLSRAWRVSEALEYGMVGVNEGVISTEIAPFGGIKESGTGREGSKFGIDDYVELKYLCFGIDA

SEQ ID NO: 3763 - protein, 795 aa, Corynebacterium glutamicum ATCC 13032
MTENQPLPADLVGSHVRAAAGTPADLATDRKFWTGLSRAVQERIADDWERTREAYGAARQQHYFSAEFLMGRALLNNLTNLGLVDEAAAATRELGHEITDILEIENDAALGNGGLGRLAACFLDSAVTQDYPVTGYGLLYRFGLFRQSFNEGFQVEKPDPWREEEYPFTIRRASNQLVVCFDDMKTRAIPYDMPITGYGTHNVGTLRLWKAEPWEEFDYDAFNSQRFTDAIIERERVSDICRVLYPNDTTYEGKKLRVRQQYFFTSASLQAMIQGHLAHHKDLSNFAEFHSVQLNDTHPVLAIPELMRLLMDEHDMGWEESWAIVSKTFAYTNHTVLTEALEQWDQQIFQQLFWRVWEIITEIDRRFRLERAADGLDEETIDRMAPIQHGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYEPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 3764 - protein, 468 aa, Triticum aestivum
MAIAVSPTHTKQKQQQQDHRRIPSQSNHTRRQARMAIAVSGQWTRLRTLGCGASGAVVTLAADAASGELFAVKSVRAADAAQLSREQGILSGLSSPHVVGCIGGGGDRDGSYHLFLEFAPGGSLADEAARNGGRLEERAIRAYAADVLRGLAYIHGKSLVHGDVKSRNVVIGADGRAMIADFGCARALGSAGPIGGTPAFMAPEVARGEEQGPAADVWALGCTVVEMATGRAPWGEMDNVLAAVHRIGYTDAVPEVPTWLSAEAKSFLAMCFARNARDRCTAAQLLEHPFVALQAGEAKARWVSPKSTLDAAFWESETDEEEEEEEEVSESPSERIKSLSCSVLPDWDSDEGWIDVLGEQCEACDSPAATKGPADVSSRAPSKVLGSPAVPAEDVAVVGTLSSDEHEVDAEDEPFGDDTILAADPSVDRQNQVCSSSDRDVLSSSHVPCNNRVLAIEKFRFPQKKKKK

SEQ ID NO: 3765 - protein, 427 aa, Batrachospermum turfosum
IEAAAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERYLFSIEGVNRAQAATGEIKGHYLNVTAATMEDMYERAEFAKELGSIICMIDLVIGYTAIQSMAIWARKTDMILHLHRAGNSTYSRQKIHGMNFRVICKWMRMAGVDHIHAGTVVGKLEGDPLMIKGFYNTLLLSHLDINLPQGIFFEQDWASLRKVTPVASGGIHCGQMHQLLDYLGDDVVLQFGGGTIGHPDGIQAGATANRVALESMVMARNEGRDYVNEGPQILKEAAKTCGPLQTALDLWKDISFNYTSTDTADFV

SEQ ID NO: 3766 - protein, 282 aa, Glycine max
EQDREKPHRHLFRFPHMGMWTKLRPGIWNFLEKASKLYELHLYTMGNKLYATEMAKVLDPKGVLFAGRVISRGDDTDSVDGEERVPKSKDLEGVLGMESSVVIIDDSVRVWPHNKLNLIVVERYTYFPCSRRQFGLPGPSLLEIDHDERPEAGTLASSLAVIEKIHQIFFASQSLEEVDVRNILASEQRKILAGCRIVFSRVFPVGEANPHLHPLWQTAEQFGAVCTNQIDEQVTHVVANSPGTDKVNWALNNGRFVVHPGWVEASALLYRRANEQDFAIKP

SEQ ID NO: 3767 - protein, 279 aa, Pseudomonas aeruginosa PAO1
MIKKCLFPAAGYGTRFLPATKAMPKEMLPVVNKPLIQYAVEEALEAGLSEIGIVTGRGKRSLEDHFDISYELEHQIRNTDKEKYLVGIRRLIDECTFAYTRQVEMKGLGHAILTGRPLIGDEPFAVVLADDLCLNLEGDSVLKQMVKLYNQFRCSIVAIQEVPPEETNKYGVIAGEMIRDDIFRVNTMVEKPKPEEAPSNLAIIGRYILTPDIFDLIEQTEPGKGGEIQITDALMKQAQDGCVLAYKFKGKRFDCGSAEGYIEATNFCYENLYKTGKAH

SEQ ID NO: 3768 - protein, 739 aa, ASPERGILLUS NIDULANS FGSC A4
MASPGRYDNGEGSSTPKLGSSPIATSAHRSRSPAPDSVRHASIARLASPVPSISNSVSSRQIPVPVSVGESQDLSRVDNLSSLPGPGQSMIASALQDSLGRSPPRFGTPPRRTESPVSNQNPQIRSNYGSFDQKPWREGSEYSAAPYEDPEIVKRHLVQPLESRDTQSSGYGTDNADDEFSSLRLQGGDITRQVYRWAEDAEEGGSVRKPQRSRSFHLNRPTPEEDTMNINSIRVPGGFRRDYLRRAVGSPRPGQSDAGDGASPAPRQLPTSSFLEFLTLYGHFAGEELEEDDEVLGPHEYFSSDTWDEAEEREPGEDSALLHPEAPGKRRRKPRGGTGTNTRTGAALLLLKSFVGTGVLFLPRAFLNGGMLFSSLVLLAVSLLSFYCFVLLVNARLKIEGSFGDIGGALYGKNMRRIILGSIVLSQLGFVSAYIVFTAENLQAFVLAVSNCKSFIDIKFMVLMQLIIFLPLSLIRDISKLGFTALIADLFILLGLVYLFYYDFLTISTQGVAEIASFNPSTWTLFIGTAIFTYEGVGLIIPIQESMKHPKQFTGVLAGVMVIITIIFLAAGAVSYAAYGHATKTVILLNLPQDDKLVNAVQFLYSLAILLSTPLQLFPAIRIMENELFTRSGKYNPGIKWKKNGFRFFLVMICAFVAWGGADDLDKFVSLVGSFACVPLIYVYPPLLHLKACAETKRQKLADIALTVLGVVSCIYTTALTLNNWVNGNNSKAPGYCDS

SEQ ID NO: 3769 - protein, 368 aa, Pichia ohmeri
MSTKTITVVPGDHVGTEICDEAIKVLKAIEKVSPVKFEFKHHLIGGAAIDATGVPLPDETLEAAKSSDAVLLGAVGGPKWGTGAVRPEQGLLKIRKELNLYANLRPCNFVSDSLLELSPLKSEIVKGTNFTVVRELVGGIYFGERQEQEESSDGQSAWDTEKYSVEEVTRITRMAAFMALQHNPPLPIWSLDKANVLALSRLWRKTVDHVMSTEFPQLKVQHQLIDSAAMILVKSPSQLNGVIITSNMFGDIISDEASVIPGSLGLLPSASLASLPDTNSAFGLYEPCHGSAPDLPANKVNPVATILSVAMMLRLSLDCLKEAEALEKAVGQVLDAGIRTADLRGSSSTKEVGDAVAAAVEKILAEGK

SEQ ID NO: 3770 - protein, 332 aa, Pseudomonas fluorescens PfO-1
  unsure (1)..(332): unsure at all Xaa locations
MVAMSGNFLALAQPGVQQLSPYVPGKPVDELARELDLDPASIVKLASNENPLGASPKALAAIREALDELTRYPDGNGFALKSLLAEQCRVELNQVTLGNGSNDILELVARAYLAPGLNAVFSEHAFAVYPIATQAVGAQAKVVPAKEWGHDLPAMLAAIDANTRVVFIANPNNPTGTWFGAEALDDFLQDVPEHVLVVLDEAYIEYAEGSDLPDGLDFLAAYPNLLVSRTFSKAYGLAALRVGYGLSTPVVADVLNRVRXAVQRQQPGPGRGVCGVERRGISGAEPPAQRIRHATAGGGFSRAGSELDSVQGQLYLRRPWSGGGSGVPGPAA

SEQ ID NO: 3771 - protein, 122 aa, Pectobacterium carotovorum subsp. carotovorum
AGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEA

SEQ ID NO: 3772 - protein, 487 aa, Oryza sativa
MAPWRAAAMASSQLARRAARRLLSSQHRRHCAAPACPWLLGSAPPVLAPSPVAAAAAGDRRGFCSVRRFTGESNAAAAVEEAENGLVAGGDQQAIDFPGGKVSFVAEMNFLPESQRDRINCYRVLDDDGRTISGSRFQEVSKELALKMYNEMATLQVMDTIFFEAQRQGRISFYLTSHGEEAINIASAAALTIDDIVLPQYREPGVLLWRGFTLQEFANQCFGNKLDYGKGRQMPIHYGSNRLNYFTVSSPIATQLPHAVGAAYSLKMDKKDACAITYFGDGGTSEGDFHAALNFAAVMEAPVIFFCRNNGWAISTPTSEQFRSDGAVIRGQAYGMRSIRVDGNDALAVYSAVHTAREMAIKEGRPILVEALTYRVGHHSTSDDSTKYRPVDEIEHWRTARDPISRYRKWVQGNGWWCDEDESELRNNVRQELLKAIQVAERMPKPPLAELFTDVYDEVPSNLREQERLLRDTIKKHPADYPADVHI

SEQ ID NO: 3773 - protein, 125 aa, Oryza sativa
  unsure (1)..(125): unsure at all Xaa locations
PTRPKKDQPKEDDDAQLLQQALAMSMEEGSSGAAAADAAMAEAXAVDDQDLALALQLSVQDAGGSSQSDMSKVFEDRSFVTSILNSLPGVDPNDPSVKDLLASLHGQGEQEKKEDKSDKPEDEKK

SEQ ID NO: 3774 - protein, 735 aa, Betula platyphylla
MWRLKIAEGGNDSFLSSTNNFVGRQTWEFDANAGTPEERAEVEEARQNYYKNRHKIKPGSDLLWQMQFLREKNFKQTIPQVKVKDGEEITYEIATTTLRRAARFFSALQASDGHWPAEISGVLFPLPPFILCLYITGHLNTIFTTEHRKEVFGIYHNHQYVDGGWGLHIESHSSMYSTGLHYVCMRILGEGADGDACARARKWILDRGGVTHIPYWGKIWLSILGVYEANLWCYIRMSYLPMSYLYGKRFVGPITPLILQLREELYIQPYHTINWWRARHLCAKEDLYYSQTWMQDLFWDSLYIFIEPVLSCWPFNKLRNKALQVAMKHIHYEDENSRYLTIGGGQKPFFMLACWDEDPHGDYFKKHLPRIQDFLWISEDGMKMTNAGQVWDASFAIQALLATDLSDEIGQTLMRGYDFIRIQVKDNPSGDFSSMWFVTFLKGGWPFSEQDHGWQASDCTAEALKCCLLLSMLPSEIAGEEMDPERLYDAVHIILSLQSKNGGVTGWEPAGGASCFELLNPIEFLEGTLLEHEYVECTSSAIQALVLFKKLYPGHRKEECEIFISNAVRFLEDIQMPNGSWYGIWGICFIYATWFALVGLEVAGKTYHNCLAMRKGVQFLLKTQNQDGGWGESYLSCSKKEYVPLEGNRSNLVQTAMALIGLVHAQQAERDPTPLHRAAKLLINSQMENGDFPQQELVGAVMQNCMLHYTLFRDTFPLWALAEYRNYVSLPTKSL

SEQ ID NO: 3775 - protein, 492 aa, Triticum aestivum
MDPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDAIAAGNYPEWKLFIQTIDADHEDKFDFDPLDVTKTWPEDIIPLQPVGRMVLNKNIDNFFAENEQIAFCPAIIVPGIHYSDDKLLQTRIFSYADTQRHRLGPNYLMLPVNAPKCAHHNNHHEGFMNFMHRDEEVNYFPSRFDPTRHAEKVPIPPRVLTGCREKCIIEKENNFKQAGERFRSFDPARQDRFIQRWVDALSDPRVTHEHHTIWINYWSQCDASLGQKLASRLNLKPNM

SEQ ID NO: 3776 - protein, 70 aa, Zea mays
VFFRIKRSPQLKKLMNPYCAPQSVDMNAIAFLFNGRRFRGEQTPNKLKMEDGDEIDPMFPQTGGRVPSPP

SEQ ID NO: 3777 - protein, 505 aa, Brucella suis 1330
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMKKALKRVEAIVQGDPLDPATMIGAQASSEQLEKILSYLDIGRQEGAEVLAGGERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENYLKMLDHYQNTKNMLVSYSPKKLGFF

SEQ ID NO: 3778 - protein, 292 aa, Vibrio cholerae
MKGIILAGGSGTRLYPITRGVSKQLLPIYDKPMIYYPLSTLMLAGIRDVLIITTPEDNESFKRLLGDGRDFGIHLQYAIQPSPDGLAQAFLIGEEFIGNDSVCLVLGDNIFYGQSFSKTLRHAASREHGATVFGYQVKDPERFGVVEFDEQMRAISIEEKPLKPKSNYAVTGLYFYDSRVVELAKQVKPSARGELKIPTLNEMYLNDGSLNVELLGRGFAWLDTGTHESLHEASSFVETVQHIQGLKIACLEEIAWRNGWLTSEQLLECAKPMLKNDYGQYLERLVKEERHG

SEQ ID NO: 3779 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWMKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 3780 - protein, 390 aa, Oryza sativa
  unsure (1)..(390): unsure at all Xaa locations
FFTDAYDLFCIALVTKLLGRLYYTDITKPNPGTLPPNVSSAVTGVALCGTLAGQLFFGWLGDKLGRKSVYGFTLILMVVCSIASGLSFGHTPKSVIVTLCFFRFWLGFGIGGDYPLSATIMSEYASKKTRGAFIAAVFAMXGFGILFGAIVALVVSAGFRHAYPAPSYAXNSAASLAPQADYTWWLILMFGTIPAGLTYYWRMKMPEMARYTALVARNAKQAAADMSKVLHAEIEERPEVVESQVVAGETWGLFSRQFMKRHGMHLLATTSTWFLLDIAFYSXNLFQKDIFSKVGWIPPAKTMNALEELYRISRAQALIALCGTIPGYWFTVAFIDIVGRFXIQIMGFFMMTVFMLALGVPYDHWTHPAHHTGFVVLYALTFFFANFGPN

SEQ ID NO: 3781 - protein, 115 aa, Glycine max
  unsure (1)..(115): unsure at all Xaa locations
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEXAIFVDAPSAGS

SEQ ID NO: 3782 - protein, 120 aa, Triticum aestivum
MAIKKGGAAGLKQILKRCSSLGRRQQQQGHGQEQRHWEEEEEAAPSDVPRGHFAVYVGESRRRFVVPIAVLDRPEFRSLLRRAEEEFGFGGAGDLLVLPCEELAFRSLCSASSLPCAAAR

SEQ ID NO: 3783 - protein, 518 aa, Glycine max
MPAVGGINTGGGKEYPGSLTLFVTVTCIVAAMGGLIFGYDIGISGGVTSMDPFLLKFFPSVFRKKNSDKTVNQYCQYDSQTLTMFTSSLYLAALLSSLVAATVTRKFGRKLSMLFGGLLFLVGALINGFAQHVWMLIVGRILLGFGIGFANQSVPLYLSEMAPYKYRGALNIGFQLSITVGILVANVLNYFFAKIKGGWGWRLSLGGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 3784 - protein, 110 aa, Quercus suber
SLDIWVPFEGFSAVASVPPSARETTAFATARIDWKETPEAHIFKADLPGLKKEEVKVEVEDGNVLQISGERSKEHEEKNDKWHRVERSCGKFMRRFRLPENAKVDQVKAN

SEQ ID NO: 3785 - protein, 214 aa, Zea mays
METPLSSRRITRSLAAASAQKSAAAGPDSAALFSRAKNAAAGETQPRAALHDITNDSPIVGLAAGALHATDTTPASTAAKTRRRAPRRTPGSGEALLRGQVKALLHKVEEEQGCAAAALVRPARIQALLGVSRSPAQLLAPTPANTPQIEPVPTPREGLLLLDGARVMPCVLDEEELLIPKLQVIAASLPPPHQAEEKLGDCQLNRALVFDDSP

SEQ ID NO: 3786 - protein, 244 aa, Oryza sativa
MFRYEKGGDVEAGTSGGARELYPGMTEPPEMRWALIRKIYVILSMQLLLTAAVAAVVVKVRAISHFFVSSHAGLGLYIFLIILPFIVLCPLYYYHQKHPVNLILLGLFTVAISFAVGMTCAFTSGKVILESAILTTVVVFSLTAYTFWAAKRGRDFSFLGPFLFASLIVLLVFAFIQILFPLGRISQMIYGGIASLIFSGYIVYDTDNIIKRYTYDQYVWAAVSLYLDVINLFLSLMTLFRAAD

SEQ ID NO: 3787 - protein, 321 aa, Zea mays
PGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETAMRGKLVKRNKKSSETSFYFADSRSEIRSRGDRDIDNQQALQAEEKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 3788 - protein, 261 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 3789 - protein, 407 aa, Halobacterium sp. NRC-1
MTDDRRTAGFKQRTRVAEARERLLSAVDPLARTARVALGDADGRVLAADVEAPRAVPHYERAAMDGFAVRAADTFGAGDRSPVVLDVGTGSVGPGEAVRVHTGSELPAGADAVVMIEDAERRGDRVDVFAAAAGGANVAPIGEDVSDGQHLYDAGHRLRPSDLGLLKSAGVDAVAVYERPTVGVLPTGEELVAADPGPGEVVETNGGTVAQYVSRWGGVPTRRGVVTDDEAALRTAIREAVDSHDVVVTTGGSSVGARDHVPEVIADLGTVLVHGVALQPGHPVALCVVDDTPVVALPGYPVAAIVNAVQFLRPLLKAVGHAPATAHPTTDAVLARKIASEPGTRSFVRVTRHGDEDGRPTVTPTRAGGSGVLSSVALADGWVVVPEDCEGYDAGTTVAVEQWEWSA

SEQ ID NO: 3790 - protein, 435 aa, Ptilonia magellanica
  unsure (1)..(435): unsure at all Xaa locations
PVEASAAIAGESSTATWTVVWTDLLTACDLYRAKAYKVDAVPNTSDQYFAYVSYDIDLFEEGSIANLTASIIGNVFGFKAVKALRLEDMRLPVAYLKTFQGPATGIIVERERMDKFGRPFLGATVKPKLGLSGKNYGRVVYEGLRGGLDFLKDDENINSQPFMRWKERYLYSMEGVNRSVAASGEVKGHYLNVTAATMEEMYERAEFAQQLGSIIIMVDLVIGYTAIQTMAIWARRNDMILHLHRAGNSTYSRQKNHGMNFRVICKWMRMAGVDHIHAGTVVGKLEGDPLMIRGFYNTLLEAKLDINLPQGIFFEQDWASLRKVTPVASGGIHCGQMHQLLDYLGVDVVLQFGGGTIGHPDGIQAGATANRVALESIVIARNXXXXXVTEGPQILRDAAKTCGPLQTALDLWKDITFNYTSTDTADFVETPTANV

SEQ ID NO: 3791 - protein, 479 aa, Zea mays
MKNVAKCDTWCELQNPANHRVFERKLRPKPSGGGHVCLGVTPKDTKRKKFHPPPLSPHRVTKPNPNSRPPEMGQGSPGGMGKQPGLPGDRKQGDGKKEKKYEPPAAPSRVGRKQKRQKGSEAAARLPAVAPLSKCRLRLLKLERVKDYLLMEEEFVASQERLRPQEDKAEEDRSKVDDLRGTPMSVGSLEEIIDESHAIVSSSVGPEYYVSILSFVDKDQLEPGCSILMHNKIQEIKEAVKLPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 3792 - protein, 552 aa, Mycobacterium tuberculosis H37Rv
MTVGDHLVARMRAAGISVVCGLPTSRLDSLLVRLSRDAGFQIVLARHEGGAGYLADGFARASGKSAAVFVAGPGATNVISAVANASVNQVPMLILTGEVAVGEFGLHSQQDTSDDGLGLGATFRRFCRCSVSIESIANARSKIDSAFRALASIPRGPVHIALPRDLVDERLPAHQLGTAAAGLGGLRTLAPCGPDVADEVIGRLDRSRAPMLVLGNGCRLDGIGEQIVAFCEKAGLPFATTPNGRGIVAETHPLSLGVLGIFGDGRADEYLFDTPCDLLIAVGVSFGGLVTRSFSPRWRGLKADVVHVDPDPSAVGRFVATSLGITTSGRAFVNALNCGRPPRFCRRVGVRPPAPAALPGTPQARGESIHPLELMHELDRELAPNATICADVGTCISWTFRGIPVRRPGRFFATVDFSPMGCGIAGAIGVALARPEEHVICIAGDGAFLMHGTEISTAVAHGIRVTWAVLNDGQMSASAGPVSGRMDPSPVARIGANDLAAMARALGAEGIRVDTRCELRAGVQKALAATGPCVLDIAIDPEINKPDIGLGR

SEQ ID NO: 3793 - protein, 340 aa, Oryza sativa
  unsure (1)..(340): unsure at all Xaa locations
MDHEADAYRTDLMTITRYVLNEQSRNPEARGDLTILLSHIVLGCKFVASAVNKAGLAKLIGLAGETNVQGEEQKKLDVLSNEVFVKALVSSXGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 3794 - protein, 170 aa, Zea mays; identical to SEQ ID NO: 3644

SEQ ID NO: 3795 - protein, 735 aa, Gluconacetobacter xylinus
MRLSRKIFLLSAVACGMALAQAPAFARHAHDGGGDQADARARQVLASMSLEDKMSLLFSVDGGGFNGSVAPPGGLGSAAYLRAPQGSGLPDLQISDAGLGVRNPAHIRRNGEAVSLPSGQSTASTWDMDMARQAGVMIGREAWQSGFNILLGGGADLTRDPRGGRNFEYAGEDPLQTGRMVGSTIAGVQSQHVISTLKHYAMNDLETSRMTMSADIDPVAMRESDLLGFEIALETGHPGAVMCSYNRVNDLYACENPYLLNKTLKQDWHYPGFVMSDWGATHSSARAALAGLDQESAGDHTDARPYFRTLLAADVKAGRVPEARINDMAERVVRALFAAGLVDHPAQRGPLDVVTDTLVAQKDEEEGAVLLRNQGNILPLSPTARIAVIGGHADAGVISGGGSSQVDPIGGEAVKGPGKKEWPGDPVYFPSSPLKAMQAEAPGARITYDPGTSIASAVRAARAADVVVVYATQFTFEGMDAPSMHLDDNADALITAVAAANPRTVVVMETGDPVLMPWNSSVAGVLEAWFPGSGGGPAIARLLFGKVAPSGHLTMTFPQAESQLAHPDIAGVTADNVFEMQFHTDQELVYDEGSDVGYRWFDRNHFKPLYPFGYGLTYTTFSTDGLKVTERHGQVTATFNVHNTGTRAGVDVPQVYVGLPDGGARRLAGWQRISLAPGESRQVSVQLEPRLLAHFDGKHDRWSVPSGTFRVWLASCATDDSQQTTMHLHGRTMAP

SEQ ID NO: 3796 - protein, 294 aa, Escherichia coli CFT073
MHPRFQTAFAQLADNLQSALEPILADKYFPALLTGEQVSSLKSATGLDEDALAFALLPLAAACARTPLSNFNVGAIARGVSGTWYFGANMEFIGATMQQTVHAEQSAISHAWLSGEKALAAITVNYTPCGHCRQFMNELNSGLDLRIHLPGREAHALRDYLPDAFGPKDLEIKTLLMDEQDHGYALTGDALSQAAIAAANRSHMPYSKSPSGVALECKDGRIFSGSYAENAAFNPTLPPLQGALILLNLKGYDYPDIQRAVLAEKADAPLIQWDATSATLKALGCHNIDRVLLA

SEQ ID NO: 3797 - protein, 838 aa, Geobacter metallireducens
MTDEAFPSESGSPELDTMMLIIKSFLEHLEYTLGKDKYSATRHDIFNALAYAVRDRMVERWLDTQQAYYNEDPKRIYYVSMEFLMGKTLENSLVNLGLLAEFREAMNSLGYDLDEFIEREQDAGLGNGGLGRLAACFLDSMATMGVPGYGYGIRYEYGIFRQNIIDGSQVEIPDNWLRYRNPWEMDRQEHLHPVKFYGRVVERKDTEGNTLFDWIDTEDVMAMAYDTPIPGYGTNTVNTMRLWTAKSTREFDLSFFNEGNYIRAVEKKMLTENISKVLYPADNVPEGKELRFKQEYFLACATVHDVIYRFHKQHEDLRRLPEKAAIQLNDTHPALCIPEMMRVLIDHHRLDWETAWNITTRTFAYTNHTILPEALEKWPVWFFEHILPRHIQIIYEINDRFLTAVRTRFPGDTGKLERMSLIEEHWERKVRMANLAVVGSHSVNGVAALHTEIIKEHVFKDFFEMYPERFNNKTNGITQRRWLKCANPDQARLIGDTIGNGWTTDLYKLTQLRPLVDDPAFMAQWQQVKRTNKDKLAEYILKHNCIQVNADSLFDCQVKRIHEYKRQLLNVLHVITLYNRIKANPDGDFVPRTIIFSGKAAPAYAIAKLIIRLINAVGDVINNDSQVGDRLKVVFLANYSVSLAEKIFPAADLSEQISTAGTEASGTGNMKFALNGALTIGTLDGANIEIMEEVGRDNIFIFGMNADEVEDLRRRGYNPRDYYSRNPELKKVLDMIAEGYFFPANRDLFRPIVDSLLNQGDHYMLLADYASYVACQEEVSRLYLDREQWARKAILNCAGMGKFSSDRTIAEYAREIWDVEPFEVHPVLEYRQHDVIPD

SEQ ID NO: 3798 - protein, 470 aa, Zea mays
  unsure (1)..(470): unsure at all Xaa locations
MAGTEVEDPPAAALEVPAKRGLLRYNSPLAQVSLLGLICFCCPGMFNALSGLGGGGQVDPTIADNANTALYACFAVFGVLGGAAHNLLGPRATLLAGALTYPLYAGSFLYYNHRPGSQVFPVTAGALLGAGAGFLWAAQGAVMTSYPPPNRRGTYISLFWCLFNLGGVLGGLLPFALNYNRGDKKGSVSDGTYIAFMAFMLVGAALTVLVLPPARIVRDDGTRATRVTFSSPATEGAEILKLFANWKMLLALPAAWASNFFYTYXVQQRQQRPLHAPHQGPQQRLLLGRADDRLRRHRLLPRLRLRQPPKEGAVRGRRRRRRRNGHLXGGLANQLSYKAVPVADPIDFKDGHRYAGPFLLYFSYGLLDAMFQSLIYWIIGALANDSQILSRYVGFYKGVQSAGAAVAWQVDRRHTPLMSQLIVNWGLMTISYPLLALLVFLAVKDESYSVSSVEDGREKDSKLSAPTSFH

SEQ ID NO: 3799 - protein, 433 aa, Brucella melitensis 16M
MLITGRNKQTALMASLPALFALAGTAMAQDTAPAPTLDTGDTAWMLTSTALVLMMTIPGLALFYGGMVRKKNVLSTVMQSFAITCLMSILWMIAGYSLAFTDGGSLHSYIGGFSKVFFSGVTMESLTGTIPEYLFITFQMTFAIITPALITGSFAERMKFSSMLVFLTLWLFIVYVPVAHWVWGGGFMASDGVLDFAGGTVVHINAGVAGLVAALVIGKRDGYGHTNMAPHNLVLSVIGAALLWVGWFGFNAGSAAGANALAGVAMLNTQVATAGAALAWMFVEWAISGKPSVLGIISGAVAGLVAVTPAAGFVNPTGALIIGIVAGAVCYVAAVKIKHVLGYDDSLDAFGVHGVGGFVGAVLTGFFADATINPASEGATIGKQFFGAAITIIYTAIATVIILYVVKAIMGLRPGKQAEIEGLDIALHGEAVQ

SEQ ID NO: 3800 - protein, 541 aa, Pichia angusta
MKLSMSVLALVATCIGSAQAAAIKKDTAGQHPLGMNSKFGDVFVEKGKSLLDRVSEVVSESSKNISPELRDIWNEMEAKFPDTLKNMKLKSEPVVKITKKPADFWDFNVFNEKFSNYKLRVKKTDPGALGLDHTRQYSGYLDVEDEDKHFFYWMFESRNDPANDPVILWLNGGPGCSSLTGMLFELGSASIGPDLKPINNPYSWNSNATVIFLDQPVNVGFSYSSKSVSNTVAAGKDVYAFLELFYQQFPHLLKNDFHIAGESYGGHYIPVFASEILTHADRSFNLTSVLIGNGLTDPLNQYPFYERMACSTDGGYEPTLDESECEGMLETLPRCLSLIESCYSSQSVFSCVPASIYCNNAQLGPFQKTGRNVYDVRKMCEGTLCYKDMEYIDQYLNQDFVKEKIGAEVETYESCNFDVNRNFLFAGDWMKPYHKNVINLLEQGLPVLIYAGDKDFICNWLGNQAWSNELPWSGHEEFESAELYNLTLKDGTKVGEVKNAGKFTFARMFDGGHMVPYDQPESSLAMVNRWIAGDYSLGTKK

SEQ ID NO: 3801 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 3802 - protein, 120 aa, Zea mays
VLLELARSRNRMPLPKSIAPPGSIPLPPEQDTLLAQNYQLLPPLKPPPQYEEIEDETEEPNPSNPANSNPSYSQDQSSKEQQQQHTPQHGQRVSFQLNAVAAAAAAAKRPRMAIDQLNMG

SEQ ID NO: 3803 - protein, 320 aa, Streptomyces coelicolor A3(2)
MAESVPRFDLITMGRIGVDLYPLQTGVPLAEVETFGKFLGGSASNVAVAAARLGRATAVITRTGDDPFGGYLHDALKEFGVDDRWVTPVAAYPTPVTFCEIFPPDDFPLYFYRRPKAPDLEIHPEELDLDAIRAASIFWMTGTGLSEEPSRTATLSALAHRAKSGTTVFDLDWRPMFWADPDQARPYYAEALAHATVAVGNLDECEIATGVREPRACAEALLAAGVELAVVKQGPKGVLAAHRDGRSAEVPPVPVEVVNGLGAGDAFGGSLCHGLLSGWELERIMRYANAAGALVASRLACSSAMPTEAEVDDLLARATP

SEQ ID NO: 3804 - protein, 402 aa, Pseudomonas fluorescens PfO-1
MAEQGSPRRFARIDRLPPYVFNITAELKMAARRRGEDIIDLSMGNPDGATPPHIVEKLVQVAQREDTHGYSTSKGIPRLRRAISNWYKERYEVEIDPESEAIVTIGSKEGLAHLMLATLDQGDTVLVPNPSYPIHIYGAVIAGAQVRSVPLVPGVDFFAELERAIRGSIPKPKMMILGFPSNPTAQCVELDFFERVIALAKQYDVLVVHDLAYADIVYDGWKAPSIMQVPGAKDMAVEFFTLSKSYNMAGWRIGFMVGNPELVSALARIKSYHDYGTFTPLQVAAIAALEGDQQCVRDIAEQYRQRRNVLVKGLHELGWMVENPKASMYVWAKIPEAYAHLGSLEFAKKLLAEAKVCVSPGVGFGEYGDDHVRFALIENQDRIRQAVRGIRGMFRADALGTK

SEQ ID NO: 3805 - protein, 249 aa, Triticum aestivum
  unsure (1)..(249): unsure at all Xaa locations
MAAPPSHSFVYIDAEALHAVLPFPSLISHLRAGLPAFSEDIHCPHRVSFPVPTSPSAALLLMPSWCAHPSLPYLALKAVTSFPANSPHRPSIHATVSLFSSASGVPLASVEGSALTLLRTAAVSALAASLLVSPSRPPSTLALAGAGALAPYLADAHLSALPSLSRILVWNRTKAKSAALVAKLRDAHPGXVAVEEVDGMDEAVSAADIVSCATGSQEPIARGELLRPGAHLXTWVGSFTPAMRECDDE

SEQ ID NO: 3806 - protein, 91 aa, Glycine max
  unsure (1)..(91): unsure at all Xaa locations
VPLFRVVVTRLCFEGIEARGFIFGSPIXGAKFVPLRKPKKXPGKVISQEHILEYGRDCLEMHVGLXAVEPAEHALVVDDLIATGGTLCAAM

SEQ ID NO: 3807 - protein, 383 aa, Oryza sativa (japonica cultivar-group)
MGLVYFWAATATRRWWPICVMSSTARPHGDVTVPDPAGGPHLPGAHNSRHDELYLWGVREVVVDLGAGTLSLISPTDIRPGFLPVFRSGSCADIGTKSYMEDEHVCVDNLIEHLGVRTPVIPAPGAFYGVFDGHGGTDAACFVRKNLLRFIIEDGHFPSSIEKAIRSAFVRADHAIADSHSLDRNSGTTALTALIFGRTLLVANAGDCRAVLGKRGRAVELSRDHKPSCRSEKIRIENLGGTVFDGYLNGQLSVARAIGDWHVKGSKGSISPLTAEPEFQEVRLTEEDEFLIIGCDGLWDVMTSQCAVTMVRKELMTHNDPERCSQELVQEALRRNSCDNLTVVVVCFSSDPPPQIEVPRFRVRRSISMEGLHMLKGALDSNA

SEQ ID NO: 3808 - protein, 506 aa, Zea mays
  unsure (1)..(506): unsure at all Xaa locations
MASPAMVPLRQLFVDGEWRPPAQGRRLPVVNPTTEAHIGEIPAGTAEDVDXAAVAAARAALKRNRGRDWARAPGAVRAKYLRAIAAKVIERKPELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 3809 - protein, 437 aa, Arabidopsis thaliana
MCVGLSMAEICSSYPTSGGLYYWSAMLAGPRWAPLASWMTGWFNIVGQWAVTASVDFSLAQLIQVIVLLSTGGRNGGGYKGSDFVVIGIHGGILFIHALLNSLPISVLSFIGQLAALWNLLGVLVLMILIPLVSTERATTKFVFTNFNTDNGLGITSYAYIFVLGLLMSQYTITGYDASAHMTEETVDADKNGPRGIISAIGISILFGWGYILGISYAVTDIPSLLSETNNSGGYAIAEIFYLAFKNRFGSGTGGIVCLGVVAVAVFFCGMSSVTSNSRMAYAFSRDGAMPMSPLWHKVNSREVPINAVWLSALISFCMALTSLGSIVAFQAMVSIATIGLYIAYAIPIILRVTLARNTFVPGPFSLGKYGMVVGWVAVLWVVTISVLFSLPVAYPITAETLNYTPVAVAGLVAITLSYWLFSARHWFTGPISNILS

SEQ ID NO: 3810 - protein, 445 aa, Oceanobacillus iheyensis HTE831
MGKSFTKDEVIKQIKEENVKFIRLQFTDMLGTIKNVEIPYSQLDKALDNKMTFDGSSIEGFVRIEESDMLLYPDLDTFVVFPWTSEKGKVARFICDIYNPDGTPFEGCPRYNLKRNLKKMEELGFDAFNIGTEPEFFLFKLDEKGEPTLELNDHGGYFDLAPTDLGENCRRDIVLELEEMGFEIEASHHEVAPGQHEIDFKYSDAVKHADDIQTFKLVVKTIARKHNLHATFMPKPLFGVNGSGMHVNMSLFNGKENAFYDTSGELELSNTAYQFIAGIIKHATNFTAVTNPTVNSYKRLVPGYEAPCYVAWSGSNRSPLIRIPSSRGLSTRIEVRSVDPAANPYMALSVLLASGLDGIEQGLEAPESVDRNIYVMDKAEREANGVQDLPATLKDAMENLKKDKILVDSLGEHLFEHFIEAKEIEWDMFRTTVHPWEREQYLSNY

SEQ ID NO: 3811 - protein, 336 aa, Streptococcus pyogenes M1 GAS
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 3812 - protein, 242 aa, Oryza sativa (japonica cultivar-group)
MVEAMNSVAKLDEGLTKEERNLLSVGYKNLIGAKRAAMRIIGSIELKEETKGKESHVRQTAEYRRKVEAEMDKICCDVINIIDKYLIPHSSGAESSVFYYKMKGDYYRYLAEFKTGTEKIEVSELSLNAYETASKTAQTDLTPTDPIRLGLALNISVFYCEIMNSPDKACQLAKNAFDEAVAELPSLSEENYKDSTLIMQLLRDNLALWNSDMADDADDIRERTDTTGAKGDPAADGGANSW

SEQ ID NO: 3813 - protein, 481 aa, Thermosynechococcus elongatus BP-1
MKAMSKLKLKRARRQKRPLLNLDWQPNFRWRSPALVACIPLALIIVAVWGVAAQAQDKPLTPEDVQGVLNTIWVLVAAILVIFMNAGFGMLETGFCRQKNAVNILAKNLIVFALATLAYWAIGYSFMFGTEGNAFIGWGGFFLSSEDPATYGLNPFPKGLPISVAFLFQAAFAGTAATIVSGAVAERIKFVDFLIFSLLLTGISYPITGHWVWGGGLLSSIGFLGENVAFKDFAGSTVVHAVGGWSALMGAAFLGPRIGKYAADGTPQALPGHNMGFAMLGCLILWIGWFGFNPGSQLAADEAVPYIAVTTNLAAAAGGVAATITAWLAIGKPDLSMIINGILAGLVSITAGCAGVSYWSAVIIGTIGGVIVVYSVLFFDRIKIDDPVGATSVHLVCGTWGTLAVGLFDKELGLFSGYGVTQLIAQIIGILTIGGFTVLLTSIFWLALKQTLGIRVSEEEEIKGLDIGEHGMEAYSGFLKE

SEQ ID NO: 3814 - protein, 521 aa, Zea mays
  unsure (1)..(521): unsure at all Xaa locations
MQFSSVLPLEGKACMSPVRRGSGGYGSERMRINCCSIRXNKALRRMCFSARGXLCSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAXVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAXLHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMXCQGWKERLHNKQRGRPRSRPAGRRILXIRSGIVVVLKNATIKDGTVI

SEQ ID NO: 3815 - protein, 510 aa, Zea mays; identical to SEQ ID NO: 758

SEQ ID NO: 3816 - protein, 134 aa, Triticum aestivum
  unsure (1)..(134): unsure at all Xaa locations
MDLSAVQAALSDKSYSTLASLCDELLLQAASQGFTTDEWPYSVHLLAHLYINDLNSARFFWKSLPQEVKDTRPELAAVWRIGQCLWKRDYAGVNTAAQGFXWGPDLADFITAFLGIGLAWIGMNDIEFPNGMWE

SEQ ID NO: 3817 - protein, 293 aa, Tropaeolum majus
MTSPKWFLFLGILVMATGAMGAAPKRPVAVPFGRNYAPTWAFDHIKYFNGGSDIQLHLDKYTGTGFQSKGSYLFGHFSMQIKLVPGDSAGTVTAFYLSSQNSEHDEIDFEFLGNKTGQPYILQTNVFTGGKGDREQRIYLWFDPTKDYHSYSVLWNLYQIVFFVDDVPIRVFKNSKDLGVKFPFNQPMKIYSSLWNADDWATRGGLEKTDWSKAPFIASYKGFHVDGCEASVEAKFCATQGKRWWDQKEFQDLDGYQWRRLLWVRNKWTIYNYCNDRVRYPTISPECKRDRDI

SEQ ID NO: 3818 - protein, 431 aa, Zea mays
MAMALSPGTVPLGVLLRREVTKERMERPDVLCGEANLSRKGEDFTLLRADAGQRIPGDPSTSFSVFAIFDGHNGSGAAIYARENLLKNVLRAIPTCFCREEWLAVLPRALVAAFVKTDKDFQAVDETSGTTVTFVIIDEWVVTVASVGDSRCILESADGSIYFLSADHRFDSNPDEVKRVTACGSKVGKMDIVGGPEVGPLRCWPGGLCLSRSIGDLDVGECIIAVPHVKQVKLSNAGGRIIIASDGVWDDLTCEMALDCSRGFSSDVAANRIVNEATRPRGIRDDTTCIVIDILPPENIVPSPRKRPRRITFNNVFRKRHLDVPPETNRSEYAEPDVVEEIFEDGSPMLSKRLTTGYTLEKTFAPSSCAVCLVRLKSGQGISVHDNPLQYEKLQGWQGPFLCPSCHEKKEAMEGKRRPKGSSSNVFGHMC

SEQ ID NO: 3819 - protein, 299 aa, Methanosarcina acetivorans C2A
MDRIISVVGHTALDYIIDVENIAGKNESSPVIDYEEYPGGGAANIAVAIAKLGGKSQLMSPVGMDFSSSGYEQLLKDAHVDLSRLYSIEALKLSKAFIFTDREDNQTTYFYWGASSKFKELEPEPVDFAHLATADCIYNAKIAQIAGFVSFDPGQDLVTYSQEKLETILAHTDILFANRHEIKRVSEMTGKSFSELRAMIEVIVITYDAEGSRIYTGNEEWKIPVVSVKAVDPTGAGDAYRAGFLLAYTREYSLPTCGKIGSTVASFAVQSRGCQTSLPTWEEMKSRYEASFGKLEVES

SEQ ID NO: 3820 - protein, 395 aa, Neisseria meningitidis MC58
MNTLLNQLKPYPFARLREAMQGISAPEGLEAVPLHIGEPKHPTPKVITDALTASLHELEKYPLTAGLPELRQACANWLKRRYDGLTVDADNEILPVLGSREALFSFVQTVLNPVSDGIKPAIVSPNPFYQIYEGATLLGGGEIHFANCPAPSFNPDWRSISEEVWKRTKLVFVCSPNNPSGSVLDLDGWKEVFDLQDKYGFIIASDECYSEIYFDGNKPLGCLQAAAQLGRSRQKLLMFTSLSKRSNVPGLRSGFVAGDAELLKNFLLYRTYHGSAMSIPVQRASIAAWDDEQHVIDNRRMYQEKFERVIPILQQVFDVKLPDASFYIWLKVPDGDDLALARNLWQKAAIQVLPGRFLARDTEQGNPGEGYVRIALVADVATCVKAAETIVSLYR

SEQ ID NO: 3821 - protein, 471 aa, Chloroflexus aurantiacus
MKLAWRTKIGLGLGFGLGLWLVGTGRAFAQEGPTTAELAVAMNTFFLIVAAALVFFMQAGFAMLTAGLTRSKNTTNILFKNLMDFVMCSIAFWAVGWGIAYGTSAGGFIGTDQFFLSPVTAEGEVPVMASWFFQVVFAGTAATIVAGAMAERTKFAAYLIYSFIISLFIYPVVVHWVWSGAGWLNTYSGSTEGNWGFTDFAGSTVVHSVGGWASLVGAMILGPRLGRFGPDGKPRVIPGHNMSLAALGTFILWLGWFGFNPGSQLAIASQANADAVALVAVTTNLAAAAGALGALFTAWLRYGKPDLGQTLNGVLGGLVAITAGCAYVDPLSSIIIGFIAGPIVVFSAELLEKLKIDDPVGAVPVHLVNGIWGTLAVGLFASVPGNTGTTGLFYGGGLTLLISQFVGVVAIGLWTVATAALMFFAIKATIGLRVSKAEEEAGLDIGEHGMVAYPDLSGAPAGGEVSGALAR

SEQ ID NO: 3822 - protein, 507 aa, Citrus x paradisi
MFIENFKVESPNVKYTDHEIHSVYDYETTELVHENRNGTYQWIVKPKTVKYEFKTDVHVPKLGVMLVGWGGNNGSTLTGGVIANREGICWATKDTVQQANYFGSLTQASAIRVGSYNGEEIYAPFKSILPMVNPDDIVFGGWDISDMNLADAMARARVFDIDLQKQLRPYMESMVPLPGIYDPDFIAANQGSRANNVIKGTKKEQMLQIIKDIREFKEKNKVDRVVVLWTANTERYSNVIVGLNDTVESLLASLDKNEAEISPSTLYAIACVLENIPFINGSPQNTFVPGLIDLAIRRNCLIGGDDFKSGQTKMKSVLVDFLVGAGIKPTSIVSYNHLGNNDGMNLSAPQTFRSKEISKSNVVDDMVSSNVFFMGLVNTRPRWIKYVPYVAIERAMDEYTSEIFMGGKSTIVLHNTCEDSLLAAPIILDLVLLAELSTRIQLKAEGEGKFHSFHPVATILSYLTKAPLVPPGTPVVNALSKQRAMLENILRACVGLAPENNMILEYK

SEQ ID NO: 3823 - protein, 554 aa, Candidatus Blochmannia floridanus
MNGAHEVIKALVKQKVDIIFGYPGGAIMPIYDALFDSEVKHLLCRHEQGAIIAAIGYARATGKVGVCFATSGPGATNLVTGLADALLDSIPIVAITGQVGLEFIGTDSFQEVDVLGLSLACTKHSFLVRSVDMLSDVIEEAFFIALSGRPGPVLVDIPKDIQLSDNLGSFSKNIEKQREYHILNNNCNQNDVNQARILMVNSSRPVAYVGGGVGMARAVLSLRRFIAETGGMPTVVTLKGLGAPDCSELCYLGMLGMHGNQAANLAVQQCDLLVAIGARFDDRVTGQLSSFAPQAKVIHLDIDSSECNKLRLVQVFLLGNLNSLLLELIQSLSINKWRDQVQSLKLQYGWSYSRSTNEKISVPVLLKTISDNVPINTIITTDVGQHQMWVAQHMQFSKPENFITSGGLGTMGFGIPAAIGAQLGCPNNMVICISGDGSFLMNVQELATIKRRKLPVKIVLLDNKRLGMVRQWQELFFNKRYSETILNDNPDFLILAKAFDIDGMYISHTSQMLDAIYTLLNYQGPFLLHVLIDVDANVWPLVPPGSSNEVMLTQ

SEQ ID NO: 3824 - protein, 728 aa, Aspergillus fumigatus
MRLTFIPSLIGVANAVCPYMTGELNRRDEISDGDAAAATEEFLSQYYLNDNDAFMTSDVGGPIEDQNSLSAGERGPTLLEDFIFRQKIQRFDHERVPERAVHARGAGAHGVFTSYGDFSNITAASFLAKEGKQTPVFVRFSTVAGSRGSSDLARDVHGFATRFYTDEGNFDIVGNNIPVFFIQDAILFPDLIHAVKPRGDNEIPQAATAHDSAWDFFSQQPSTMHTLLWAMSGHGIPRSFRHVDGFGVHTFRFVTDDGASKLVKFHWKSLQGKASMVWEEAQQTSGKNPDFMRQDLHDAIEAGRYPEWELGVQIMDEEDQLRFGFDLLDPTKIVPEEFVPITKLGKMQLNRNPRNYFAETEQVMFQPGHIVRGVDFTEDPLLQGRLFSYLDTQLNRHGGPNFEQLPINQPRVPVHNNNRDGAGQMFIPLNPHAYSPKTSVNGSPKQANQTVGDGFFTAPGRTTSGKLVRAVSSSFEDVWSQPRLFYNSLVPAEKQFVIDAIRFENANVKSPVVKNNVIIQLNRIDNDLARRVARAIGVAEPEPDPTFYHNNKTADVGTFGTKLKKLDGLKVGVLGSVQHPGSVEGASTLRDRLKDDGVDVVLVAERLADGVDQTYSTSDAIQFDAVVVAAGAESLFAASSFTGGSANSASGASSLYPTGRPLQILIDGFRFGKTVGALGSGTAALRNAGIATSRDGVYVAQSVTDDFANDLKEGLRTFKFLDRFPVDH

SEQ ID NO: 3825 - protein, 438 aa, Penicillium chrysogenum
MPISKIHARSVYDSRGNPTVEVDVVTETGLHRAIVPSGASTGLHEVVELRDGDKTKWGGKGVLNAVKNVNDVIGPALIKENIDVKDQAKVDEFLNKLDGTPNKGKLGANAILGVSLAVAKAAAAEKGVPLYAHISDLAGTKKPFVLPVPFQNVLNGGSHAGGRLAFQEFMIVPDTAPTFSEGLRQGAEVYQELKALAKKKYGQSAGNVGDEGGVAPDIQTAEEALDLITEAIEQAGYTGQIKIAMDVASSEFYKEDAKKYDLDFKNPESDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADIAVGLRAGQIKTGAPARSERLAKLNQILRIEEELGANAVYAGEKFRTAVNL

SEQ ID NO: 3826 - protein, 85 aa, Glycine max
  unsure (1)..(85): unsure at all Xaa locations
MVLESTMVCVDKXEYMRNGDFLPTRLQAQQDAVNIVCHSKTRSNPENNVGLITLANDCEVLTTLTPDTGRILSKLHTVQPKXNXT

SEQ ID NO: 3827 - protein, 395 aa, Oryza sativa
MEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNALVVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 3828 - protein, 459 aa, Umbilicosphaera sibogae
DPEYSIKETDLLALFRCTPQPGVDPVEAAAALAGESSTATWTVVWTDLLTACDLYRAKAYRVDPVPSASDTYFCYIAYDIDLFEEGSLANLTASIIGNIFGFKAVKALRLEDMRMPVALLKTYQGPATGLIVERERLDKFGRPLLGATVKPKLGLSGKNYGRVVFEGLKGGLDFLKDDENINSQPFMRYRERFLYSMEGVNHAAATTGEVKGHYLNTTGATMEDMYERANFAKELGSVIVMIDLVIGYTAIQSMAKWSRDYDVILHLHRAGNSTYSRQKTHGMNFRVICKWMRMSGVDHIHAGTVVGKLEGDPLMIKGFYNTLLDFKTDVNLPQGLFFAQDWASLRKCVPVASGGIHCGQMHQLINYLGDDVVLQFGGGTIGHPDGIQAGATANRVALECMVVARNEGRDYIAEGPQILRDAAKTCGPLQTALDLWKDITFNYASTDTADFAETPTANV

SEQ ID NO: 3829 - protein, 344 aa, Oenococcus oeni MCW
MEKAKAENFDWPNLGFNYYDLPYSFHAEYKDGKWDEGKLTSDSTIKMSEAANVLHYGQEAFEGLKAYRRKDGGVNLFRPDMNAKRLHNSAERLLMAPFPEDRFVEAVKMVVKANQNFVPPYGSGATLYIRPFIIGTGEVIGVHPADKFQFHILVTPVGPYYKGGMKPTEYVTSPYDRAAHGGTGQSKVSGNYAASLLPGSLAHKNGYSDVVYLDPRLHENIEELGGANFFGITKDGKFKTPKSPSILPSITKKSLLQIADSFGMEPEETTISIYDLDQFSEAGAMGTAAVISPVGSITHNGNKHVFYSETEVGSYTQKLYDRLSGIQDGDQKGPDGWQVDVPLK

SEQ ID NO: 3830 - protein, 491 aa, Fragaria x ananassa
HEWKLNGYIVSDCDSVGVFYDQQHYTRTPEEAAAEAIKAGLDLDCGPFLAIHTEGAIKAGLLPEIDVDYALANTLTVQMRLGMFDGEPSAQQYGNLGPRDVCTPAHQELALEASRQGIVLLQNNGHTLPLSTVRHRTVAVVGPNSDVTETMIGNYAGVACGYTTPLQGIGRYTKTIHQQGCTNVACTTNQLFGAAEAAARQADATVLVMGLDQSIEAEFRDRTDLVMPGHQQELVSRVARASRGPTVLVLMSGGPIDVSFAKNDPKIGAIIWVGYPGQAGGTAMADVLFGTTNPSGKLPMTWYPQDYVSKVPMTNMAMRAGRGYPGRTYRFYKGPVVFPFGLGLSYTTFAHSLAQVPTSVSVPLTSLSATTNSTMLSSAVRVSHTNCNPLSLALHVVVKNTGARDGTHTLLVFSSPPSGKWAANKQLVGFHKVHIVAGSHKRVKVDVHVCKHLSVVDQFGIRRIPIGEHKLQIGDLEHHISVEANVGEIRS

SEQ ID NO: 3831 - protein, 318 aa, Carica papaya
MENFPVIDLSKLNGEERASTMELIHDACENWGFFELVNHGISHDLMDTVERLTKEHYKKCMEQRFKEMVESNGLEAVQSEINDMDWESTFFLRHLPASNMHEIPDLEDDYRKAMKEFAVGLQKLAEQMLDLLCENLGLEKGYLKKVFYGSKGPNFGTKVRNYPPCPKPDLIKGLRAHTDAGGIILVFQDDKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 3832 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFSEQEAAELTKRIQNAGTEVVEAKAGGGSATLSMGQAAARFGLSLVRALQGEKGVVECAYVEGDGQYARFFSQPLLLGKNGVEERKSIGTLSAFEQRSLEG

SEQ ID NO: 3833 - protein, 606 aa, Arabidopsis thaliana
MDTKIGSIDDCKPTNGDVCSPTNGTVATIHNSVPSSAITINYCDATLGRHLARRLVQAGVTDVFSVPGDFNLTLLDHLMAEPDLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLDDAHEQIDKAISTALKESKPVYISVSCNLAAIPHHTYSRDPVPFSLAPRLSNKMGLEAAVEATLEFLNKAVKQVMVGGPKLRVAKACDAFVELADASGYALAMMPSAKGFVPEHHPHFIGTYWGAVSTPFCSEIVESADAYIFAGPIFNDYSSVGYSLLLKKEKAIVVQPDRITVANGPTFGCILMSDFFRELSKRVKRNETAYENYHRIFVPEGKPLKCESREPLRVNTMFQHIQKMLSSETAVIAAETGDSWFNCQKLKLPKRYEFQMQYGSIGWSVGATLGYAQASPEKRVLAFIGDGSFQVTVQDISTMLRNGQKTIIFLINNGGYTIEVEIHDGPYNVIKNWNYTGLVDAIHNGEGNCWTAKVRYEEELVEAITTATTEKKDCLCFIEVILHKGETSKELLEWGHASLLLTAVLPNPQ

SEQ ID NO: 3834 - protein, 299 aa, Streptococcus pneumoniae
MTSKVRKAVIPAAGLGTRFLPATKALAKEMLPIVDKPTIQFIVEEALKSGIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMNDYEKTHASTIAVMPVPHEDVSSYGVIAPQGEGSNGLYSVETFVEKPAPEETPSDLAIIGRYLLTPEIFEILEKQAPGAGNEIQLTDAIDTLNKTQRVFAREFTGTRYDVGDKFGFMKTSIDYALKHPQVKDDLKNYLIQLGKELTEKE

SEQ ID NO: 3835 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEFARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 3836 - protein, 318 aa, Cyanidioschyzon merolae
MWQLKLYRDMVLGRKFEDQCAQMYYRGKMFGFVHLYNGQEAVSTGVIQALAEHDYVCSTYRDHVHALSKGVSPKEVMAELFGKQTGCSKGRGGSMHLFSAPHRFLGGFAFIGEGIPIALGAAFSSLYQHNLWGVPMSVTACFFGDGTSNNGQFYECLNMAVLWKLPMIFVVENNQWAIGMAHHRSTSEVEIYEKAKMFGMPALEVDGMDVLAVHEVAKEAVERARSAKGPTLIEALTYRFRGHSLADPDELRAKQQKAIWMARDPITQLSSWLIEQELVTQEQLDKIHREIDIIISDAVQFALSSEEAKDLYQYVYAS

SEQ ID NO: 3837 - protein, 809 aa, Corynebacterium glutamicum ATCC 13032
MGFIFRHFPLNSSAMTENQPLPADLVGSHVRAAAGTPADLATDRKFWTGLSRAVQERIADDWERTREAYGAARQQHYFSAEFLMGRALLNNLTNLGLVDEAAAATRELGHEITDILEIENDAALGNGGLGRLAACFLDSAVTQDYPVTGYGLLYRFGLFRQSFNEGFQVEKPDPWREEEYPFTIRRASNQLVVCFDDMKTRAIPYDMPITGYGTHNVGTLRLWKAEPWEEFDYDAFNSQRFTDAIIERERVSDICRVLYPNDTTYEGKKLRVRQQYFFTSASLQAMIQGHLAHHKDLSNFAEFHSVQLNDTHPVLAIPELMRLLMDEHDMGWEESWAIVSKTFAYTNHTVLTEALEQWDQQIFQQLFWRVWEIITEIDRRFRLERAADGLDEETIDRMAPIQHGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYEPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 3838 - protein, 438 aa, Pyrococcus furiosus DSM 3638
MRVEEFLKQKGIEVGDYVRIIKVEDGEKVEYEGIVMPPYELSEGDTVVIKLDNGYNIGIAIEKIQEINVIEKAKAKPEVHFKAELEPRKELPTITILGTGGTIASRIDYETGAVYPAFTAEELAKAVPEIFEIANIKPKLLFNIFSEDMKPKHWIEIAHETAKALNSGNEGVVIAHGTDTMGYTAAALSFMLRNLTKPVVLVGAQRSSDRPSSDAAMNLICATRMAVSDAAEVMVVMHGETSDTYCLAHRGTKVRKMHTSRRDAFRSINDIPIAKIWSDGKIEFLRDDYRKRSEGEVWVDDKLEEKVALVKVYPGMSAELIDFLVDKGYKGIVIEGTGLGHTPSDLIPSIKRAVDEGVAVCMTSQCLYGRVNLNVYATGRKLLKAGVIPCEDMLPETAYVKLMWVLGHTNDLREAKKMMLTNYAGEITPYTKPNTFLI

SEQ ID NO: 3839 - protein, 198 aa, Halobacterium sp. NRC-1
MNVVVVDNYDSFTYNLVEYLSAQPRDDHAPDVTVLKNTASLAAVRAADPDAVVISPGPGHPDTPRDVGVTTDVLRAVSPRVPTLGVCLGMEAAVHEYGGTVGRAAEPMHGKTTPVSHDETGIFADIQQDFPAARYHSLVCTSIPSCFAVTATTRDGSLPMAIRHRDHPLACVQFHPESVLTGVGHDVIGNFLDAAAAH

SEQ ID NO: 3840 - protein, 489 aa, Thermobifida fusca
MTTIEREARIVEQVPKQVCIGGHWRDAQSGATFKVEDPATGSVLCEVADAGVADGMAALEMAAATQPTWAEYPPRERGEILRRAYELLMHRQEDLAVLMTLEMGKPVAESKGEIAYAAEFFRWFSEEAVRIDGSYSVAPNGQSRLLVMRQPVGPSLLITPWNFPMAMGTRKIGPAIAAGCTMILKPAQQTPLSALALADILHEAGLPEGVLSVLPTTDAAGLTGPLLRDGRLRKLSFTGSTPVGRALIKQSADQVLRTSMELGGNAPFLVFDDADLDAAVAGALQAKMRNIGEACTAANRFYVQSGVAEEFSRRLAERMAGLRMGRGTEPDVDVGPLIDDKARTKVQSLVDDAANRGARVLLGGKRGDGAGYFYHPTVLTDVPKDSEVCRTEIFGPVAPVIPFDTEEEALAEANRTEFGLVSYVYTENLRRALRMAEKLESGMVGLNQGIVSNPAAPFGGVKHSGLGREGGRVGIDEYLETKYVGIAGV

SEQ ID NO: 3841 - protein, 273 aa, Glycine max
  unsure (1)..(273): unsure at all Xaa locations
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPAFNVINGGSHAGNKLAMQEFMVLXHVGASSFXEAMKMXVEVYHNLKSVIKKKYGQDAINVGDEGXIAHFAPNIQENKGXDTIKLLKTAIAKAGYIQANRQSLELLKTDTSIACQKRQCCH

SEQ ID NO: 3842 - protein, 525 aa, Oryza sativa
MVTQLTYLAASAGVCLASALAIALLSIALYIIGVVASFAVLCAKEFAERAHDRPPLVGTVFRQLKNFDRMFDEHVNYATAHRTSRIVYPGHCEVFTSDPAVVEHVLKNSFSKYSKGDFLTTAMKDLFGDGIFATDGDMWRHQRKLASYEFSTKVLRDFSSDTFRRNAAKLAEKISCAAANRISINIQDLLMRATMDSIFKVGFGFELNTLSGSDESGIQFSKAFDEANSLVYYRFVDIMWKLKRYLNIGSEAKLKRNIQIIDSFVMKLIHQKREQMKIAADYKTKEDILSRFVLASEQDPGTMDDRYLRDIVLNFLIAGKDTTGNTLTWFFYLLCKNPIVQDKVALEIREFVEWSKEDNTIESFTKRLDEGAISKMHYLQATISETLRLYPAVPVDAKMADEDDVLPNGYRVVKGDGINYMIYAMGRMTYLWGEDAQEFRPERWLVNGVYQQESPFKFVSFNAGPRICLGKEFAHRQMKIMAATLIHFFKFRLEDESKEPIYKTMFTLHIDNGLHLLANPREISP

SEQ ID NO: 3843 - protein, 468 aa, Undaria peterseniana
IPYAKMGYWDADYNVKDTDILALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPFAYLKTFQGPATGVIVERERLDKFGRPFLGATVKPKLGLSGKNYGRVVYEGLCGGLDFLKDDENINSQPFMRWKERYLYCMEGVNRAAAATGEVKGSYLNVTAATIEQMYERAEYAHAIGTVIVMVDLVIGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLFYLGDDVVLQFGGGTIGHPDGIQSGATANRVALESMVLARNEGRDYVGEGPQILRNAAATFGALKAALDLWKDITFEYTSTDTPYFVELPTESK

SEQ ID NO: 3844 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 3845 - protein, 542 aa, Zea mays
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVLHTEILDEQEKLDGMVAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKTDAGYPAGIGVRNSLFVLAASNMLGFVLTFLVPESKGKSLEEMSGEAEDSEEEPVGARAVRPSETQMV

SEQ ID NO: 3846 - protein, 500 aa, Pseudomonas fluorescens
MNTLPSQVWRTNIGSAPSQLLNYIDGNFVTSASSFANINPVNGKLISDVFEADAKQVNEAVVAAQNALKGPWGKLSVQDRAALIHKIADGIQARFEEFVAAEVADTGRPVHQARTLDIPRAIANFRTFADLAKTSHTDLFEMSTSDGSGALNYTVRKPLGVIGVISPWNLPLLLFTWKVAPALACGNTVVAKPSEESPSSATLLAEVMHDAGVPPGVFNLIHGFGKDSAGEFLTQHPGISALTFTGESKTGSTIMKAVADGVKEVSFELGGKNAAVVFADADLDAAIEGVLRSSFTNSGQVCLCSERVYVHRSIFDEFVSGLKVEAERLVVGYPDQDGVNMGPLISHGHRDKVLSYYRLAVDEGATVVTGGGVPKFNDERDQGAYVQPTIWTGLSDKARCVTEEIFGPVCHISPFDDEDEVINRVNDSNYGLACAIWTTNLSRAHRVSRQIHVGLVWVNTWYLRDLRTPFGGVKLSGLGREGGRFSMDFYSDIANICIKI

SEQ ID NO: 3847 - protein, 198 aa, Streptococcus pneumoniae
GIEDILVVTGKSKRSIEDHFDSNFELEYNLKEKGKTDLLKLVDKTTDMRLHFIRQTHPRGLGDAVLQAKAFVGNEPFVVMLGDDLMDITDEKAVPLTKQLMDDYERTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 3848 - protein, 843 aa, Synechocystis sp. PCC 6803
MRAVLMAGGAGTRLRPLTCDLPKPMVPIVNQPIAAHIIHLLRRHNITEVVATLHYLPDAMRDYFLDGSEFGVQMTYAVEDEHPLGTAGCVKNIEELLDDTFLVISGDSITDFNLTQAIAFHKQKQAKATLILTKVPNPLEFGVVITDENQRVQRFLEKPSTSEVFSDTVNTGTYILEPEVLAYLPPKEEMDFSKDLFPLLLENDEPMYGFVADGYWCDVGNLDAYREAQYDALEKKVTLELGNLPRHSDIWIGENTTIDPTAILTPPLAIGDNCNIGSGTKLEAGTIIGDNVTIGAGAELKRAIVWNGVLIGDEAYLAACVVGRGCRIERRVQVLEGAVIGPLSIIGEEAQINSNVKVWPSKRVEPGAILNINLIWGSTGHRNLFGQRGVSGIVNIDMTPEFAVKLGAAYGSSLRPGAEIVVSRDQRNVSRMVTRSLIAGLMSVGVNIQNLEATAIPIARTMTPKLKVAGGIHVRIHPDRPDYLLIEFLDSQGINISKKTEKKIEGAYFKEDLRRVSIPQIGDMSYPAQVLETYCHTFEKLLDMDIINNDGAKIVIDYAYGVSGAILPLLLTKFGCDAVVLNASLRQTAVSNEEKEVLLSQLGQVVSALQANLGVQVSANGEQLTLVDEGGLPIRGELLTALMVHMVLTASPRGTIVVPVQASSAVEHLARRHGGKVLRTKANPTALMAAAQSSHNVVLGGSGETGFIFPRLHPGFDAMFCIAKVMEMLTVQKRTLGEIRSELPTVYHNSCSVRCSWKIKGALMRHLVEIHRDQHIELVDGVKMTFPHGDNWVLILPDAGEPLVHIYANSEDRHWVDEKLRYYQAQVLNFISDAQEESYQHFS

SEQ ID NO: 3849 - protein, 471 aa, Herbaspirillum seropedicae
MARTAAEVLKMVKDNEVKFVDFRFADTRGKEQHVSVPVSHFDIDKFESGHAFDGSSIAGWKGIEASDMLLIPDPNTANIDPFMEETTLFMQCDVIEPSDGKGYDRDPRSIAKRAEAYLKSSGLGDTAYFGPEPEFFIFDGVRWGADMSGSFVKIDSEEASWSTGAKIEGGNSGHRPTVKGGYFPVPPVDSFQDMRSEMSLIIESLGIPVEVHHHEVAGAGQNELGTKFSTLVERADWTQTMKYVIWNVAHTYGKTATFMPKPLVGDNGSGMHVHQSVWKDGKNLFAGDGYAGLSEFALYYIGGIIKHAKALNAITNPGTNSYKRLVPGFEAPVKLAYSARNRSASIRIPHVANPKGRRIETRFPDPLANPYLCFSALLMAGLDGVQNKIHPGEAATKDLYHLPPEEDKLIPTVCSSLDEALEHLDKDREFLTRGGVFTDSMIDAYIDLKMQEVQRFRMTTHPIEFDMYYSL

SEQ ID NO: 3850 - protein, 356 aa, Nicotiana tabacum
MENNYNQLGENSSQRGNNFLYGGIPLLSSPNSSYLWKNKWRRRRSDCYDQSQAVVHPIVKTEGGSSTSHHHHTFQYPSIIRSGYHHQTVQNHHESESSGSEVDALKAKIIAHPQCSNLLDAYMDCQKVGAPPEVVARLSAVRQEFEVRQRDSSTDRDVSKDPELDQFMEAYYDMLVKYREELTRPLHEAMDFMRKIETQLNMLEDKCEGVGSSEEEQDNSGGETEIPEIDPRAEDRELKNHLLRKYSGYLSSLKQELSKKKKKGKLPKDARQKLLSWWELHYKWPYPSESEKVALAETTGLDQKQINNWFINQRKRHWKPSEDMQFMVMDGLHPQNAAALYMEGHYMGEGPFRLGQ

SEQ ID NO: 3851 - protein, 331 aa, Thermus thermophilus
MKVGINGFGRIGRQVFRILHERGVEVALINDLTDNKTLAHLLKYDSTYGRFPGAVGYDEENLYVDGKAIRATAIKDPREIPWKQAGVGVVVESTGVFTDGEKARAHLEAGAKKVIITAPAKNEDITVVLGVNHEQYDPAKHHILSNASCTTNSLAPVMKVLEKAFGVEKALMTTVHSYTNDQRLLDLPHKDLRRARAAALNIIPTTTGAAKATALVLPSLKGRFDGMALRVPTPTGSISDITALLKREVTAEEVNAALKAAAEGPLKGILAYTEDEIVLRDIVMDPHSSIVDGKLTKAIGNLVKVFAWYDNEWGYANRVADLVELVLKKGV

SEQ ID NO: 3852 - protein, 436 aa, Azotobacter vinelandii
MTLRKGAGSCCPFFPLPAPSWPAAQEATLDSGDTAWMLTATALVLFMTIPGLALFYGGMVRSKNLLSVMMQCFAITGLISVLWVLFGYSLAFDTAGMEEGVLNFSSFVGGLDKAFLSGLTTDSLVGTFPESVFITFQMTFAIITPALITGAFAERMKFSSMLVFMSAWFLLVYAPIAHMVWSGNGALMWDWGVLDFAGGTVVHINAGVAGLVACLVLGKRKGYPGVAMTPHNLGYTLVGAAMLWVGWFGFNAGSRSRNGTAGMAMLVTQIATAAAALAWIPAEWLTHGKPSPGHRLRRGRAWWHHPGRGTVGPMGALVIGLASGSICFYCATAVKRRFGYDDSLDAFGVHGVGGIVGAVLTGLFAAPALGGFGEIDSIASQLWIQIKGVLFTVIYTGVATFVILKAIERVIGLRISEEEETMGLDLSLHNERGYNL

SEQ ID NO: 3853 - protein, 849 aa, GIBBERELLA ZEAE PH-1
MAMLASKAAFPAGMGSSSHTPVASQPAMPLPRRTPMMPSSGAYGSPTESEFTEHDPAESVKNWDEDQVCEYLRTVKCGEYEKIFRKNHINGENLLEMDKDVLKEMGVEKVGDRVRLFLSIKKLRTRAYANEKKRNRDSFGGLDIQITAPNDSPRLHSSRGVPASSSKRYSRQLDLYGALDNGKTSSRPNSPLPGTDVRNLRARGKTYASIPVNAQGQRIVTTNPDLPANRLVTTHTRNNSSMDGSLMAALPQGQEVIRVISTGGVTKVVKISGCNTCEEVMRVTLRKFALREDHERNYCFWVLAGIDPDPGQCRRLGDTELWRIIKDQRRPERNRLILRRVPAGEPGEAELHRAAAIAMEEEQQKHARALETVDKRRSLRPFGGLRPPSELIASDLTSYFPDHTREDIDRTARLSMRRSTRMSKVNSRLSVASNLSFASSIQDAPPIPTIADSWLNANTQLAKVRTRDSHIRVPQAAYNRDSVTSSVLDTLQEESSLEPDRKSYVSFTESGSDSAPVSVTDPEGNTTATSYYDGDTSTGSGSFQEIRQALTNDGDDVDEELHSFLAGESWGDDKWMKGALIGQGSFGCVYLALHAVTGELLAVKQVETPAPGANSQGDNRKKGMIDALKREISLLRDLRHPNIVQYLGCSSTADYLNIFLEYVPGGSVQTMLNSYGALPEPLVRSFVRQILTGLSYLHNQDIIHRDIKGANILVDNKGTIKISDFGISKKLEATNILNGANNSKHRPSLQGSVFWMAPEVVKQTSYTRKADIWSLGCLVVEMMTGSHPFPDCSQLQAIFKIGGGKAAPTIPEHASEAAKEFLAQTFEIDHNLRPSADQLILSPFLIPIT

SEQ ID NO: 3854 - protein, 482 aa, Nicotiana tabacum
MATTQNRRNSVSSAVAKRQAMAENNHGKLPAGGAKKRPALTNISNHTTASARNSLSHSSKLAPCTSKVVSIKKNNSNAASSVLPTSSSFVKPISKTVSLPRSDAAVPKITAIPPLPSTCSMDISPSHSDGSLVSMDETMSTSNSLRSPDVEYIDDNQTAAFDSIEKKAFSTLYISEDVKAADICKRDVLVDMESGDKIANIDNNLVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVMALHSLCCNNNNSSLPAIREKYSQHKYKFVAKKYCPPTIPVEFFQNISC

SEQ ID NO: 3855 - protein, 567 aa, Synechocystis sp. PCC 6803
MMLISQPMADRPLSWSGLSRRPWRRQLAVTRVFLLFVFFLSWDRLTAPRSAQRRYRRAQWLVQQLLYLGPTFIKIGQSLSTRADIIPAEYIEAFTQLQDRVPPFDSRQAIAVIEQELHGAIDEIFQQFEVTPLASASLGQVHRAVLPTGEAVVVKVQRPGLDSLLNLDFELLHQTLRLAKRWLPGFRRLAQKYEIEAIYQEFFSLLFLEIDYIHEGKNAERFRQNFADYPRVRVPEIYWQYTTRMVLTLEYLPGIKVDDRQALETAGINLDLVIQTGICAYLKQLLVDGFFQSDPHPGNMAVDSQGDLIFYDFGTMAEVKIIAKDQMVQTFFAVLRKDTNQVLEALIYMGLVEPKGDLSPIKRIINFLLDNFRDKPIDIKAFDQVGEEVYAMFQQQPFRLPPQMTFILKSISTLDGIARALDPRYNLIAASQPFIQSITVAQPKRSLAMALLQQVKQFALDQLNRPSRNQQFLQELAAKLERGELQFATRSPEGDRLLRKIHLALKSLIFACLTGFTLLSATVLLSTVYARFAVVGFGLAGLFGLFLLRSLIKLAVQEKLDRLVQKR

SEQ ID NO: 3856 - protein, 231 aa, Glycine max
  unsure (1)..(231): unsure at all Xaa locations
SWTLADRDHAWQVSDTTAECXKWGLLLSVLPQDIVGEKMELEKLHDSINLILSLQSKNGGMTAWEPAGAYKWLELLNPTEFFADIVVEHEYLECTASAIQVLVLFKKLYPEHRKEEIENFIAKAVTFIEDTQLXNGSWYGNLGXCFTYSSWFXLGGLVAAGKTYTNCVTIRKAVKFLLKIQNKDGGWGESYLSCPRKMYLPLEGSRSNVVQTSWALMALIHAEQVLFLMST

SEQ ID NO: 3857 - protein, 764 aa, Pisum sativum
MWKLKIGDGGKDRNIFSTNNFVGRQTWEFDPDAGTSQEKAQVEAARQHFYDNRFEVKACSDLLWRFQILKEKNFKQTIESVKIKDEEEISEENVAITLRRAVHHLSTLQSNDGHWPALNAGPLFYFPPLVFCMYVTGHLDSIFPYEYRKEILRYIYCHQNEDGGWGLHVEGHSIMFCTVLNYICMRILGEGPNGGKEDACARARKWIHDHGSVTHVSSWGKIWLSVLGIFDWCASNPMPPEFWMLPSFLLKHPAKMLCYCRLVYMPMSYLYGKRFVGPITPLILMLREELLTQPYEKVNWKKTRHLCAKEDLYYPHPLIQDLIWDSLYIFVEPLLTHWPFNKLLREKALQTVMKHIHYEDENSRYITIGCVEKVLCILACWVEDPNGDAFKKHLARLPDYLWVSEDGMTLHSFGSQTWDASLIIQALLATNLIEDVGPILTKAHEFIKKSQVRDNPSGDFKSMYRHISKGSWTFSDKDHGWQVSDCTAESLKCCLLLSMLPPEIVGEKMEPEMLYDSVNILLSLQGKKGGLPAWEPSEAVEWLELFNPIEFLEEIVVEREYVECTSSAIQALVLFKKLYPEHRKKEVENFIANAVRFLEYKQTSDGSWYGNWGICFTYGSWFALNGLVAAGKTYDNCAAIRKGVEFLLTTQREDGGWGESHLSSSKKIYVPLERSQSNIVQTSWAIMGLIHAGQMERDPTPLHRAVKLIINFQQEEGDWPQQELTGVFMKNCMLQYAMYRDIFPTWALAEYRRRILLASPAVAI

SEQ ID NO: 3858 - protein, 466 aa, Batrachospermum helminthosum
LCKMGYWDPDYIIKETDVLALFRITPQPGVDPVEAAAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERFLFSIEGVNRAQAATGEIKGHYLNVTAATMEDMYERAEFAKELGSIICMIDLVVGYTAIQTMAVWARKADMILHLHRAGNSTYSRQKIHGMNFRVICKWMRMAGVDHIHAGTVVGKLEGDPLMIKGFYNTLLMSHLDINLPQGIFFEQDWASLRKVTPVASGGIHCGQMHQLLDYLGDDVVLQFGGGTIGHPDGIQAGATANRVALESMVLARNEGSDFVNEGPQILRDAAKTCGPLQTALDLWKDISFNYTSTDTADFVETPTANV

SEQ ID NO: 3859 - protein, 187 aa, Salmonella typhimurium LT2
MILLIDNYDSFTWNLYQYFCELGAEVQVRRNDALTLAHIDALNPQKIVISPGPCTPNDAGISLAVIRHYAGRIPMLGVCLGHQAMAQAFGASVVRAAKVMHGKTSPVTHNGQGVFRGLPSPLTVTRYHSLIVDPATLPECFEITAWSETQEIMGIRHREWDLEGVQFHPESILSEQGHALLKNFLRR

SEQ ID NO: 3860 - protein, 238 aa, ASPERGILLUS NIDULANS FGSC A4
MRAHPQSAVGLMSMGGKGPEVLSTFTTDFGGILAGLHRTKIHGTAHFTSSIQVAGLALKHRSEKSQRQRIIVFSCSPIAEDEKTLVKLAKKMKKNNVSIDVIAFGDLESDQTKKLEAFVENVKGGDGSNLAIIPPGPNLLSEELQASPILGGDGSGGAGGLGGGDGGDGGAFDLDAAAENDPELAFALRLSLEEEKNRQEKERREREAQQGKENLEGIPEEGSSSKKDNEDPDKMDTA

SEQ ID NO: 3861 - protein, 611 aa, Zea mays
  unsure (1)..(611): unsure at all Xaa locations
MDLDARHRHTPDSSSSPHAASDMGLPLAGAAYQPYVSELLSFSIERLHKEPELLRVDAERVRRQMQEVAVENYGAFIAASEALSFVRAQLESFDGHLEAMIEEIPNLTSGCTEFVESAQQILEERKLNQTLLANHTTLLDLLEIPPLMDTCIRNGNYDEALDLEAFVSKISKLHPDLPVVQGLAAEVKKTVQSLISQLLQKLRSNIQLPECLRIVAHLRRIGVFSESELRLQFLRCREAWLSGILEDLDQRNVYDYLKGMVTCHRVHLFDVVNQYRAIFNNDKSGNDENSEGGLLFSWAMQQVSNHLATLQVMLPSITEGGSLSNILEQCMYCAMGLGLVGLDFRGLLPPIFEEXLVFKLLNFITDSKGALLLMLLSAFCSAVLNLFSKNMSMAVENFQVVLDSHRWVPMPSVGFVANGVVDDTSDDVTPPSVLMEHPPLAVFVNGVSAAMNELRPCTPLSLKVVLAQEVVKGLHAVSDSLVRYKAMRMLRGNESALFLSLCQAFIEVVHPYCAACFGRCYSNGATLISECQGTLDAVRQLLTIPARSNSSSIERKQSGAIERKQSVESSGTAVTYNELSADGPGLEINDAATTTTPPVEDDVSTHPPGSK

SEQ ID NO: 3862 - protein, 310 aa, Staphylococcus carnosus
GFGRIGRLAFRRIQDVEGIDVVAVNDLTDDEMLAHLLKYDTMQGRFTEEVEVVDGGFRVNGKEVKSFEEPDASKLPWKDLDIDVVLECTGFYTSEEKAKAHIDAGAKKVLISAPATGDVKTIVYNVNQDTLDSSDVIVSGASCTTNSLAPVAQVLNDSFGLVEGFMTTIHAYTGDQNTQDGPHRKGDKRRARAAAENIVPNSTGAAKAIGKVIPEIDGKLDSGAQRVPVATGSLAELTVVLDKDVTVDEVNEAMKQASNESFGYNEDEIVSSDVVGMTFGSLFDATQTRVMTVSGRQLVKVAAWYDNEMS

SEQ ID NO: 3863 - protein, 308 aa, Zea mays
MAAAPPGEMASDDDRSVAADSWSIKSDYGSTLDDDQRYSDTAEVLLASSSASSVAAPSTTVAVHPSSDFSFDKDVHDSSYVEPPLLGLQNFQDGAYAEDLANFHERSHADDWFGTDIMDIRVGWTKNLCSSRDLPSCSVLDIGTGSGRLLQQLAKQGFSDLTGIDYSESAIELARSLAIGDGFEHINFLVDDVLESKLERRFELVMDEGTLDAIGLHPDGPVKRMMYWQSVDSLVSRGGILVITSCSRTKDELVQEVENFNQRKLGAVGSGSEGLPASEAAVFSYLDHVQSYPSVDSSCITTVAFLHK

SEQ ID NO: 3864 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRPEEDDRVRMTPHPVEFELYYSV

SEQ ID NO: 3865 - protein, 348 aa, Pichia stipitis
MSIPTTQKAVIFETNGGPLLYKDIPVPKPKPNELLINVKYSGVCHTDLHAWKGDWPLDTKLPLVGGHEGAGVVVALGENVTGWEIGDYAGIKWINGSCLQCEYCVTAHESNCPDADLSGYTHDGSFQQYATADAIQAARIPKGTDLALIAPILCAGITVYKALKTAQLQAGQWVAVSGAAGGLGSLAIQYAKAMGYRVVGIDGGADKGEFAKSLGAEVFVDFLSSKDVVADVLKATNGGAHGVINVSVSERAMQQSVDYVRPTGTVVLVGLPAGAKVSASVFSSVVRTIQIKGSYVGNRADSAEAIDFFTRGLIKCPIKIVGLSELASVYELMEQGKILGRYVVDTSK

SEQ ID NO: 3866 - protein, 411 aa, Oryza sativa
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATVRFCALHSL

SEQ ID NO: 3867 - protein, 52 aa, Glycine max
MAKHHPDLIMCRKQPGIAIGRLCEKCDGKCVVCDSYVRPCTLVRICDECNYG

SEQ ID NO: 3868 - protein, 242 aa, Polarella glacialis
LKYMVYMLKYDSVHKRFEGTVACEEVDGKEFLLVNHKRIAVFHEKDPACIPWGESGADYICESTGVFTAQEKAELHLKGGAKKVIISAPPKDAVPIYVVGVNHHEYKATDTVVSNASCTTNCLAPLTKVINDKFGIVEGLMTTVHAMTATQLTVDGPSRGGKDWRGGRCASQNIIPSSTGAAKAVGKCLPEMNGKLTGMAFRVPTPDVSVVDLTVRLEKPAKYEDIVAAVKEAAAGPMKGVL

SEQ ID NO: 3869 - protein, 338 aa, Zea mays
  unsure (1)..(338): unsure at all Xaa locations
MAKIKIGINGFGRIGRLVARVALQSDDVELVAVNDPFISTDYMTYMFKYDTVHGQXWKHHEVKVKDSKTLLFGEKEVAVFGCRNPEEIPWGSVGAEYVVESTGVFTDQEKAAAHLKGGAKKXVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 3870 - protein, 594 aa, Schizosaccharomyces pombe
MNSYVLTSQVLVYNYSKRKNYWHFWLRSFMSNNRKFLVHIHLIPHLNSLYSICFLGFPGQELLVASDHIQKRNHHKPAVVGASITLMASVALVDFDPVKHAGVSSKRAYRVVLAGFLCFSDYKKVLGSSYASEEERQLALSECHLRCAERSLKVFEENGGIYIKIGQHLSAMGYVIPKEWTNTMVKLQDRCPSTSLKDIDHLFRVDTGKGLDETFDEFDPIALGVASLAQVHKARLKDSDVWVAVKVQHPSVSLNSPLDLSMTRWVFKAIKTFFPDFKLMWLADEIERSLPQELDFTREAKNSIETKEHFAHLSTSLYVPEVMWSKPRILVMEYVAGARIDNLSFMDEHSISRDLVSVDICHIFNEMIFGKGGHLHCDPHGGNVLIRSKPKNSKSPRNYEIVLLDHGLYRDIPHELQVDYANMWLNIINFNEKNLKFYAKKVANVSDENFPIFATAITGRPYKSLKSLPIGGPNHEEEQKKFISALQKGGMLQSIIRLLSTMPRLTLLLMKTNDLVRSLDENLKTKSGPEKLYLIMARYCLRCVYDDKMDSLWNSRSFWVSKVFKGTYYRLSYLFSSLKYTLAENYFYYKHMYL

SEQ ID NO: 3871 - protein, 267 aa, Glycine max
MSSMLRFPFSFLQPQRPQFPRPFTAFAAAAAVSSSDRSFLRNALNSFFSVNPSMPLLGSLSLADSGVCVVEAKTGTSFPSVLDSSQKLCGIGLRKKNVLGLKNIDVYAFGVYATDEDIKRHLSEKYGKLSASELQGNKEFTEDLMESDISMTIRLQVVYGRLSIRSVRSAFEVSVGSKLQKFGGSDNKELLQRFTSQFKDEFKIPRGSVIHLSRDKGHVLRTSIDGQEVGSIQSKLLCKSILDLYFGEEPFDNQAKEEIELNMASYL

SEQ ID NO: 3872 - protein, 339 aa, Desulfovibrio desulfuricans G20
MKKVRVGINGFGRIGRQVLKTIWERHRDTVDVVAVNDLFDINTNAHLLSHDTNYRGFAPEVSVDGDIMRVGGDFVIKNYAERDPRAIPWGAMDVDIVIESTGIFTSGPKAAMHLEAGAKKVVISAPAKEEDITVVLGVNHQDYDPAKHRIISNASCTTNCLAPVVKVMHENFGIQKGVMTTVHSYTNDQRILDQPHRDMRRARAAACNMIPTSTGAAKAVALVIPEMKGRFEGYSVRVPTPTVSLVDFVAILERETTTEELRATLKNAAQGSLNGILGYSELPLVSSDFIGDPHSGIVEADFTLVQTGNLAKVYVWYDNEWGYSCRVADLVEYMRERGL

SEQ ID NO: 3873 - protein, 387 aa, Gossypium hirsutum
MVHCLPKVFVIQDKPMLPSTAAVAKDEHRPLAFDASILGSESNIPSQFIWPDDEKPCLDAPALVIPTIDLGAFLLGDSLAVSKAAEVVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPIPGAFVVNVGDTFMALTNGFYKSCLHRAVVNTETVRKSLAFFLCPKLERPVTPAAGLVTAENPRKYPDFTWAALLKFTQNHYRADMKTLVAFSKWVQEQESNYKLIP

SEQ ID NO: 3874 - protein, 435 aa, Glycine max
  unsure (1)..(435): unsure at all Xaa locations
MGADKFEALTMIGKAACGEVRVCRXKATGHVYAMKKLKKSERLRIGQVEHVKAERNLLAEVDSNCIVKLYYSFQDEEYLYLIMEYLPGGDMMTLLMRKDILTEDEARFYVGETVLAIESIHKHNYIHRDIKPDNLLLDRNGHMKLSDFGLCKPLDCSNLQEKDFSVGMNRSGALQSDGRPVAPKRTQQEQLQHWQKNRRMLAYSTVGTPDYIAPEVLLKKGYGVECDWWSXLGAIMYEMLVGYPPFYSDEPMLTCRKIVNWRTTLKFPEEAKLSAEAKDLICRLLCNVEQRLGTKGADEIKAHPWFKGVEWDKLYQMKAAFIPEVNDELDTQNFEKFEEADNQTLPSSKSGPWRKMLPSKDVNFVGYTYKNYEIVNDPEIPEIAELKKKSTKPKRPSIKSLFDDESATAANQPVRGSFLNLLPPQMEVPEKSESQ

SEQ ID NO: 3875 - protein, 549 aa, Escherichia coli O157:H7
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 3876 - protein, 481 aa, Iridaea cordata
  unsure (1)..(481): unsure at all Xaa locations
QARXKNERYESGVIPYAKMGYWDPDYVVKDTDVLALFRVSPQPGVDPVEASAAVAGESSTATWTVVWTDLLTACDLYRAKAYKVDVVPNTTDQYFAYIAYDIDLFEEGSIANLTASIIGNVFGFKALKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEEIYERAEFAKELGSIIVMIDLVIGYTAIQSMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGDDVVLQFGGGTIGHPDGIQAGATANRVALESMVIARNEGRDFVSEGPQILQDAAKTCGPLQTALDLWKDISFNYTSTDTSDFVETPTANV

SEQ ID NO: 3877 - protein, 542 aa, Candida albicans
MKLSKSTLIATLALTATSTNALVVQNPFSNIQQALKLDLSYDKLTSKLTDTFEQGKANIISTIAKVMNEPLDGLTPEIKNIWLEMLMKFPNSITELNFKAPPKKGKITTQQFDFHVTDAQVPNHKLRIKSTPKDLGIDTVKQYSGYLDVVDEDKHFFYYFFESRNDPKNDPVILWLNGGPGCSSLTGLFFELGPSSIDKNLKPVYNPHSWNANASVIFLDQPINVGYSYSSQSVSNTIAAGKDVYAFLQLFFKNFPEYANLDFHIAGESYAGHYIPAFASEILTHPERNFNLTSVLIGNGLTDPLVQYEYYEPMACGEGGEPSVLEPEECDGMLNLLPRCLSLIESCYESGSVWSCVPATIYCNNGQMGPYQKTGRNVYDIRTMCEGSSLCYSQLEYIDQYLNLPEVKKALGAEVDEYQSCNFDINRNFMFAGDWMKPYQKNVIDLLEKELPVLIYAGDKDFICNWLGNQAWTNRLEWSGSKGFTKAPVKSWKVGKNAAGEVKNYKHFTFLRVFGGGHMVPYDQPENALDMVNRWISGDYKY

SEQ ID NO: 3878 - protein, 302 aa, Oryza sativa (japonica cultivar-group)
MDASSPFSFHELRRQASSYLTDKIRSARLALTDVTPTQLMTEEATSGDASPPNVKTMSLIARQAFEIDEYVRISDILHKRFARFDRRQWREAYKALLLLEHLLTHGPRSVALEFQRDREVIEQMVSFQHIDEKGSVSILRPDSIISSPDVLSPFFLITDGFFLNPSCSFNWGMTVKSKSERVLRLLERGPFLEDERERARKIAHEIKGFGSFNLSSAHASGSAAAALRAGAMEHQCYGRSNSRYEGRWRREACVDDGDKENLLVVSMAEAKAEAAAEEPHHYHHPFYGFGQQRPEAMLLLSQ

SEQ ID NO: 3879 - protein, 172 aa, Triticum aestivum
  unsure (1)..(172): unsure at all Xaa locations
MDLEFGRGMRSPQRDSWKTTMVLAYQSLGVVYGDLSISPLYVFKSTFAEDIQHSDTNEEIFGVLSFVFWTLTLIPLIKYVSIVLRAHDNGEGGTFALYSLICRHANVSLLPNRQIADEELSTYKLERNPETVDKXRVKVWLEKHKNLHTALLIMVLIGTCMVIGXXVLTPAI

SEQ ID NO: 3880 - protein, 535 aa, Oryza sativa (japonica cultivar-group)
MDISLASLVLVLLAFVLPLLYLLLQLPGKKSGGGGGDGPRLPPSPAGCLPLLGHLHQLGPLPHVALRSMAAAHGPVLRLRLGRVPTVVVSSAAAAEEVLRARDAAFSSRPRSAMAERILYGRDIAFAPYGEYWRQARRVCVVHLLSAQRVSSFRRVREEEAAALADAVRAAGRGGGRAFDLSGLIVAYASAVVSRAAFGDESARGMYGGADGGRAVRKAFSDFSHLFGTKPVSDYLPWLGWVDTLRGRERKARRTFEALDGVLDKVIDDHRRRRDSGRRQTGDADAGHRDFVDVLLDVNEMDNEAGIHLDAIEIKAIIMDMFVAGSDATSKPMEWAMAELVSHPRHMRRLQDEIRAVVGGGRVTEDHVDKLPYLRAALKEALRLHAPLPLLVARETVADTEIMGYHVAARTRVVINGWAIGRDTAVWGETAEEFMPERFLAGGNGGGAAAADYKVQGFEMLPFGGGRRGCPGVTFGMATVEMAVASLLYHFDWEAAAADGKGGREGTPLLDMSETSGISMGLKHGLPLVAKPRFP

SEQ ID NO: 3881 - protein, 527 aa, GIBBERELLA ZEAE PH-1
MKFFSSKRQEHAAEGEHLERRKTPDTDGRITFLACFMGLVASMGGMIFGYSSGQISGYFMMKDYGERFGVPNGDGTYEFSAARQGTITGLLSVGCLFGSLIAGNLCDTIGRRTTISISALWTCVGTVIEVASQHAWYQHAIGRLVTGLGVGALSVAVPMYQSESAPAIIRGIIVSCYQLFVTLGIWCAEMVNWGTNHYDGSASWRIPNGLNFLWALLLGVGILFLPESPRFAYRKGKEEEARKTIANLAGLDINSPSVNRQIDEIREKLEEERSLPETRWVEIFTGPRMMYRTLLGITLQAGQQLTGINFFFYFGTTVFASTGLKDSYVTQLILGSVNCACTFGGLYVVQKCGRRISLMIGAAWMMMCFFIYAFVGHFALDRADPLNTPAAGTVLVTFSCLAIVAFATTWGPLVWAVVAEMYPSQYRSRCMAIATATNWLFNFLIGFFTRFITDAIDYYYGLVYAGCCAALVAIVFFFVIESKDRTLEEIDTMYVQKVNPITSSKWVGHNHASKAAREGVTDEEVSS

SEQ ID NO: 3882 - protein, 498 aa, Spinacia oleracea
MRKAAVGAAVVCTAAVCAAAAVLVRQRMKSSSKWGRVMAILKELDDNCGTPLGKLRQVADAMTVEMHAGLASEGASKLKMLISYVDNLPTGDEHGLFYALDLGGTNFRVLRVKLGGKEKRVVEQEFDEVSIPPELMVGTSEQLFDYIAEALAKFVATESEGLHPEPNKQRELGFTFSFPVKQTSIASGTLIRWTKGFNIEDTVGEDVVAELTKAMLRKGVDMRVTALVNDTVGTLAGGRYYKEDVIAAVILGTGTNAAYVERASAIHKWHGPLPKSGEMVINMEWGNFRSSYLPLTEYDIALDEESLNPGEQIFEKMISGMYLGEIVRRVLYRMADEASLFGDTVPSKLKTPFILRTPDMSAMHHDTSPDLKVVASKLKDVLGIPNSSLKVRKIIVDVCDVIASRGACISAAGILGIIKKLGRDTLKQGENQKSVIALDGGLFEHYAKFRECMEDSLKELLGDEVAETIVIEHSNDGSGIGAALLAASHSQYLEEDES

SEQ ID NO: 3883 - protein, 213 aa, Triticum monococcum
MSMSCGLCGANNCPRLMVSPIHHHHHHHQKHQLCEYQFFAHGNHHHHHHGSAADYPVPPPPDNFDHRRTWTRPFHETAAAGNSSRLTLEVGAGGQHMAHLVQPPARAHIVPFHGGAFTNTISNEAIMTIDTEMMVGPAHYPTMQERAAKVMRYREKRKRRRYDKQIRYESRKAYAELRPRVNGRFVKVPEAMASPSSPASPYDPSKLHLGWFR

SEQ ID NO: 3884 - protein, 720 aa, Microbulbifer degradans 2-40
  unsure (1)..(720): unsure at all Xaa locations
MSEKTLNLIKESEATWLDLRFTDTKGKEQHVTIPASYVDEEFFENGQMFDGSSIAGWKGINESDMILMPDDSTAMLDPFTDEATVILRCDIVEPSTGQGYERDPRSVAKRAEEFLKSTGLGDTAFFGPEPEFFVFDDVKWGADMSGSFVKINSEEAAWSSGSKFTDGNLGHRPRVKGGYFPVPPVDSLHDIRASMCNAMMQMGLDVEVHHHEVATAGQCEIGVKFNTLVKKADEVQILKYCVHNVAHAYGKTATFMPKPIVGDNGSGMHVHQSYWKDGVNQFAGDGYAGLSETALYYIGGIIKHAKAINAFSNPGTNSYKRLIPGFEAPVMLAYSARNRSASIRIPYVPSPKGKRIEARFADPIANPYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLTLLLRYSPIN

SEQ ID NO: 3885 - protein, 277 aa, Zea mays
MGEAASPARPRLVSLLLSTPAPRSHLFHPSLLAAASLSSACNDSHVSVFSSLLRRRPIAQLPHSIHGLRCLSPARATPSKTLLSLPRATLSSFADPDGDGGSSAKASDGGAKAGAGGEEQVGECEMSEMARAFHISPRVATSISVTIAFAALTVPLAMRSLVCHGTFRMNALAYFTLLSGFYMAWNIGANDVANAMGTSVGSGALTLRQAVLTAAVLEFSGAFLMGTHVTSTMQKGILVASAFQGKDSLLFAGLISSLAAAGTWLQVASSYGWPVSL

SEQ ID NO: 3886 - protein, 181 aa, Methanothermococcus thermolithotrophicus
MEPEIKIVNVVVSTQIGTDIDLEYAADILDNAEYEPEQFPGLVCRLSDPKVALLIFRSGKLNCTGAKSKEDAEIAIKKIIKELKDAGMDIIDNPEVNVQNMVATADLGIEPNLDDISTLEGTEYEPEQFPGLVYRLSDPKVVVLIFGSGKVVITGLKKKDDAYLALDKILSTLKELEEEYY

SEQ ID NO: 3887 - protein, 181 aa, Triticum aestivum
MASDGRVERIASSIRAIPNFPKPGILFQDITTLLLDPQAFRDTTDLFVERYKDKDITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDMPVFVLVQADESV

SEQ ID NO: 3888 - protein, 452 aa, Sarcodiotheca gaudichaudii
RTDVLALFRVSPQPGVDPIEASAAVEGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVSERERMDKFGRPFLGATVKPMVVLYMKVLGRVVYEGLRGGLDFLKDDENINSQPFMRWKERFLYSMEGVNRSIAATGEIKGHYLNVTAATMENMYERAEFAKQLGTVIVMIDLVIGYTAIQSMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLNYLGIDVVLQFGGGTIGHPDGIQAGATANRVALESMVLARNEGRDYVAEGPQILLDAAKTCGPLQTALDLWKDITFNYTSTDTADFVETPTANV

SEQ ID NO: 3889 - protein, 291 aa, Streptomyces galilaeus
MKGIILAGGSGTRLHPITVSVSKQLLPVGDKPMIYYPLSVLMLADIREILLICTERDLEQFRRLLGDGSQLGLRIDYAVQNRPAGLADAFVIGADHVGDDDVALVLGDNIFHGHHFYDLLQSNVRDVQGCVLFGYPVEDPERYGVGETDASGQLVSLEEKPLRPRSDLAITGLYLYDNEVVDIAKNLRPSARGELEITDVNRNYLARGRARLVDLGRGFAWLDAGTPESLLQATQYVRTLEERQGVRIACVEEVAVRMGFIDADMCHRLGEQMSQSGYGRYVMAVAREFSG

SEQ ID NO: 3890 - protein, 341 aa, Vibrio cholerae
MLRVAINGFGRIGRNVLRAVYESGKRDRIQVVAVNELAKPDAMAHLLQYDTSHGRFGKKISHDQQHIYVHHQNGEYDSIRILHLSEIPLLPWRDLGVDLVLDCTGVYGCQEDGQQHIDAGAKLVLFSHPGASDLDNTIIYGVNHETLTAEHKIVSNGSCTTNCIVPIIKVLDDAFGIDSGTITTIHSSMNDQQVIDAYHNDLRRTRAASQSIIPVDTKLHKGIERIFPKFSNKFEAISVRVPTVNVTAMDLSVTIKSNVKVNDVNQTIVNASQCTLRGIVDYTEAPLVSIDFNHDPHSAIVDGTQTRVSNGQLVKMLVWCDNEWGFANRMLDTALAMQATQ

SEQ ID NO: 3891 - protein, 415 aa, Polysiphonia akkeshiensis
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIASTGEVKGHYMNITAATMEEMYERAEFGKQIGTIIVMIDLVIGYTAIQTMAVWARKNDMILHLHRAGNSTYSRQKIHGMNFRVICKWMRMAGVDHIHAGTVVGKLEGDPLMIRGFYNTLLETHLDINLPQGIFFQQDWASLRKVAPVASGGIHCGQMHQLLDYLGNDVVLQFGGGTIGHPDGIQAGATANRVALESMVIARNEGRDYVAEGPQILRDAAKTCGPLQTALDLWKDITF

(The sequence listing continues in the following parts.)

We claim:

1. A transgenic seed for a crop plant, wherein the genome of said transgenic seed comprises a recombinant DNA which expresses a protein having the amino acid sequence SEQ ID NO: 481, wherein transgenic plants grown from said seed exhibit increased yield as compared to control plants of the same species lacking said recombinant DNA.

2. The transgenic seed of claim 1, wherein the seed is corn, soybean, wheat or cotton seed.

3. A method of facilitating production of a crop comprising providing to a grower of said crop transgenic seeds, wherein the genome of said transgenic seeds comprises a recombinant DNA which expresses a protein having the amino acid sequence SEQ ID NO: 481, and wherein plants grown from said transgenic seeds exhibit increased yield as compared to control plants of the same species lacking said recombinant DNA; and obtaining from said transgenic seeds transgenic plants comprising said recombinant DNA, thereby facilitating production of said crop.

4. A method according to claim 3, wherein (a) said control plants are susceptible to a yield-limiting environment; and (b) transgenic plants grown from said transgenic seeds thrive in said yield-limiting environment.

5. The method of claim 3, wherein the transgenic seeds are corn, soybean, wheat or cotton seeds.

6. A method of producing a plant comprising planting transgenic seeds, wherein the genome of said transgenic seeds comprises recombinant DNA which expresses a protein having the amino acid sequence SEQ ID NO: 481, so that at least one plant grown from said transgenic seeds exhibits increased yield as compared to control plants of the same species lacking said recombinant DNA; and harvesting said at least one plant.

* * * * *

UNITED STATES PATENT AND TRADEMARK OFFICE

CERTIFICATE OF CORRECTION

PATENT NO. : 9,115,368 B2
APPLICATION NO. : 11/982700
DATED : August 25, 2015
INVENTOR(S) : Abad et al.

It is certified that error appears in the above-identified patent and that said Letters Patent is hereby corrected as shown below:

Title page, item (75) "Inventors", in column 1, line 1-11, delete "Mark Scott Abad, Webster Groves, MO (US); Jaclyn Cleveland, Morrisville, NC (US); Bettina Darveaux, Hillsborough, NC (US); Angie Ferguson, Morrisville, NC (US); Barry S. Goldman, St. Louis, MO (US); Balasulojini Karunanandaa, Creve Coeur, MO (US); Maria McDonald, Garner, NC (US); Daniel Riggsbee, Raleigh, NC (US); Mahmood Sayed, Cary, NC (US); Erin Slaten, Woodland Hills, CA (US)" and insert --Mark Scott Abad, Webster Groves, MO (US); Barry S. Goldman, St. Louis, MO (US); Balasulojini Karunanandaa, Creve Coeur, MO (US)--, therefor Title page, item (56) "Other Publications", line 27, delete "10179338.8,Partial" and insert --10179338.8, Partial--, therefor Signed and Sealed this
Twenty-eighth Day of June, 2016

Michelle K. Lee
*Director of the United States Patent and Trademark Office*